United States Patent 11,931,406 (FLAVIVIRUS VACCINE) - sequence listing, part 17

SEQ ID NO: 8284 - RNA, 9879 nt, Artificial Sequence
  derived and/or modified CDS sequence (opt1) from DENV-1__FJ373305__SS-prME
agcgugaccaugcugcugaugcugaugcccaccgcccuggccuuccaccucaccacccggggcggggagccccacaugaucgugagcaagcaggagcggggcaagagccugcuguucaagaccuccgccggggugaacaugugcacccucaucgccauggaccugggcgagcugugcgaggacaccaugaccuacaagugcccccggaucaccgagaccgagcccgacgacguggacugcuggugcaacgccacggacaccugggucaccuacgggaccugcagccagacgggcgagcaccggcgggacaagcgguccguggcccucgcgccccacgugggccuggggcuggagacccgcaccgagaccuggaugagcuccgagggcgcguggaagcagauccagcgggucgagacgugggcccuccggcaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagguggccgagacccagcacggcaccgugcugguccagaucaaguacgagggcaccgacgcgcccugcaagauccccuuccugacgcaggacgagaagggggugacccagaacggccggcugaucaccgccaacccgaucgugaccgacaaggagaagcccgucaacaucgaggccgagccgcccuucggggagagcuacaucaucaucggcgccggcgagaaggcgcucaagcuguccugguucaagaaggggagcuccaucggcaagauguucgaggccacggcccgcggggcccggcgcauggccauccugggcgacaccgcgugggacuucgggagcaucggcggcguguucaccuccguggggaagcucguccaccagaucuucggcaccgccuacggggugcuguucagcggcguguccuggacgaugaagaucgggaucggcguccugcucaccuggcugggccugaacagccgcuccaccagccucuccaugaccugcaucgccguggggcuggugacgcuguaccucggcgucauggugcaggccgacagcgggugcgugaucaacuggaagggccgggagcugaagugcggguccggcaucuucgucaccaacgaggugcacaccuggaccgagcaguacaaguuccaggccgacagcccgaagcgccugagcgcggccaucggcaaggccugggaggagggggugugcggcauccgguccgccacccgccucgagaacaucauguggaagcagaucagcaacgagcugaaccacauccugcucgagaacgacaugaaguucacggucguggugggggacgucgccggcauccuggcgcaggggaagaagaugauccggccccagcccauggaguacaaguacuccuggaaguccuggggcaaggccaagaucaucggcgccgacgugcagaacaccaccuucaucaucgacgggcccaacaccccggagugccccgacgaccagcgcgccuggaacaucugggagguggaggacuacggcuucgggaucuucacgaccaacaucuggcugaagcuccgggacuccuacacccaggucugcgaccaccgccugaugagcgcggccaucaaggacuccaaggccgugcacgccgacaugggcuacuggaucgagagcgagaagaacgagaccuggaagcuggcccgggcguccuucaucgaggugaagacgugcaucuggcccaagagccacacccucugguccaacggcguccuggagagcgagaugaucauccccaagaucuacgggggcccgaucucccagcacaacuaccgccccggguacuucacccagaccgccggccccuggcaccuggggaagcucgagcuggacuucgaccugugcgagggcacgaccgugguggucgacgagcacugcggcaaccgggggccgagccuccgcaccaccacggugaccggcaagaucauccacgaguggugcugccgguccugcacccugccgccccugcgcuuccgcggggaggacggcugcugguacgggauggagauccgccccgugaaggagaaggaggagaaccucgucaagagcaugguguccgccggcagcggcgagguggacagcuucucccuggggcugcucugcaucagcaucaucaucgaggaggucaugcggucccgcuggagccggaagaugcugaugaccggcacgcuggccguguucuuccuccugaucauggggcagcugaccuggaacgaccucauccgccugugcaucauggugggcgccaacgcguccgaccgcauggggaugggcaccaccuaccuggcccucauggccacguucaagaugcggccgauguucgccgucggccugcuguuccgccggcucaccagccgcgaggugcugcugcucaccaucgggcugucccugguggccagcgucgagcuccccaacucccuggaggagcugggcgacgggcucgcgaugggcaucaugauccugaagcugcucaccgacuuccagagccaccagcugugggccacgcugcucucccugaccuucaucaagaccaccgugagccugcacuacgccuggaagacgauggccaugguccucuccaucgugagccuguucccccugugccucuccaccaccagccagaagaccacguggcugcccgugcugcucggcucccuggggugcaagccgcugaccauguuccucaucgcggagaacaagaucuggggccggcgcagcuggccccugaacgaggggaucauggccgucggcaucguguccauccugcucagcagccugcugaagaacgacgugccccucgccgggccccugaucgccggcggcaugcugaucgccugcuacgucaucuccgggagcuccgcggaccucagccuggagaaggccgccgagguguccugggaggaggaggccgagcacagcggcgccucccacaacauccugguggagguccaggacgacgggaccaugaagaucaaggacgaggagcgggacgacacccucaccauccugcugaaggcgacgcuccuggccgugagcggcguguacccgcuguccauccccgccacccucuucgucugguacuucuggcagaagaagaagcagcgcagcggggugcugugggacacccccagcccgcccgagguggagcgggccguccuggacgacggcaucuaccgcaucaugcagcggggccugcucgggcgcagccaggugggcgugggggucuuccaggagaacguguuccacaccauguggcacgugacgcggggcgccguccugauguaccaggggaagcgccuggagcccuccugggcgagcgugaagaaggaccucaucuccuacggcggcggguggcggcugcagggcagcuggaacaccggggaggaggugcaggucaucgccguggagcccggcaagaaccccaagaacgugcagaccgcccccgggaccuucaagacgcccgagggcgaggucggcgccaucgcccuggacuucaagcccgggaccuccggcagccccaucgugaaccgcgaggggaagaucgugggccucuacggcaacggggucgugaccaccuccggcacguacgugagcgcgaucgcccaggccaaggccagccaggaggggccgcugcccgagaucgaggacgaggucuuccggaagcgcaaccugaccaucauggaccuccaccccggcuccgggaagacccggcgcuaccugccggcgaucgugcgggaggccaucaagcgcaagcugcgcacccucauccuggcccccacgcggguggucgccagcgagauggccgaggcgcugaagggcaugcccauccgcuaccagaccaccgccgugaaguccgagcacaccggcaaggagaucguggaccucaugugccacgccacguucaccaugcggcugcugagccccguccgcgugccgaacuacaacaugaucaucauggacgaggcccacuucaccgaccccuccagcaucgccgcgcggggguacaucuccacccgcgugggcaugggggaggccgccgccaucuucaugacggccacgccgcccggcagcgucgaggcguucccgcaguccaacgccgugauccaggacgaggagcgggacauccccgagcgcagcuggaacuccggguacgaguggaucaccgacuuccccggcaagaccgugugguucguccccagcaucaaguccggcaacgacaucgccaacugccuccggaagaacgggaagcgcgugauccagcugagccggaagacguucgacaccgaguaccagaagaccaagaacaacgacugggacuacguggucaccacggacaucuccgagaugggcgccaacuuccgcgcggaccgggugaucgacccgcgccggugccugaagcccgugauccucaaggacgggcccgagcgcgucauccuggccggccccaugccggugaccgucgccagcgccgcccagcggcgcgggcggaucggccgcaaccacaacaaggagggcgaccaguacaucuacauggggcagccccugaacaacgacgaggaccacgcgcacuggaccgaggccaagaugcuccuggacaacaucaacacccccgagggcaucauccccgcccuguucgagccggagcgcgagaaguccgccgccaucgacggggaguaccggcuccgcggcgaggcgcggaagacguucguggagcugaugcgccgcggggaccugcccguguggcucagcuacaaggucgccuccgagggcuuccaguacagcgaccgccgguggugcuucgacggcgagcgcaacaaccaggugcuggaggagaacauggacguggagaucuggaccaaggagggggagcggaagaagcugcgcccccgguggcucgacgcccgcaccuacagcgacccccuggcccugcgggaguucaaggaguucgccgcgggccgccgguccgucagcggggaccucauccuggagaucggcaagcugccgcagcaccucacccagcgcgcccagaacgcccuggacaaccuggugaugcuccacaacuccgagcagggcgggcgggccuaccgccacgcgauggaggagcugcccgacacgaucgagacccugaugcuccuggcccugaucgccgugcucaccggcggggucacccuguucuuccugagcggccgggggcucggcaagaccuccaucggccugcugugcgugauggccagcuccgugcuccuguggauggccagcgucgagccccacuggaucgcggccuccaucauccuggaguucuuccucauggugcugcugauccccgagccggaccgccagcggacgccccaggacaaccagcucgccuacguggucaucgggcugcuguucaugauccucaccguggccgccaacgagaugggccugcuggagaccaccaagaaggaccucgggaucggccacguggcggucgagaaccaccaccacgccgccaugcuggacguggaccugcaccccgccagcgccuggacgcucuacgcgguggccaccaccaucaucaccccgaugaugcgccacacgaucgagaacaccaccgccaacaucucccugaccgccaucgccaaccaggcggccauccugauggggcucgacaagggcuggcccaucagcaagauggacaucggcgucccccugcuggcccucgggugcuacucccaggugaacccccugacgcugaccgccgcggugcucaugcuggucgcccacuacgccaucaucggcccggggcugcaggccaaggccacccgcgaggcgcagaagcggaccgccgccggcaucaugaagaaccccacgguggacgggaucguggccaucgaccucgaccccgucguguacgacgccaaguucgagaagcagcugggccagaucaugcugcucauccugugcaccagccagauccugcucaugcgcaccaccugggcgcugugcgaguccaucacgcuggccaccggcccccucaccacccugugggaggggagcccgggcaaguucuggaacacgaccaucgccguguccauggccaacaucuuccgggggagcuaccuggccggcgcgggccucgccuucucccugaugaagucccucgggggcgggcgccgggggaccggggcccagggcgagacccucggcgagaaguggaagcgccagcugaaccagcugagcaaguccgaguucaacacguacaagcggagcgggaucauggaggucgaccgcuccgaggccaaggagggccucaagcgcggggagaccaccaagcacgcggugagccgcggcaccgccaagcugcggugguucguggagcgcaaccuggucaagcccgaggggaaggugaucgaccugggcugcggccgcggcgggugguccuacuacugcgccgggcucaagaaggugacggaggucaagggguacaccaagggcggccccggccacgaggagcccaucccgauggccaccuacggguggaaccuggugaagcugcacagcggcaaggacguguucuucaucccgcccgagaagugcgacacccuccugugcgacaucggggaguccagccccaacccgacgaucgaggagggccgcacccugcggguccucaagaugguggagcccuggcugcgcgggaaccaguucugcaucaagauccugaaccccuacaugcccuccguggucgagacccucgagcagaugcagcggaagcacggcggcaugcuggugcgcaacccgcugagccggaacuccacccacgagauguacugggugagcugcgggaccggcaacaucgucuccgccgugaacaugacgagccgcaugcuccugaaccgcuucaccauggcgcaccggaagcccaccuacgagcgcgacguggaccugggggccggcacccggcacgucgccguggagcccgagguggccaaccucgacaucaucggccagcgcaucgagaacaucaagcacgagcacaaguccacguggcacuacgacgaggacaaccccuacaagaccugggccuaccacgggagcuacgaggucaagccguccggcagcgcguccagcauggugaacggggucgugaagcugcugaccaagcccugggacgugauccccauggucacccagaucgccaugacggacaccacccccuucggccagcagcggguguucaaggagaagguggacacccgcacgccgaaggccaagcgggggaccgcccagaucauggaggucaccgccaaguggcucuggggcuuccugagccgcaacaagaagccccggaucugcacccgcgaggaguucacgcggaaggugcgcuccaacgcggccaucggcgccguguucgucgacgagaaccaguggaacagcgccaaggaggcgguggaggacgagcgguucugggaccuggugcaccgcgagcgggagcuccacaagcaggggaagugcgcgaccugcgucuacaacaugaugggcaagcgcgagaagaagcugggggaguucggcaaggccaaggggucccgggccaucugguacauguggcugggcgcccgcuuccucgaguucgaggcgcugggcuucaugaacgaggaccacugguucagccgggagaacucccugagcgggguggagggcgaggggcuccacaagcugggcuacauccugcgcgacaucuccaagauccccgggggcaacauguacgccgacgacaccgccggcugggacacccggaucacggaggacgaccuccagaacgaggcccgcaucaccgacaucauggagccggagcacgcccugcuggccaagagcaucuucaagcucaccuaccagaacaaggugguccgcgugcagcggcccgccaagaacgggaccgugauggacgucaucucccgccgggaccagcgcggcagcggccagguggggacguacggccugaacaccuucaccaacauggaggcccagcugauccggcagauggaguccgaggggaucuucagccccuccgagcucgagacccccaaccuggccgagcgcgugcuggacuggcucgagaaguacggcgucgagcggcugaagcgcauggccaucagcggggacgacugcguggugaagccgaucgacgaccgguucgcgacggcccugaccgcccucaacgacaugggcaagguccgcaaggacaucccccagugggagcccuccaagggguggaacgacuggcagcagguccccuucugcagccaccacuuccaccagcugaucaugaaggacggccgggagaucguggucccgugccgcaaccaggacgagcuggugggccgggcccgcgugucccagggggccggcuggagccuccgggagaccgcgugccugggcaagagcuacgcccagauguggcagcugauguacuuccaccgccgggaccuccgccuggccgccaacgcgaucugcuccgccguccccguggacuggauccccaccagccggacgaccugguccauccacgcccaccaccaguggaugaccaccgaggacaugcugagcguguggaaccgcgucuggaucgaggagaaccccuggauggaggacaagacgcacaucuccagcuggggcgacgugccguaccucgggaagcgcgaggaccaguggugcggcucccugaucggccugaccgcccgggccaccugggcgaccaacauccagguggccaucaaccagguccgccggcucaucgggaacgagaacuaccuggacuacaugaccagcaugaagcgcuucaagaacgagggcgaccccgagggggcccugugguga

SEQ ID NO: 8285 - RNA, 9879 nt, Artificial Sequence
  derived and/or modified CDS sequence (opt1) from DENV-1__EU660402__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgaguucugcgaggacacgaugaccuacaagugcccccgcaucaccgaggccgagcccgacgacguggacugcuggugcaacgccaccgacaccugggugaccuacgggaccugcagccagaccggcgagcaccggcgggacaagcgguccguggcccuggcgccccacgugggccucgggcuggagacgcgcaccgagaccuggaugagcuccgagggcgccuggaagcagauccagcgggucgagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugcccgacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaagaucguccaguacgagaaccugaaguacagcgugaucgugaccguccacaccggcgaccagcaccagguggggaacgaguccacggagcacggcaccaccgcgaccaucacgccccaggcccccagcacggagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccagcggggccuccaccagccaggagaccuggaaccggcaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcauguccuacgucaugugcaccgggagcuucaagcuggagaaggagguggcggagacccagcacggcacggugcucguccagaucaaguacgagggcaucgacgcccccugcaagauccccuucuccacccaggacgagaagggggugacccagaacggccggcugaucaccgccaacccgaucgugacggacaaggagaagcccgucaacaucgaggccgagccgcccuucggggagagcuacaucgugaucggcgcgggcgagaaggcccugaagcuguccugguucaagaaggggagcuccaucggcaagauguucgaggccaccgcccgcggggcccggcgcauggcgauccucggcgacaccgccugggacuucgggagcaucggcggcguguucaccuccgucgggaagcuggugcaccagaucuucggcacggccuacggggugcuguucagcggcgucuccuggaccaugaagaucgggaucggcgugcuccugaccuggcugggccucaacagccgcuccaccagccuguccaugacgugcaucgccguggggcuggucacccucuaccugggcgugauggugcaggccgacagcgggugcgucaucaacuggaagggccgggagcugaagugcgggagcggcaucuucgugaccaacgaggugcacaccuggacggagcaguacaaguuccaggcggacuccccgaagcgccucagcgccgccaucggcaaggccugggaggagggggucugcggcauccgguccgccacccgccuggagaacaucauguggaagcagaucagcaacgagcugaaccacauccuccuggagaacgacaugaagcugaccgugguggucggggacguggcgggcauccucgcccaggggaagaagaugauccggccccagcccauggaguacaaguacuccuggaagaucuggggcaaggccaagaucaucggcgccgacgugcagaacaccaccuucaucaucgacgggcccaacacgccggagugccccgacgaccagcgcgcguggaacaucugggaggucgaggacuacggcuucgggaucuucaccaccaacaucuggcugaagcugcgggacagcuacacccaggugugcgaccaccgccucauguccgccgccaucaaggacagcaaggccgugcacgccgacaugggcuacuggaucgaguccgagaagaacgagacguggaagcuggcgcgggccagcuucaucgaggucaagaccugcaucuggcccaagucccacacccuguggagcaacggcgugcucgaguccgagaugaucauccccaagaucuacgggggcccgaucagccagcacaacuaccgccccggguacuucacccagacggccggccccuggcaccuggggaagcuggagcucgacuucgaccugugcgagggcaccaccguggucguggacgagcacugcggcaaccgggggccgucccugcgcaccacgaccgugaccggcaagaucauccacgaguggugcugccggagcugcacccugccgccccuccgcuucaagggggaggacggcugcugguacgggauggagauccggcccgucaaggagaaggaggagaaccuggugaaguccauggugagcgccggcagcggcgaggucgacuccuucagccucgggcugcugugcaucuccaucaugaucgaggaggugaugcgcagccgguggucccgcaagaugcucaugacgggcacccuggccguguucuuccugcucaucauggggcagcugaccuggaacgaccugauccggcucugcaucauggucggcgcgaacgccuacgaccgcauggggaugggcaccacguaccuggcccugauggccaccuucaagaugcgcccgauguucgccgugggccuccuguuccggcgccugaccagccgggaggugcuccugcugaccaucgggcucucccuggucgcgagcguggagcugcccaacucccucgaggagcugggcgacgggcuggccaugggcaucaugauccucaagcugcugacggacuuccagagccaccagcucugggccacccugcugucccucaccuucauccgcaccacguucagccugcacuacgccuggaagaccauggcgaugguccuguccaucgugagccucuucccccugugccuguccaccaccagccagaagacgaccuggcuccccgugcugcugggcucccucgggugcaagccgcugaccauguuccugaucgccgagaacaagaucuggggccggaaguccuggccccucaacgaggggaucauggccgucggcaucguguccauccugcugagcagccuccugaagaacgacgugccccuggccgggccccucaucgccggcggcaugcugaucgcgugcuacgucaucuccgggagcuccgccgaccugagccucgagaaggccgccgagguguccugggaggaggaggccgagcacagcggcgcgucccacaacauccugguggagguccaggacgacgggaccaugaagaucaaggacgaggagcgcgacgacacgcugaccauccuccugaaggccacccugcucgccgugagcggcguguacccgcuguccauccccgccacccuguucgucugguacuucuggcagaagaagaagcagcggagcggggugcucugggacacccccagcccgcccgagguggagcgcgccguccuggacgacggcaucuaccggaucaugcagcgcggccugcuggggcggagccaggugggcgugggggucuuccaggagaacguguuccacacgauguggcacgugacccgcggcgcgguccucauguaccaggggaagcggcuggagcccuccugggccagcgugaagaaggaccugaucuccuacggcggcggguggcgccuccagggcagcuggaacaccggggaggaggugcaggucaucgccguggagcccggcaagaaccccaagaacgugcagaccgcccccgggacguucaagaccuccgagggcgaggucggcgccaucgcgcuggacuucaagcccgggaccagcggcucccccaucgugaaccgggaggggaagaucgugggccuguacggcaacggggucgugaccacgagcggcaccuacgugagcgccaucgcccaggccaaggcgucccaggaggggccccucccggagaucgaggacgaggucuuccgcaagcggaaccugaccaucauggaccugcaccccggcagcgggaagacccgccgguaccuccccgccaucgugcgcgaggccaucaagcggcgccugcgcacgcugauccucgccccgacccggguggucgccuccgagauggcggaggcccugaagggcaugcccauccgcuaccagaccaccgccgucaagagcgagcacacgggcaaggagaucguggaccugaugugccacgccaccuucaccaugcggcuccugucccccguccgcgugcccaacuacaacaugaucaucauggacgaggcccacuucaccgacccgagcuccaucgcggcccggggguacaucagcacgcgcgugggcaugggggaggccgccgccaucuucaugaccgcgacgccgcccggcuccgucgaggccuucccccagagcaacgccgugauccaggacgaggagcgggacaucccggagcgcuccuggaacagcggguacgaguggaucaccgacuuccccggcaagacggugugguucguccccuccaucaagagcggcaacgacaucgccaacugccugcggaagaacgggaagcgcgugauccagcucucccggaagaccuucgacaccgaguaccagaagaccaagaacaacgacugggacuacguggucacgaccgacaucagcgagaugggcgcgaacuuccgcgccgaccgggugaucgacccccgccggugccugaagccggugauccugaaggacgggcccgagcgcgucauccucgccggccccaugcccgugaccgucgccuccgccgcgcagcggcgcgggcggaucggccgcaaccacaacaaggagggcgaccaguacaucuacauggggcagccgcugaacaacgacgaggaccacgcccacuggaccgaggccaagaugcugcucgacaacaucaacacgcccgagggcaucauccccgcccuguucgagcccgagcgcgagaaguccgccgcgaucgacggggaguaccggcugcgcggcgaggcccggaagaccuucguggagcucaugcgccgcggggaccugccgguguggcugucccacaaggucgccagcgagggcuuccaguacagcgaccgccgguggugcuucgacggcgagcgcaacaaccaggugcucgaggagaacauggacguggagaucuggaccaaggagggggagcggaagaagcugcgcccccgguggcuggacgcccgcaccuacuccgacccccucgcccugcgggaguucaaggaguucgcggccggccgccggagcgucuccggggaccugauccucgagaucggcaagcugccccagcaccugacgcagcgcgcccagaacgcccucgacaaccuggugaugcugcacaacagcgagcagggcgggcgggcguaccgccacgccauggaggagcucccggacaccaucgagacccugaugcugcucgcccugaucgccgugcugaccggcggggucaugcuguucuuccuguccggccgggggcugggcaagacgagcaucggccuccugugcgugauggccuccagcgugcugcucuggauggcguccgucgagccccacuggaucgccgccagcaucauccuggaguucuuccugauggugcuccugauccccgagcccgaccgccagcggaccccgcaggacaaccagcuggccuacguggucaucgggcuccuguucaugauccugaccguggccgcgaacgagaugggccuccuggagaccaccaagaaggaccuggggaucggccacguggccgucgagaaccaccaccacgccgccaugcucgacguggaccugcaccccgccuccgcguggacgcuguacgccguggccaccaccaucaucacccccaugaugcgccacacgaucgagaacaccaccgccaacaucagccucaccgccaucgcgaaccaggccgccauccugauggggcuggacaagggcuggccgaucuccaagauggacaucggcgucccccuccuggcccuggggugcuacagccaggugaacccccucacgcugaccgcggccgugcugaugcucgucgcccacuacgccaucaucggccccgggcugcaggccaaggcgacccgcgaggcccagaagcggaccgccgccggcaucaugaagaacccgacgguggacgggaucguggccaucgaccuggaccccgucguguacgacgcgaaguucgagaagcagcucggccagaucaugcugcugauccucugcaccucccagauccugcugaugcgcaccaccugggcccucugcgagagcaucacgcuggccaccggcccccugaccacccucugggaggggucccccggcaaguucuggaacacgaccaucgccgugagcauggccaacaucuuccggggguccuaccuggcgggcgccggccuggccuucagccucaugaagucccucgggggcgggcgccgggggaccggggcccagggcgagacccugggcgagaaguggaagcgccagcucaaccagcuguccaagagcgaguucaacacguacaagcgguccgggaucauggaggucgaccgcagcgaggcgaaggagggccugaagcgcggggagaccaccaagcacgccgugucccgcggcaccgccaagcuccggugguucguggagcgcaaccuggucaagccggaggggaaggugaucgaccugggcugcggccgcggcggguggagcuacuacugcgccgggcugaagaaggugacggaggucaagggguacaccaagggcgggcccggccacgaggagcccauccccauggccaccuacggguggaaccucgugaagcugcacuccggcaaggacguguucuucaucccgcccgagaagugcgacacccugcucugcgacaucggggagagcucccccaaccccacgaucgaggagggccgcacccugcggguccugaagaugguggagccguggcuccgcgggaaccaguucugcaucaagauccugaaccccuacaugcccagcguggucgagacccuggagcagaugcagcggaagcacggcggcaugcucgugcgcaacccccugucccggaacagcacccacgagauguacuggguguccugcgggacgggcaacaucgucagcgcggugaacaugaccucccgcaugcugcucaaccgcuucaccauggcccaccggaagccgaccuacgagcgcgacguggaccugggggccggcacccggcacgucgccguggagcccgagguggccaaccuggacaucaucggccagcgcaucgagaacaucaagcacgagcacaagagcacguggcacuacgacgaggacaaccccuacaagaccugggcguaccacggguccuacgaggucaagcccagcggcuccgccagcagcauggugaacggggucgugaagcuccugaccaagccgugggacgugauccccauggucacccagaucgccaugacggacaccacccccuucggccagcagcggguguucaaggagaagguggacacccgcacgcccaaggccaagcgggggaccgcccagaucauggaggucaccgcgaaguggcuguggggcuuccucucccgcaacaagaagccgcggaucugcacccgcgaggaguucacgcggaaggugcgcagcaacgccgccaucggcgccguguucgucgacgagaaccaguggaacuccgcgaaggaggccguggaggacgagcgguucugggaccuggugcaccgcgagcgggagcugcacaagcaggggaagugcgcgaccugcgucuacaacaugaugggcaagcgcgagaagaagcucggggaguucggcaaggccaaggggagccgggccaucugguacauguggcugggcgcgcgcuuccuggaguucgaggcccucggcuucaugaacgaggaccacugguucucccgggagaacagccuguccgggguggagggcgaggggcugcacaagcucggcuacauccugcgcgacaucagcaagauccccgggggcaacauguacgccgacgacaccgccggcugggacacccggaucacggaggacgaccugcagaacgaggccaagaucaccgacaucauggagcccgagcacgcgcuccuggccaaguccaucuucaagcugaccuaccagaacaaggugguccgcgugcagcgcccggccaagaacgggaccgugauggacgucaucagccggcgcgaccagcggggcuccggccaggugggcacguacggccucaacaccuucaccaacauggaggcccagcugauccgccagauggagagcgaggggaucuucucccccagcgagcuggagacccccaaccucgccggccgggugcuggacuggcuggagaagcacggggucgagcgccucaagcggauggcgaucuccggcgacgacugcguggugaagcccaucgacgaccgcuucgccacggcccugaccgcccugaacgacauggggaagguccggaaggacaucccgcagugggagcccagcaagggcuggaacgacuggcagcagguccccuucugcucccaccacuuccaccagcucaucaugaaggacggccgcgagaucgugguccccugccggaaccaggacgagcugguggggcgcgcccgggugagccagggcgcgggguggagccugcgcgagaccgccugccucggcaaguccuacgcccagauguggcagcugauguacuuccaccggcgcgaccugcggcucgccgcgaacgccaucugcagcgccgucccgguggacugggugcccaccucccgcacgaccuggagcauccacgcccaccaccaguggaugaccaccgaggacaugcuguccgucuggaaccggguguggaucgaggagaaccccuggauggaggacaagacgcacgugagcuccuggggcgacguccccuaccugggcaagcgcgaggaccaguggugcggcagccucaucgggcugaccgcccgcgcgaccugggccaccaacauccagguggccaucaaccaggugcggcgccugcucggcaacgagaacuaccuggacuacaugacguccaugaagcgguucaagaacgagagcgacccggagggggcccugugguga

SEQ ID NO: 8286 - RNA, 9879 nt, Artificial Sequence
  derived and/or modified CDS sequence (opt1) from DENV-1__EU660403__SS-prME
agcgugaccaugcugcugaugcugaugcccaccgcccuggccuuccaccucaccacccggggcggggagccccacaugaucgugagcaagcaggagcggggcaagagccugcuguucaagaccuccgccggggugaacaugugcacccucaucgccauggaccugggcgagcugugcgaggacaccaugaccuacaagugcccccggaucaccgagaccgagcccgacgacguggacugcuggugcaacgccacggacaccugggucaccuacgggaccugcagccagacgggcgagcaccggcgggacaagcgguccguggcccucgcgccccacgugggccuggggcuggagacccgcaccgagaccuggaugagcuccgagggcgcguggaagcagauccagcgggucgagacgugggcccuccggcaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagguggccgagacccagcacggcaccgugcugguccagaucaaguacgagggcaccgacgcgcccugcaagauccccuuccugacgcaggacgagaagggggugacccagaacggccggcugaucaccgccaacccgaucgugaccgacaaggagaagcccgucaacaucgaggccgagccgcccuucggggagagcuacaucaucaucggcgccggcgagaaggcgcucaagcuguccugguucaagaaggggagcuccaucggcaagauguucgaggccacggcccgcggggcccggcgcauggccauccugggcgacaccgcgugggacuucgggagcaucggcggcguguucaccuccguggggaagcucguccaccagaucuucggcaccgccuacggggugcuguucagcggcguguccuggacgaugaagaucgggaucggcguccugcucaccuggcugggccugaacagccgcuccaccagccucuccaugaccugcaucgccguggggcuggugacgcuguaccucggcgucauggugcaggccgacagcgggugcgugaucaacuggaagggccgggagcugaagugcggguccggcaucuucgucaccaacgaggugcacaccuggaccgagcaguacaaguuccaggccgacagcccgaagcgccugagcgcggccaucggcaaggccugggaggagggggugugcggcauccgguccgccacccgccucgagaacaucauguggaagcagaucagcaacgagcugaaccacauccugcucgagaacgacaugaaguucacggucguggugggggacgucgccggcauccuggcgcaggggaagaagaugauccggccccagcccauggaguacaaguacuccuggaaguccuggggcaaggccaagaucaucggcgccgacgugcagaacaccaccuucaucaucgacgggcccaacaccccggagugccccgacgaccagcgcgccuggaacaucugggagguggaggacuacggcuucgggaucuucacgaccaacaucuggcugaagcuccgggacuccuacacccaggucugcgaccaccgccugaugagcgcggccaucaaggacuccaaggccgugcacgccgacaugggcuacuggaucgagagcgagaagaacgagaccuggaagcuggcccgggcguccuucaucgaggugaagacgugcaucuggcccaagagccacacccucugguccaacggcguccuggagagcgagaugaucauccccaagaucuacgggggcccgaucucccagcacaacuaccgccccggguacuucacccagaccgccggccccuggcaccuggggaagcucgagcuggacuucgaccugugcgagggcacgaccgugguggucgacgagcacugcggcaaccgggggccgagccuccgcaccaccacggugaccggcaagaucauccacgaguggugcugccgguccugcacccugccgccccugcgcuuccgcggggaggacggcugcugguacgggauggagauccgccccgugaaggagaaggaggagaaccucgucaagagcaugguguccgccggcagcggcgagguggacagcuucucccuggggcugcucugcaucagcaucaucaucgaggaggucaugcggucccgcuggagccggaagaugcugaugaccggcacgcuggccguguucuuccuccugaucauggggcagcugaccuggaacgaccucauccgccugugcaucauggugggcgccaacgcguccgaccgcauggggaugggcaccaccuaccuggcccucauggccacguucaagaugcggccgauguucgccgucggccugcuguuccgccggcucaccagccgcgaggugcugcugcucaccaucgggcugucccugguggccagcgucgagcuccccaacucccuggaggagcugggcgacgggcucgcgaugggcaucaugauccugaagcugcucaccgacuuccagagccaccagcugugggccacgcugcucucccugaccuucaucaagaccaccuucagccugcacuacgccuggaagacgauggccauggugcucuccaucgucagccuguucccccugugccucuccaccaccagccagaagaccacguggcugcccgugcugcucggcucccuggggugcaagccgcugaccauguuccucaucgcggagaacaagaucuggggccggcgcagcuggccccugaacgaggggaucauggccgugggcaucgucuccauccugcucagcagccugcugaagaacgacgugccccucgccgggccccugaucgccggcggcaugcugaucgccugcuacgugaucuccgggagcuccgcggaccucagccuggagaaggccgccgaggucuccugggaggaggaggccgagcacagcggcgccucccacaacauccugguggaggugcaggacgacgggaccaugaagaucaaggacgaggagcgggacgacacccucaccauccugcugaaggcgacgcuccuggccgucagcggcguguacccgcuguccauccccgccacccucuucgugugguacuucuggcagaagaagaagcagcgcagcgggguccugugggacacccccagcccgcccgagguggagcgggccgugcuggacgacggcaucuaccgcaucaugcagcggggccugcucgggcgcagccaggucggcguggggguguuccaggagaacgucuuccacaccauguggcacgugacgcggggcgccgugcugauguaccaggggaagcgccuggagcccuccugggcgagcgucaagaaggaccucaucuccuacggcggcggguggcggcugcagggcagcuggaacaccggggaggagguccaggugaucgccgucgagcccggcaagaaccccaagaacgugcagaccgcccccgggaccuucaagacgcccgagggcgaggugggcgccaucgcccuggacuucaagcccgggaccuccggcagccccaucgucaaccgcgaggggaagaucgugggccucuacggcaacgggguggucaccaccuccggcacguacgugagcgcgaucgcccaggccaaggccagccaggaggggccgcugcccgagaucgaggacgagguguuccggaagcgcaaccugaccaucauggaccuccaccccggcuccgggaagacccggcgcuaccugccggcgaucguccgggaggccaucaagcgcaagcugcgcacccucauccuggcccccacgcgggugguggccagcgagauggccgaggcgcugaagggcaugcccauccgcuaccagaccaccgccgucaaguccgagcacaccggcaaggagaucguggaccucaugugccacgccacguucaccaugcggcugcugagccccgugcgcgucccgaacuacaacaugaucaucauggacgaggcccacuucaccgaccccuccagcaucgccgcgcggggguacaucuccacccgcgugggcaugggggaggccgccgccaucuucaugacggccacgccgcccggcagcguggaggcguucccgcaguccaacgccgucauccaggacgaggagcgggacauccccgagcgcagcuggaacuccggguacgaguggaucaccgacuuccccggcaagaccgugugguucgugcccagcaucaaguccggcaacgacaucgccaacugccuccggaagaacgggaagcgcgucauccagcugagccggaagacguucgacaccgaguaccagaagaccaagaacaacgacugggacuacguggugaccacggacaucuccgagaugggcgccaacuuccgcgcggaccgggucaucgacccgcgccggugccugaagcccgugauccucaaggacgggcccgagcgcgugauccuggccggccccaugccggucaccguggccagcgccgcccagcggcgcgggcggaucggccgcaaccacaacaaggagggcgaccaguacaucuacauggggcagccccugaacaacgacgaggaccacgcgcacuggaccgaggccaagaugcuccuggacaacaucaacacccccgagggcaucauccccgcccuguucgagccggagcgcgagaaguccgccgccaucgacggggaguaccggcuccgcggcgaggcgcggaagacguucgucgagcugaugcgccgcggggaccugcccguguggcucagcuacaagguggccuccgagggcuuccaguacagcgaccgccgguggugcuucgacggcgagcgcaacaaccagguccuggaggagaacauggacguggagaucuggaccaaggagggggagcggaagaagcugcgcccccgguggcucgacgcccgcaccuacagcgacccccuggcccugcgggaguucaaggaguucgccgcgggccgccgguccgugagcggggaccucauccuggagaucggcaagcugccgcagcaccucacccagcgcgcccagaacgcccuggacaaccuggucaugcuccacaacuccgagcagggcgggcgggccuaccgccacgcgauggaggagcugcccgacacgaucgagacccugaugcuccuggcccugaucgccgugcucaccggcggggugacccuguucuuccugagcggccgggggcucggcaagaccuccaucggccugcugugcgucauggccagcuccgugcuccuguggauggccagcguggagccccacuggaucgcggccuccaucauccuggaguucuuccucaugguccugcugauccccgagccggaccgccagcggacgccccaggacaaccagcucgccuacguggugaucgggcugcuguucaugauccucaccgucgccgccaacgagaugggccugcuggagaccaccaagaaggaccucgggaucggccacguggcgguggagaaccaccaccacgccgccaugcuggacgucgaccugcaccccgccagcgccuggacgcucuacgcgguggccaccaccaucaucaccccgaugaugcgccacacgaucgagaacaccaccgccaacaucucccugaccgccaucgccaaccaggcggccauccugauggggcucgacaagggcuggcccaucagcaagauggacaucggcgugccccugcuggcccucgggugcuacucccaggucaacccccugacgcugaccgccgcggugcucaugcugguggcccacuacgccaucaucggcccggggcugcaggccaaggccacccgcgaggcgcagaagcggaccgccgccggcaucaugaagaaccccacggucgacgggaucguggccaucgaccucgaccccguggucuacgacgccaaguucgagaagcagcugggccagaucaugcugcucauccugugcaccagccagauccugcucaugcgcaccaccugggcgcugugcgaguccaucacgcuggccaccggcccccucaccacccugugggaggggagcccgggcaaguucuggaacacgaccaucgccguguccauggccaacaucuuccgggggagcuaccuggccggcgcgggccucgccuucucccugaugaagucccucgggggcgggcgccgggggaccggggcccagggcgagacccucggcgagaaguggaagcgccagcugaaccagcugagcaaguccgaguucaacacguacaagcggagcgggaucauggagguggaccgcuccgaggccaaggagggccucaagcgcggggagaccaccaagcacgcggucagccgcggcaccgccaagcugcggugguucguggagcgcaaccuggugaagcccgaggggaaggucaucgaccugggcugcggccgcggcgggugguccuacuacugcgccgggcucaagaaggugacggaggugaagggguacaccaagggcggccccggccacgaggagcccaucccgauggccaccuacggguggaaccuggucaagcugcacagcggcaaggacguguucuucaucccgcccgagaagugcgacacccuccugugcgacaucggggaguccagccccaacccgacgaucgaggagggccgcacccugcgggugcucaagauggucgagcccuggcugcgcgggaaccaguucugcaucaagauccugaaccccuacaugcccuccgugguggagacccucgagcagaugcagcggaagcacggcggcaugcugguccgcaacccgcugagccggaacuccacccacgagauguacugggugagcugcgggaccggcaacaucguguccgccgucaacaugacgagccgcaugcuccugaaccgcuucaccauggcgcaccggaagcccaccuacgagcgcgacguggaccugggggccggcacccggcacguggccgucgagcccgagguggccaaccucgacaucaucggccagcgcaucgagaacaucaagcacgagcacaaguccacguggcacuacgacgaggacaaccccuacaagaccugggccuaccacgggagcuacgaggugaagccguccggcagcgcguccagcauggucaacgggguggucaagcugcugaccaagcccugggacgugauccccauggugacccagaucgccaugacggacaccacccccuucggccagcagcgggucuucaaggagaagguggacacccgcacgccgaaggccaagcgggggaccgcccagaucauggaggugaccgccaaguggcucuggggcuuccugagccgcaacaagaagccccggaucugcacccgcgaggaguucacgcggaagguccgcuccaacgcggccaucggcgccguguucguggacgagaaccaguggaacagcgccaaggaggcggucgaggacgagcgguucugggaccuggugcaccgcgagcgggagcuccacaagcaggggaagugcgcgaccugcguguacaacaugaugggcaagcgcgagaagaagcugggggaguucggcaaggccaaggggucccgggccaucugguacauguggcugggcgcccgcuuccucgaguucgaggcgcugggcuucaugaacgaggaccacugguucagccgggagaacucccugagcggggucgagggcgaggggcuccacaagcugggcuacauccugcgcgacaucuccaagauccccgggggcaacauguacgccgacgacaccgccggcugggacacccggaucacggaggacgaccuccagaacgaggcccgcaucaccgacaucauggagccggagcacgcccugcuggccaagagcaucuucaagcucaccuaccagaacaagguggugcgcguccagcggcccgccaagaacgggaccgugauggacgugaucucccgccgggaccagcgcggcagcgggcaggucggcacguacggccugaacaccuucaccaacauggaggcccagcugauccggcagauggaguccgaggggaucuucagccccuccgagcucgagacccccaaccuggccgagcgcgugcuggacuggcucgagaaguacggcguggagcggcugaagcgcauggccaucagcggggacgacugcgucgugaagccgaucgacgaccgguucgcgacggcccugaccgcccucaacgacaugggcaaggugcgcaaggacaucccccagugggagcccuccaagggguggaacgacuggcagcagguccccuucugcagccaccacuuccaccagcugaucaugaaggacggccgggagaucguggugccgugccgcaaccaggacgagcuggucggccgggcccgcgugucccagggggccggcuggagccuccgggagaccgcgugccugggcaagagcuacgcccagauguggcagcugauguacuuccaccgccgggaccuccgccuggccgccaacgcgaucugcuccgccgugcccgucgacuggauccccaccagccggacgaccugguccauccacgcccaccaccaguggaugaccaccgaggacaugcugagcguguggaaccgcguguggaucgaggagaaccccuggauggaggacaagacgcacaucuccagcuggggcgacgucccguaccucgggaagcgcgaggaccaguggugcggcucccugaucggccugaccgcccgggccaccugggcgaccaacauccagguggccaucaaccaggugcgccggcucaucgggaacgagaacuaccuggacuacaugaccagcaugaagcgcuucaagaacgagggcgaccccgagggggcccugugguga

SEQ ID NO: 8287 - RNA, 9879 nt, Artificial Sequence
  derived and/or modified CDS sequence (opt1) from DENV-1__EU660397__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccgcaucaccgagaccgagcccgacgacguggacugcuggugcaacgccacggacaccugggugaccuacgggaccugcagccagacgggcgagcaccggcgcgacaagcgguccguggcccucgcgccccacgugggccuggggcuggagacccgcaccgagaccuggaugagcuccgagggcgccuggaagcagauccagcgggucgagacgugggcccuccgccaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugcggggcaugagcuacgucaugugcacgggguccuucaagcucgagaaggagguggccgagacccagcacggcaccgugcugguccagaucaaguacgagggcaccgacgcgcccugcaagauccccuucagcacgcaggacgagaagggggugacccagaacggccgccugaucaccgccaacccgaucgugaccgacaaggagaagcccgucaacaucgaggccgagccgcccuucggggaguccuacaucgugaucggcgccggcgagaaggcgcugaagcucagcugguucaagaagggguccagcaucggcaagauguucgaggccacggcccgcggggcccgccgcauggccauccugggcgacaccgcgugggacuucggguccaucggcggcguguucaccagcgucgggaagcuggugcaccagaucuucggcaccgccuacggggugcuguucuccggcgucagcuggacgaugaagaucgggaucggcgugcugcugaccuggcucggccugaacucccggagcaccucccugagcaugaccugcaucgccguggggcucgucacgcuguaccugggcgugauggugcaggccgacuccgggugcgucaucaacuggaagggccgcgagcucaagugcgggagcggcaucuucgugaccaacgaggugcacaccuggaccgagcaguacaaguuccaggccgacagcccgaagcggcuguccgcggccaucggcaaggccugggaggagggggucugcggcauccgcagcgccacccggcuggagaacaucauguggaagcagaucuccaacgagcucaaccacauccugcuggagaacgacaugaaguucacggugguggucggggacguggccggcauccucgcgcaggggaagaagaugauccgcccccagcccauggaguacaaguacagcuggaaguccuggggcaaggccaagaucaucggcgccgacgugcagaacaccaccuucaucaucgacgggcccaacaccccggagugccccgacgaccagcgggccuggaacaucugggaggucgaggacuacggcuucgggaucuucacgaccaacaucuggcugaagcugcgcgacagcuacacccaggugugcgaccaccggcucauguccgcggccaucaaggacagcaaggccgugcacgccgacaugggcuacuggaucgaguccgagaagaacgagaccuggaagcuggcccgcgcgagcuucaucgaggucaagacgugcaucuggcccaagucccacacccuguggagcaacggcgugcucgaguccgagaugaucauccccaagaucuacgggggcccgaucagccagcacaacuaccggcccggguacuucacccagaccgccggccccuggcaccuggggaagcuggagcucgacuucgaccugugcgagggcacgaccguggucguggacgagcacugcggcaaccgcgggccgucccugcggaccaccacggugaccggcaagaucauccacgaguggugcugccgcagcugcacccugccgccccuccgguuccgcggggaggacggcugcugguacgggauggagauccggcccgucaaggagaaggaggagaaccuggugaaguccauggugagcgccggcagcggcgaggucgacuccuucagccucgggcugcugugcaucuccaucaugaucgaggaggugaugcgcagccgguggucccgcaagaugcucaugaccggcacgcuggccguguucuuccugcucaucauggggcagcugaccuggaacgaccugauccgccucugcaucauggucggcgccaacgcgagcgaccggauggggaugggcaccaccuaccuggcccugauggccacguucaagaugcgcccgauguucgccgugggccuccuguuccggcgccugaccucccgggaggugcuccugcugaccaucgggcucagccuggucgccuccguggagcugcccaacagccucgaggagcugggcgacgggcuggcgaugggcaucaugauccucaagcugcugaccgacuuccagucccaccagcucugggccacgcugcugagccucaccuucaucaagaccaccuucucccugcacuacgccuggaagacgauggccaugguccugagcaucgugucccucuucccccugugccugagcaccaccucccagaagaccacguggcuccccgugcugcugggcagccucgggugcaagccgcugaccauguuccugaucgcggagaacaagaucuggggccgccgguccuggccccucaacgaggggaucauggccgucggcaucgugagcauccugcugagcucccuccugaagaacgacgugccccuggccgggccccucaucgccggcggcaugcugaucgccugcuacgucaucagcggguccagcgcggaccugucccucgagaaggccgccgaggugagcugggaggaggaggccgagcacuccggcgccagccacaacauccugguggagguccaggacgacgggaccaugaagaucaaggacgaggagcgcgacgacacccugaccauccuccugaaggcgacgcugcucgccguguccggcguguacccgcugagcauccccgccacccuguucgucugguacuucuggcagaagaagaagcagcgguccggggugcucugggacacccccagcccgcccgagguggagcgcgccguccuggacgacggcaucuaccggaucaugcagcgcggccugcuggggcggucccaggugggcgugggggucuuccaggagaacguguuccacaccauguggcacgugacgcgcggcgccguccucauguaccaggggaagcggcuggagcccagcugggcguccgugaagaaggaccugaucagcuacggcggcggguggcgccuccagggcuccuggaacaccggggaggaggugcaggucaucgccguggagcccggcaagaaccccaagaacgugcagaccgcccccgggaccuucaagacgcccgagggcgaggucggcgccaucgcccuggacuucaagcccgggaccagcggcucccccaucgugaaccgggaggggaagaucgugggccuguacggcaacggggucgugaccaccagcggcacguacgugagcgcgaucgcccaggccaaggccucccaggaggggccgcuccccgagaucgaggacgaggucuuccgcaagcggaaccugaccaucauggaccugcaccccggcagcgggaagacccgccgguaccucccggcgaucgugcgcgaggccaucaagcgcaagcugcggacccugauccucgcccccacgcgcguggucgccuccgagauggccgaggcgcugaagggcaugcccauccgguaccagaccaccgccgucaagagcgagcacaccggcaaggagaucguggaccugaugugccacgccacguucaccaugcgccuccugucccccguccgggugccgaacuacaacaugaucaucauggacgaggcccacuucaccgaccccagcuccaucgccgcgcgcggguacaucagcacccgggugggcaugggggaggccgccgccaucuucaugacggccacgccgcccggcuccgucgaggcguucccgcagagcaacgccgugauccaggacgaggagcgcgacauccccgagcgguccuggaacagcggguacgaguggaucaccgacuuccccggcaagaccgugugguucguccccuccaucaagagcggcaacgacaucgccaacugccugcgcaagaacgggaagcgggugauccagcucucccgcaagacguucgacaccgaguaccagaagaccaagaacaacgacugggacuacguggucaccacggacaucagcgagaugggcgccaacuuccgggcggaccgcgugaucgacccgcggcgcugccugaagcccgugauccugaaggacgggcccgagcgggucauccucgccggccccaugccggugaccgucgccuccgccgcccagcgccgggggcgcaucggccgcaaccacaacaaggagggcgaccaguacaucuacauggggcagccccugaacaacgacgaggaccacgcgcacuggaccgaggccaagaugcugcucgacaacaucaacacccccgagggcaucauccccgcccuguucgagccggagcgggagaaguccgccgccaucgacggggaguaccgccugcggggcgaggcgcgcaagacguucguggagcucaugcggcgcggggaccugcccguguggcuguccuacaaggucgccagcgagggcuuccaguacagcgaccggcgcuggugcuucgacggcgagcggaacaaccaggugcucgaggagaacauggacguggagaucuggaccaaggagggggagcgcaagaagcugcggccccgcuggcuggacgcccggaccuacuccgacccccucgcccugcgcgaguucaaggaguucgccgcgggccggcgcagcgucuccggggaccugauccucgagaucggcaagcugccgcagcaccugacccagcgggcccagaacgcccucgacaaccuggugaugcugcacaacagcgagcagggcgggcgcgccuaccggcacgcgauggaggagcuccccgacacgaucgagacccugaugcugcucgcccugaucgccgugcugaccggcggggucacccucuucuuccuguccggccgcgggcugggcaagaccagcaucggccuccugugcgugauggccuccagcgugcugcucuggauggccuccgucgagccccacuggaucgcggccagcaucauccuggaguucuuccugauggugcuccugauccccgagccggaccggcagcgcacgccccaggacaaccagcuggccuacguggucaucgggcuccuguucaugauccugaccguggccgccaacgagaugggccuccuggagaccaccaagaaggaccuggggaucggccacguggcggucgagaaccaccaccacgccgccaugcucgacguggaccugcaccccgccuccgccuggacgcuguacgcgguggccaccaccaucaucaccccgaugaugcgccacacgaucgagaacaccaccgccaacaucagccucaccgccaucgccaaccaggcggccauccugauggggcuggacaagggcuggcccaucuccaagauggacaucggcgucccccuccuggcccuggggugcuacagccaggugaacccccucacgcugaccgccgcggugcugaugcucgucgcccacuacgccaucaucggcccggggcugcaggccaaggccacccgggaggcgcagaagcgcaccgccgccggcaucaugaagaaccccacgguggacgggaucguggccaucgaccuggaccccgucguguacgacgccaaguucgagaagcagcucggccagaucaugcugcugauccucugcaccucccagauccugcugaugcggaccaccugggcgcucugcgagagcaucacgcuggccaccggcccccugaccacccucugggagggguccccgggcaaguucuggaacacgaccaucgccgugagcauggccaacaucuuccgcggguccuaccuggccggcgcgggccuggccuucagccucaugaagucccucgggggcgggcggcgcgggaccggggcccagggcgagacccugggcgagaaguggaagcggcagcucaaccagcuguccaagagcgaguucaacacguacaagcgcuccgggaucauggaggucgaccggagcgaggccaaggagggccugaagcgcggggagaccaccaagcacgcggugucccggggcaccgccaagcuccgcugguucguggagcggaaccuggucaagcccgaggggaaggugaucgaccugggcugcggccgcgggggcuggagcuacuacugcgccgggcugaagaaggugacggaggucaagggcuacaccaagggcgggcccggccacgaggagcccaucccgauggccaccuacggguggaaccucgugaagcugcacuccggcaaggacguguucuucaucccgcccgagaagugcgacacccugcucugcgacaucggggagagcucccccaacccgacgaucgaggagggccggacccugcgcguccugaagaugguggagcccuggcuccgggggaaccaguucugcaucaagauccugaaccccuacaugcccagcguggucgagacccuggagcagaugcagcgcaagcacggcggcaugcucgugcggaacccgcugucccgcaacagcacccacgagauguacuggguguccugcgggaccggcaacaucgucagcgccgugaacaugacgucccgcaugcugcucaaccgguucaccauggcgcaccgcaagcccaccuacgagcgggacguggaccugggggccggcacccgccacgucgccguggagcccgagguggccaaccuggacaucaucggccagcggaucgagaacaucaagcacgagcacaagagcacguggcacuacgacgaggacaaccccuacaagaccugggccuaccacggguccuacgaggucaagccgagcggcuccgcgagcagcauggugaacggggucgugaagcuccugaccaagcccugggacgugauccccauggucacccagaucgccaugacggacaccacccccuucggccagcagcgcguguucaaggagaagguggacacccggacgccgaaggccaagcgcgggaccgcccagaucauggaggucaccgccaaguggcuguggggcuuccucucccggaacaagaagccccgcaucugcacccgggaggaguucacgcgcaaggugcggagcaacgcggccaucggcgccguguucgucgacgagaaccaguggaacuccgccaaggaggcgguggaggacgagcgcuucugggaccuggugcaccgggagcgcgagcugcacaagcaggggaagugcgcgaccugcgucuacaacaugaugggcaagcgggagaagaagcucggggaguucggcaaggccaaggggagccgcgccaucugguacauguggcugggcgcccgguuccuggaguucgaggcgcucggcuucaugaacgaggaccacugguucucccgcgagaacagccuguccgggguggagggcgaggggcugcacaagcucggcuacauccugcgggacaucagcaagauccccgggggcaacauguacgccgacgacaccgccggcugggacacccgcaucacggaggacgaccugcagaacgaggcccgcaucaccgacaucauggagccggagcacgcccuccuggcgaaguccaucuucaagcugaccuaccagaacaaggugguccgggugcagcgccccgccaagaacgggaccgugauggacgucaucagccggcgcgaccagcggggcuccggccaggugggcacguacggccucaacaccuucaccaacauggaggcccagcugauccgccagauggagagcgaggggaucuucucccccagcgagcuggagacccccaaccucgccgagcgggugcuggacuggcuggagaaguacggcgucgagcgccucaagcggauggccaucuccggggacgacugcguggugaagccgaucgacgaccgcuucgcgacggcccugaccgcccugaacgacaugggcaagguccggaaggacaucccccagugggagcccagcaagggguggaacgacuggcagcagguccccuucugcucccaccacuuccaccagcucaucaugaaggacggccgcgagaucguggucccgugccggaaccaggacgagcuggugggccgcgcccgggugagccagggggccggcuggagccugcgcgagaccgcgugccucgggaaguccuacgcccagauguggcagcugauguacuuccaccggcgcgaccugcggcucgccgccaacgcgaucugcagcgccguccccguggacuggauccccaccucccgcacgaccuggagcauccacgcccaccaccaguggaugaccaccgaggacaugcuguccguguggaaccgcgucuggaucgaggagaaccccuggauggaggacaagacgcacaucagcuccuggggcgacgugccguaccuggggaagcgggaggaccaguggugcggcagccucaucggccugaccgcccgcgccaccugggcgaccaacauccagguggccaucaaccagguccggcgccugaucgggaacgagaacuaccucgacuacaugaccuccaugaagcgguucaagaacgagagcgaccccgagggcgcccugugguga

SEQ ID NO: 8288 - RNA, 9879 nt, Artificial Sequence
  derived and/or modified CDS sequence (opt1) from DENV-1__EU687247__SS-prME
agcgugaccaugcugcugaugcugaugcccaccgcccuggccuuccaccucacgacccggggcggggagccccacaugaucguguccaagcaggagcggggcaagagccugcuguucaagaccuccgccggggugaacaugugcacccucaucgccauggaccugggcgaguucugcgaggacaccaugaccuacaagugcccccgcaucaccgaggccgagcccgacgacguggacugcuggugcaacgccaccgacacgugggucaccuacgggaccugcagccagaccggcgagcaccggcgggacaagcgguccguggcccuggcgccccacgugggccucgggcuggagacgcgcaccgagaccuggaugagcuccgagggcgccuggaagcagauccagcgggucgagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugcccgacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaagaucguccaguacgagaaccugaaguacagcgugaucgugaccguccacaccggcgaccagcaccagguggggaacgaguccacggagcacggcaccaccgcgaccaucacgccccaggcccccagcacggagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccagcggggccuccaccagccaggagaccuggaaccggcaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcauguccuacgucaugugcaccgggagcuucaagcuggagaaggagguggcggagacccagcacggcacggugcucguccagaucaaguacgagggcaccgacgcccccugcaagauccccuucuccacccaggacgagaagggggugacccagaacggccggcugaucacggccaacccgaucgugaccgacaaggagaagcccgucaacaucgaggccgagccgcccuucggggagagcuacaucgugaucggcgcgggcgagaaggcccugaagcuguccugguucaagaaggggagcuccaucggcaagauguucgaggccaccgcccgcggggcccggcgcauggcgauccucggcgacaccgccugggacuucgggagcaucggcggcguguucacguccgucgggaagcuggugcaccagaucuucggcaccgccuacggggugcuguucagcggcgucuccuggaccaugaagaucgggaucggcgugcuccugaccuggcugggccucaacagccgcuccacgagccuguccaugaccugcaucgccguggggcuggucacccucuaccugggcgugauggugcaggccgacagcgggugcgucaucaacuggaagggccgggagcugaagugcgggagcggcaucuucgugaccaacgaggugcacacguggaccgagcaguacaaguuccaggcggacuccccgaagcgccucagcgccgccaucggcaaggccugggaggagggggucugcggcauccgguccgccacccgccuggagaacaucauguggaagcagaucagcaacgagcugaaccacauccuccuggagaacgacaugaagcugaccgugguggucggggacguggcgggcauccucgcccaggggaagaagaugauccggccccagcccauggaguacaaguacuccuggaagaucuggggcaaggccaagaucaucggcgccgacgugcagaacaccacguucaucaucgacgggcccaacaccccggagugccccgacgaccagcgcgcguggaacaucugggaggucgaggacuacggcuucgggaucuucaccaccaacaucuggcugaagcugcgggacagcuacacccaggugugcgaccaccgccucauguccgccgccaucaaggacagcaaggccgugcacgccgacaugggcuacuggaucgaguccgagaagaacgagaccuggaagcuggcgcgggccagcuucaucgaggucaagaccugcaucuggcccaagucccacacccuguggagcaacggcgugcucgaguccgagaugaucauccccaagaucuacgggggcccgaucagccagcacaacuaccgccccggguacuucacgcagaccgccggccccuggcaccuggggaagcuggagcucgacuucgaccugugcgagggcaccaccguggucguggacgagcacugcggcaaccgggggccgucccugcgcacgaccaccgugaccggcaagaucauccacgaguggugcugccggagcugcacgcugccgccccuccgcuucaagggggaggacggcugcugguacgggauggagauccggcccgucaaggagaaggaggagaaccuggugaaguccauggugagcgccggcagcggcgaggucgacuccuucagccucgggcugcugugcaucuccaucaugaucgaggaggugaugcgcagccgguggucccgcaagaugcucaugaccggcacccuggccguguucuuccugcucaucauggggcagcugaccuggaacgaccugauccggcucugcaucauggucggcgcgaacgccagcgaccgcauggggaugggcacgaccuaccuggcccugauggccaccuucaagaugcgcccgauguucgccgugggccuccuguuccggcgccugaccucccgggaggugcuccugcugacgaucgggcucagccuggucgcguccguggagcugcccaacagccucgaggagcugggcgacgggcuggccaugggcaucaugauccucaagcugcugaccgacuuccagucccaccagcucugggccacccugcugagccucaccuucauccgcacgaccuucucccugcacuacgccuggaagaccauggcgaugguccugagcaucgugucccucuucccccugugccugagcaccacgucccagaagaccaccuggcuccccgugcugcugggcagccucgggugcaagccgcugaccauguuccugaucgccgagaacaagaucuggggccggaaguccuggccccucaacgaggggaucauggccgucggcaucgugagcauccugcugagcucccuccugaagaacgacgugccccuggccgggccccucaucgccggcggcaugcugaucgcgugcuacgucaucagcggguccagcgccgaccugucccucgagaaggccgccgaggugagcugggaggaggaggccgagcacuccggcgcgagccacaacauccugguggagguccaggacgacgggacgaugaagaucaaggacgaggagcgcgacgacacccugaccauccuccugaaggccacccugcucgccguguccggcguguacccgcugagcauccccgccacccuguucgucugguacuucuggcagaagaagaagcagcgguccggggugcucugggacacgcccagcccgcccgagguggagcgcgccguccuggacgacggcaucuaccggaucaugcagcgcggccugcuggggcggucccaggugggcgugggggucuuccaggagaacguguuccacaccauguggcacgugacccgcggcgcgguccucauguaccaggggaagcggcuggagcccagcugggccuccgugaagaaggaccugaucagcuacggcggcggguggcgccuccagggcuccuggaacaccggggaggaggugcaggucaucgccguggagcccggcaagaaccccaagaacgugcagacggcccccgggaccuucaagaccagcgagggcgaggucggcgccaucgcgcuggacuucaagcccgggaccuccggcagccccaucgugaaccgggaggggaagaucgugggccuguacggcaacggggucgugacgaccagcggcaccuacguguccgccaucgcccaggccaaggcgagccaggaggggccccucccggagaucgaggacgaggucuuccgcaagcggaaccugaccaucauggaccugcaccccggcuccgggaagacgcgccgguaccuccccgccaucgugcgcgaggccaucaagcggcgccugcgcacccugauccucgccccgacccggguggucgccagcgagauggcggaggcccugaagggcaugcccauccgcuaccagaccacggccgugaaguccgagcacaccggcaaggagaucguggaccugaugugccacgccaccuucaccaugcggcuccugagccccguccgcgugcccaacuacaacaugaucaucauggacgaggcccacuucacggacccguccagcaucgcggcccggggguacaucuccacccgcgugggcaugggggaggccgccgccaucuucaugaccgcgacgccgcccggcagcgucgaggccuucccccaguccaacgccgugauccaggacgaggagcgggacaucccggagcgcagcuggaacuccggguacgaguggaucacggacuuccccggcaagaccgugugguucguccccagcaucaaguccggcaacgacaucgccaacugccugcggaagaacgggaagcgcgugauccagcucagccggaagaccuucgacaccgaguaccagaagacgaagaacaacgacugggacuacguggucaccaccgacaucuccgagaugggcgcgaacuuccgcgccgaccgggugaucgacccccgccggugccugaagccggugauccugaaggacgggcccgagcgcgucauccucgccggccccaugcccgugaccgucgccagcgccgcgcagcggcgcgggcggaucggccgcaaccacaacaaggagggcgaccaguacaucuacauggggcagccgcugaacaacgacgaggaccacgcccacuggacggaggccaagaugcugcucgacaacaucaacacccccgagggcaucauccccgcccuguucgagcccgagcgcgagaaguccgccgcgaucgacggggaguaccggcugcgcggcgaggcccggaagaccuucguggagcucaugcgccgcggggaccugccgguguggcugagcuacaaggucgccagcgagggcuuccaguacuccgaccgccgguggugcuucgacggcgagcgcaacaaccaggugcucgaggagaacauggacguggagaucuggaccaaggagggggagcggaagaagcugcgcccccgguggcuggacgcccgcacguacagcgacccccucgcccugcgggaguucaaggaguucgcggccggccgccgguccgucagcggggaccugauccucgagaucggcaagcugccccagcaccugacccagcgcgcccagaacgcccucgacaaccuggugaugcugcacaacuccgagcagggcgggcgggcguaccgccacgccauggaggagcucccggacaccaucgagacccugaugcugcucgcccugaucgccgugcugacgggcggggucacccucuucuuccugagcggccgggggcugggcaagaccuccaucggccuccugugcgugauggccagcuccgugcugcucuggauggcgagcgucgagccccacuggaucgccgccuccaucauccuggaguucuuccugauggugcuccugauccccgagcccgaccgccagcggaccccgcaggacaaccagcuggccuacguggucaucgggcuccuguucaugauccugaccguggccgcgaacgagaugggccuccuggagacgaccaagaaggaccuggggaucggccacguggccgucgagaaccaccaccacgccgccaugcucgacguggaccugcaccccgccagcgcguggacccuguacgccguggccaccacgaucaucacccccaugaugcgccacaccaucgagaacaccacggccaacaucucccucaccgccaucgcgaaccaggccgccauccugauggggcuggacaagggcuggccgaucagcaagauggacaucggcgucccccuccuggcccuggggugcuacucccaggugaacccccucacccugaccgcggccgugcugaugcucgucgcccacuacgccaucaucggccccgggcugcaggccaaggcgacgcgcgaggcccagaagcggaccgccgccggcaucaugaagaacccgaccguggacgggaucguggccaucgaccuggaccccgucguguacgacgcgaaguucgagaagcagcucggccagaucaugcugcugauccucugcaccagccagauccugcugaugcgcacgaccugggcccucugcgaguccaucacccuggccaccggcccccugacgacccucugggaggggagccccggcaaguucuggaacaccaccaucgccguguccauggccaacaucuuccgggggagcuaccuggcgggcgccggccuggccuucagccucaugaagucccucgggggcgggcgccgggggacgggggcccagggcgagacccugggcgagaaguggaagcgccagcucaaccagcugagcaaguccgaguucaacaccuacaagcggagcgggaucauggaggucgaccgcuccgaggcgaaggagggccugaagcgcggggagaccacgaagcacgccgugagccgcggcaccgccaagcuccggugguucguggagcgcaaccuggucaagccggaggggaaggugaucgaccugggcugcggccgcggcgggugguccuacuacugcgccgggcugaagaaggugaccgaggucaagggguacaccaagggcgggcccggccacgaggagcccauccccauggccacguacggguggaaccucgugaagcugcacagcggcaaggacguguucuucaucccgcccgagaagugcgacacccugcucugcgacaucggggaguccagccccaaccccaccaucgaggagggccgcacccugcggguccugaagaugguggagccguggcuccgcgggaaccaguucugcaucaagauccugaaccccuacaugcccuccguggucgagacgcuggagcagaugcagcggaagcacggcggcaugcucgugcgcaacccccugagccggaacuccacccacgagauguacugggugagcugcgggaccggcaacaucgucuccgcggugaacaugaccagccgcaugcugcucaaccgcuucaccauggcccaccggaagccgacguacgagcgcgacguggaccugggggccggcacccggcacgucgccguggagcccgagguggccaaccuggacaucaucggccagcgcaucgagaacaucaagcacgagcacaaguccaccuggcacuacgacgaggacaaccccuacaagaccugggcguaccacgggagcuacgaggucaagcccuccggcagcgccagcuccauggugaacggggucgugaagcuccugacgaagccgugggacgugauccccauggucacccagaucgccaugaccgacaccacgcccuucggccagcagcggguguucaaggagaagguggacacccgcacccccaaggccaagcgggggaccgcccagaucauggaggucacggcgaaguggcuguggggcuuccucagccgcaacaagaagccgcggaucugcacccgcgaggaguucacccggaaggugcgcuccaacgccgccaucggcgccguguucgucgacgagaaccaguggaacagcgcgaaggaggccguggaggacgagcgguucugggaccuggugcaccgcgagcgggagcugcacaagcaggggaagugcgcgaccugcgucuacaacaugaugggcaagcgcgagaagaagcucggggaguucggcaaggccaaggggucccgggccaucugguacauguggcugggcgcgcgcuuccuggaguucgaggcccucggcuucaugaacgaggaccacugguucagccgggagaacucccugagcgggguggagggcgaggggcugcacaagcucggcuacauccugcgcgacaucuccaagauccccgggggcaacauguacgccgacgacacggccggcugggacacccggaucaccgaggacgaccugcagaacgaggccaagaucaccgacaucauggagcccgagcacgcgcuccuggccaagagcaucuucaagcugacguaccagaacaaggugguccgcgugcagcgcccggccaagaacgggaccgugauggacgucaucucccggcgcgaccagcggggcagcggccaggugggcaccuacggccucaacaccuucacgaacauggaggcccagcugauccgccagauggaguccgaggggaucuucagccccuccgagcuggagacccccaaccucgccggccgggugcugaacuggcuggagaagcacggggucgagcgccucaagcggauggcgaucagcggcgacgacugcguggugaagcccaucgacgaccgcuucgccaccgcccugaccgcccugaacgacauggggaagguccggaaggacaucccgcagugggagcccuccaagggcuggaacgacuggcagcagguccccuucugcagccaccacuuccaccagcucaucaugaaggacggccgcgagaucgugguccccugccggaaccaggacgagcugguggggcgcgcccgggugagccagggcgcgggguggucccugcgcgagacggccugccucggcaagagcuacgcccagauguggcagcugauguacuuccaccggcgcgaccugcggcucgccgcgaacgccaucugcuccgccgucccgguggacugggugcccaccagccgcaccaccugguccauccacgcccaccaccaguggaugacgaccgaggacaugcugagcgucuggaaccggguguggaucgaggagaaccccuggauggaggacaagacccacguguccagcuggggcgacguccccuaccugggcaagcgcgaggaccaguggugcggcucccucaucgggcugaccgcccgcgcgacgugggccaccaacauccagguggccaucaaccaggugcggcgccugcucggcaacgagaacuaccuggacuacaugaccagcaugaagcgguucaagaacgaguccgacccggagggggcccugugguga

SEQ ID NO: 8289 - RNA, 9879 nt, Artificial Sequence
  derived and/or modified CDS sequence (opt1) from DENV-1__EU660412__SS-prME
agcgugaccaugcugcucaugcugaugcccaccgcccuggccuuccaccucaccacccgcggcggggagccccacaugaucgugagcaagcaggagcggggcaagagccugcuguucaagaccagcgcgggggugaacaugugcacccucaucgccauggaccugggcgagcugugcgaggacacgaugaccuacaagugcccccgcaucaccgaggccgagcccgacgacguggacugcuggugcaacgccaccgacacgugggugaccuacgggaccugcagccagaccggcgagcaccggcgcgacaagcgguccguggcccucgcgccccacgugggccuggggcuggagacgcgcaccgagaccuggaugagcuccgagggcgccuggaagcagauccagcgggucgagaccugggcccuccgccaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcggugcugcggaagcucugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacaccggcgaccagcaccagguggggaacgaguccacggagcacggcaccaccgcgaccaucacgccccaggcccccacgaccgagauccagcucaccgacuacggggcccugacccuggacugcagcccccgcacgggccucgacuucaacgagaugguccugcugaccaugaaggagaaguccuggcucgugcacaagcagugguuccuggaccugccccuccccuggaccagcggggccagcaccucccaggagacguggaaccggcaggaccugcuggugaccuucaagaccgcccacgcgaagaagcaggaggucguggugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgucaugugcaccggguccuucaagcucgagaaggagguggcggagacgcagcacggcaccgugcugguccagaucaaguacgagggcaccgacgcccccugcaagauccccuucagcacccaggacgagaagggggugacgcagaacggccggcugaucaccgccaacccgaucgugaccgacaaggagaagcccgucaacaucgaggccgagccgcccuucggggaguccuacaucgugaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcgucgggaagcuggugcaccagaucuucggcaccgccuacgggguccucuucuccggcgucagcuggaccaugaagaucgggaucggcgugcugcugacguggcucggccugaacucccgcagcaccucccugagcaugaccugcaucgccguggggcucgucacccuguaccugggcgugauggugcaggccgacuccgggugcgucaucaacuggaagggccgggagcucaagugcgggagcggcaucuucgugacgaacgaggugcacaccuggaccgagcaguacaaguuccaggcggacagcccgaagcgccuguccgccgccaucggcaaggccugggaggagggggucugcggcauccggagcgccacccgccuggagaacaucauguggaagcagaucuccaacgagcucaaccacauccugcuggagaacgacaugaagcucaccgugguggucggggacguggcgggcauccuggggcagggcaagaagaugauccggccccagcccauggaguacaaguacagcuggaaguccuggggcaaggccaagaucaucggggccgacgcccagaacacgaccuucaucaucgacggccccaacaccccggagugccccgacgaccagcgcgcguggaacaucugggagguggaggacuacggguucggcaucuucaccacgaacaucuggcugaagcuccgggacagcuacacccaggucugcgaccaccgccugauguccgccgccaucaaggacagcaaggccgugcacgccgacaugggcuacuggaucgaguccgagaagaacgagaccuggaagcuggcgcgggccagcuucaucgaggugaagaccugcaucuggcccaagucccacacgcucuggagcaacgggguccuggaguccgagaugaucauccccaagaucuacggcgggccgaucagccagcacaacuaccgccccggcuacuucacccagaccgccgggcccuggcaccugggcaagcucgagcuggacuucgaccugugcgagggcaccacggugguggucgacgagcacugcgggaaccggggcccgucccuccgcaccaccaccgugacggggaagaucauccacgaguggugcugccggagcugcacccugccgccccugcgcuuccggggcgaggacgggugcugguacggcauggagauccgccccgugaaggagaaggaggagaaccucgucaaguccauggugagcgccggcagcggggagguggacuccuucagccugggccugcucugcaucuccaucaugaucgaggaggucaugcggagccgcuggucccggaagaugcugaugaccgggacccuggccguguucuuccuccugaucaugggccagcugacguggaacgaccucauccgccugugcaucauggugggggcgaacgccagcgaccgcaugggcaugggcaccaccuaccuggcccucauggccaccuucaagaugcggccgauguucgccgucgggcugcuguuccgccggcucacgucccgcgaggugcugcugcucaccaucggccugagccugguggcguccgucgagcuccccaacagccuggaggagcugggggacggccucgccaugggcaucaugauccugaagcugcucaccgacuuccagucccaccagcugugggccacccugcucagccugacguucaucaagaccaccuucucccugcacuacgccuggaagaccauggcgauggugcucagcaucgucucccuguucccccugugccucagcacgaccucccagaagaccaccuggcugcccgugcugcucgggagccugggcugcaagccgcugacgauguuccucaucgccgagaacaagaucugggggcggaaguccuggccccugaacgagggcaucauggccguggggaucgucagcauccugcucagcucccugcugaagaacgacgugccccucgccggcccccugaucgccggcgggaugcugaucgcgugcuacgugaucagcggcuccagcgccgaccucucccuggagaaggccgccgaggucagcugggaggaggaggccgagcacuccggggcgagccacaacauccugguggaggugcaggacgacggcaccaugaagaucaaggacgaggagcgcgacgacacccucaccauccugcugaaggccacccuccuggccgucuccgggguguacccgcugagcauccccgccacccucuucgugugguacuucuggcagaagaagaagcagcgguccggcguccugugggacacccccagcccgcccgagguggagcgcgccgugcuggacgacggcaucuaccggaucaugcagcgcgggcugcucggccggucccaggucggggugggcguguuccaggagaacgucuuccacaccauguggcacgugacccgcggggcggugcugauguaccagggcaagcggcuggagcccagcugggccuccgucaagaaggaccucaucagcuacggcgggggcuggcgccugcggggguccuggaacacgggcgaggagguccaggugaucgccgucgagcccgggaagaaccccaagaacgugcagaccgcccccggcaccuucaagacccccgagggcgaggugggggccaucgcgcuggacuucaagcccggcacgagcgggucccccaucgucaaccgcgagggcaagaucgugggccucuacgggaacggcguggucaccaccagcgggaccuacgugagcgccaucgcccaggccaaggcgucccaggagggcccgcugcccgagaucgaggacgagguguuccggaagcgcaaccugacgaucauggaccuccaccccgggagcggcaagacccggcgcuaccugccggccaucguccgggaggccaucaagcgcaagcugcgcacccucauccuggcccccacccgggugguggccuccgagauggcggaggcccugaagggcaugcccauccgcuaccagacgaccgccgucaagagcgagcacaccgggaaggagaucguggaccucaugugccacgccaccuucacgaugcggcugcugucccccgugcgcgucccgaacuacaacaugaucaucauggacgaggcccacuucaccgaccccagcuccaucgcggcccggggcuacaucagcacccgcguggggaugggcgaggccgccgccaucuucaugaccgcgacgccgcccggguccguggaggccuucccgcagagcaacgccgucauccaggacgaggagcgggacauccccgagcgcuccuggaacagcggcuacgaguggaucaccgacuuccccggcaagaccgugugguucgugcccuccaucaagagcgggaacgacaucgccaacugccuccggaagaacggcaagcgcgucauccagcugucccggaagaccuucgacacggaguaccagaagaccaagaacaacgacugggacuacguggugaccaccgacaucagcgagaugggggcgaacuuccgcgccgaccgggucaucgacccgcgccggugccugaagcccgugauccucaaggacggccccgagcgcgugauccuggccgggcccaugccggucacgguggccuccgccgcgcagcggcgcggccggaucggccgcaaccacaacaaggagggggaccaguacaucuacaugggccagccccugaacaacgacgaggaccacgcccacuggaccgaggccaagaugcuccuggacaacaucaacacccccgaggggaucauccccgcccuguucgagccggagcgcgagaaguccgccgcggucgacggcgaguaccggcuccgcggggaggcccggaagaccuucguggagcugaugcgccggggcgaccugcccguguggcucuccuacaaggucgccagcgagggcuuccaguacagcgaccgccgguggugcuucgacggggagcgcaacaaccaggugcuggaggagaacauggacguggagaucuggacgaaggagggcgagcggaagaagcugcgcccccgguggcucgacgcccgcaccuacuccgacccccuggcccugcgggaguucaaggaguucgcggccgggcgccggagcgucuccggcgaccucauccuggagaucggcaagcugccgcagcaccucacccagcgcgcccagaacgcccuggacaaccuggugaugcuccacaacagcgagcagggcgggcgggcguaccgccacgccauggaggagcugcccgacaccaucgagacgcugaugcuccuggcccugaucgccgugcucaccgggggcgucacccuguucuuccuguccgggcggggccucggcaagaccagcaucgggcugcugugcgugauggccuccagcgugcuccuguggauggcguccgucgagccccacuggaucgccgccagcaucauccuggaguucuuccucauggugcugcugauccccgagccggaccgccagcggacgccccaggacaaccagcucgccuacguggucaucggccugcuguucaugauccucacgguggccgcgaacgagauggggcugcuggagaccaccaagaaggaccucggcaucgggcacguggccgucgagaaccaccaccacgccgccaugcuggacguggaccugcaccccgccuccgcguggacccucuacgccguggccacgaccaucaucaccccgaugaugcgccacaccaucgagaacacgaccgccaacaucagccugaccgccaucgcgaaccaggccgccauccugaugggccucgacaagggcuggcccaucuccaagauggacaucggggucccccugcuggcccucggcugcuacagccaggugaacccccugacccugacggcggccgugcucaugcuggucgcccacuacgccaucaucgggccgggccugcaggccaaggcgacccgcgaggcccagaagcggaccgccgccgggaucaugaagaaccccaccguggacggcaucguggccaucgaccucgaccccgucguguacgacgcgaaguucgagaagcagcugggccagaucaugcugcucauccugugcacgucccagauccugcucaugcgcaccaccugggcccugugcgagagcaucacccuggccacggggccccucaccacccugugggagggcuccccggggaaguucuggaacaccacgaucgccgugagcauggccaacaucuuccggggcuccuaccuggcgggcgccgggcucgccuucagccugaugaagucccugggcgggggccgccgggggaccggcgcccagggcgagacccucggggagaaguggaagcgccagcugaaccagcuguccaagagcgaguucaacaccuacaagcgguccggcaucauggaggucgaccgcagcgaggcgaaggaggggcucaagcggggcgagacgaccaagcacgccgugucccgcgggaccgccaagcugcggugguucguggagcgcaaccuggucaagcccgagggcaaggugaucgaccugggcugcgggcggggcggguggagcuacuacugcgccggccucaagaaggugaccgaggucaagggguacacgaagggcggccccgggcacgaggagcccaucccgauggccaccuacggcuggaaccuggugaagcugcacuccgggaaggacguguucuucaucccgcccgagaagugcgacacccuccugugcgacaucggcgagagcucccccaacccgaccaucgaggaggggcgcacgcugcggguccucaagaugguggagcccuggcugcgcggcaaccaguucugcaucaagauccugaaccccuacaugcccagcguggucgaggcgcucgagcagaugcagcggaagcacggcgggaugcuggugcgcaacccgcugucccggaacagcacccacgagauguacuggguguccugcggcaccgggaacaucgucagcgccgugaacaugaccucccgcaugcuccugaaccgcuucaccauggcccaccggaagcccacguacgagcgcgacguggaccugggcaccggcacccggcacgucgccguggagcccgagguggccaaccucgacaucaucgggcagcgcaucgagaacaucaagcacgagcacaagagcaccuggcacuacgacgaggacaaccccuacaagacgugggcguaccacggcuccuacgaggucaagccgagcggguccgccagcagcauggugaacggcgucgugaagcugcugaccaagcccugggacgugauccccauggucacccagaucgccaugaccgacacgacccccuucgggcagcagcggguguucaaggagaagguggacacccgcaccccgaaggccaagcggggcacggcccagaucauggaggucaccgcgcgcuggcucuggggcuuccugucccggaacaagaagccccgcaucugcacccgggaggaguucacccgcaaggugcggagcaacgccgccaucggggccguguucgucgacgagaaccaguggaacuccgcgaaggaggccguggaggacgagcgcuucugggaccuggugcaccgggagcgcgagcuccacaagcagggcaagugcgccacgugcgucuacaacaugauggggaagcgggagaagaagcugggcgaguucgggaaggccaagggcagccgcgccaucugguacauguggcugggcgcgcgguuccucgaguucgaggcccugggguucaugaacgaggaccacugguucucccgcgagaacagccuguccggcguggagggggagggccuccacaagcugggguacauccugcgggacaucagcaagauccccggcggcaacauguacgccgacgacaccgccgggugggacacccgcaucaccgaggacgaccuccagaacgaggccaagaucacggacaucauggagccggagcacgcgcugcuggccaaggccaucuucaagcucaccuaccagaacaaggugguccgcgugcagcggcccgccaagaacggcaccgugauggacgucaucucccgccgggaccagcgcgggagcggccaggugggcaccuacgggcugaacacguucaccaacauggaggcccagcugauccggcagauggaguccgagggcaucuucagccccuccgagcucgagacccccaaccuggcggagcgcgcccuggacuggcucgagaaguacgggguggagcggcugaagcgcauggccaucagcggcgacgacugcgucgugaagccgaucgacgaccgguucgccaccgcccugacggcgcucaacgacauggggaaggugcgcaaggacaucccccagugggagcccuccaagggcuggaacgacuggcagcagguccccuucugcagccaccacuuccaccagcugaucaugaaggacggccgggagaucguggugccgugccgcaaccaggacgagcuggucgggcgggcccgcgugucccagggcgccggguggagccuccgggagaccgccugccugggcaagagcuacgcgcagauguggcagcugauguacuuccaccgccgggaccuccgccuggccgccaacgccaucugcuccgccgugcccgucgacugggugcccaccagccggaccacgugguccauccacgcgcaccaccaguggaugaccaccgaggacaugcugagcguguggaaccgcgucuggaucgaggagaaccccuggauggaggacaagacccacaucuccagcugggaggacgugccguaccucgggaagcgcgaggaccaguggugcggcucccugaucggccugacggcccgggccaccugggccaccaacauccagguggccaucaaccagguccgccggcucaucgggaacgagaacuaccuggacuacaugaucagcaugaagcgcuucaagaacgaguccgaccccgagggcgcgcugugguga

SEQ ID NO: 8290 - RNA, 9879 nt, Artificial Sequence
  derived and/or modified CDS sequence (opt1) from DENV-1__EU660418__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgagaccgagcccgacgacguggacugcuggugcaacgccacggacaccugggugaccuacgggaccugcagccagacgggcgagcaccggcgcgacaagcgguccguggcccucgcgccccacgugggccuggggcuggagacccgcaccgagaccuggaugagcuccgagggcgccuggaagcagauccagcggguggagacgugggcccuccgccaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagguggccgagacccagcacggcaccgugcugguccagaucaaguacgagggcaccgacgcgcccugcaagauccccuucagcacgcaggacgagaagggggugacccagaacggccggcugaucaccgccaacccgaucgugaccgacaaggagaagcccgucaacaucgaggccgagccgcccuucggggaguccuacaucgugaucggcgccggcgagaaggcgcugaagcucagcugguucaagaagggguccagcaucggcaagauguucgaggccacggcccgcggggcccggcgcauggccauccugggcgacaccgcgugggacuucggguccaucggcggcguguucaccagcgucgggaagcuggugcaccagaucuucggcaccgccuacgggguccucuucuccggcgucagcuggacgaugaagaucgggaucggcgugcugcugaccuggcucggccugaacucccgcagcaccucccugagcaugaccugcaucgccguggggcucgucacgcuguaccugggcgugauggugcaggccgacuccgggugcgucaucaacuggaagggccgggagcucaagugcgggagcggcaucuucgugaccaacgaggugcacaccuggaccgagcaguacaaguuccaggccgacagcccgaagcgccuguccgcggccaucggcaaggccugggaggagggggucugcggcauccggagcgccacccgccuggagaacaucauguggaagcagaucuccaacgagcucaaccacauccugcuggagaacgacaugaaguucacggugguggucggggacguggccggcauccucgcgcaggggaagaagaugauccggccccagcccauggaguacaaguacagcuggaaguccuggggcaaggccaagaucaucggcgccgacgugcagaacaccaccuucaucaucgacgggcccaacaccccggagugccccgacgaccagcgcgccuggaacaucugggaggucgaggacuacggcuucgggaucuucacgaccaacaucuggcugaagcugcgggacagcuacacccaggugugcgaccaccgccucauguccgcggccaucaaggacagcaaggccgugcacgccgacaugggcuacuggaucgaguccgagaagaacgagaccuggaagcuggcccgggcgagcuucaucgaggucaagacgugcaucuggcccaagucccacacccuguggagcaacggcgugcucgaguccgagaugaucauccccaagaucuacgggggcccgaucagccagcacaacuaccgccccggguacuucacccagaccgccggccccuggcaccuggggaagcuggagcucgacuucgaccugugcgagggcacgaccguggucguggacgagcacugcggcaaccgggggccgucccugcgcaccaccacggugaccggcaagaucauccacgaguggugcugccggagcugcacccugccgccccuccgcuuccgcggggaggacggcugcugguacgggauggagauccgccccgucaaggagaaggaggagaaccuggugaaguccauggugagcgccggcagcggcgaggucgacuccuucagccucgggcugcugugcaucuccaucaugaucgaggaggugaugcggagccgcuggucccggaagaugcucaugaccggcacgcuggccguguucuuccugcucaucauggggcagcugaccuggaacgaccugauccgccucugcaucauggucggcgccaacgcgagcgaccgcauggggaugggcaccaccuaccuggcccugauggccacguucaagaugcggccgauguucgccguggggcuccuguuccgccggcugaccucccgcgaggugcuccugcugaccaucgggcucagccuggucgccuccguggagcugcccaacagccucgaggagcugggcgacgggcuggcgaugggcaucaugauccucaagcugcugaccgacuuccagucccaccagcucugggccacgcugcugagccucaccuucaucaagaccaccuucucccugcacuacgccuggaagacgauggccaugguccugagcaucgugucccucuucccccugugccugagcaccaccucccagaagaccacguggcuccccgugcugcugggcagccucgggugcaagccgcugaccauguuccugaucgcggagaacaagaucuggggccggcgcuccuggccccucaacgaggggaucauggccgucggcaucgugagcauccugcugagcucccuccugaagaacgacgugccccuggccgggccccucaucgccggcggcaugcugaucgccugcuacgucaucagcggguccagcgcggaccugucccucgagaaggccgccgaggugagcugggaggaggaggccgagcacuccggcgccagccacaacauccugguggagguccaggacgacgggaccaugaagaucaaggacgaggagcgggacgacacccugaccauccuccugaaggcgacgcugcucgccguguccggcguguacccgcugagcauccccgccacccuguucgucuggcacuucuggcagaagaagaagcagcgcuccggggugcucugggacacccccagcccgcccgaggugggccgggccguccuggacgacggcaucuaccgcaucaugcagcgggggcugcugggccgcucccaggugggggugggcgucuuccaggagaacguguuccacaccauguggcacgugacgcgcggggccguccucauguaccagggcaagcgccuggagcccagcugggcguccgugaagaaggaccugaucagcuacggcgggggcuggcggcuccagggguccuggaacaccggcgaggaggugcaggucaucgccguggagcccgggaagaaccccaagaacgugcagaccgcccccggcaccuucaagacgcccgagggcgaggucggggccaucgcccuggacuucaagcccggcaccagcgggucccccaucgugaaccgcgagggcaagaucgugggccuguacgggaacggcgucgugaccaccagcgggacguacgugagcgcgaucgcccaggccaaggccucccaggagggcccgcuccccgagaucgaggacgaggucuuccggaagcgcaaccugaccaucauggaccugcaccccgggagcggcaagacccggcgcuaccucccggcgaucgugcgggaggccaucaagcgcaagcugcgcacccugauccucgcccccacgcggguggucgccuccgagauggccgaggcgcugaagggcaugcccauccgcuaccagaccaccgccgucaagagcgagcacaccgggaaggagaucguggaccugaugugccacgccacguucaccaugcggcuccugucccccguccgcgugccgaacuacaacaugaucaucauggacgaggcccacuucaccgaccccagcuccaucgccgcgcggggcuacaucagcacccgcguggggaugggcgaggccgccgccaucuucaugacggccacgccgcccggguccgucgaggcguucccgcagagcaacgccgugauccaggacgaggagcgggacauccccgagcgcuccuggaacagcggcuacgaguggaucaccgacuuccccggcaagaccgugugguucguccccuccaucaagagcgggaacgacaucgccaacugccugcggaagaacggcaagcgcgugauccagcucucccggaagacguucgacaccgaguaccagaagaccaagaacaacgacugggacuacguggucaccacggacaucagcgagaugggggccaacuuccgcgcggaccgggugaucgacccgcgccggugccugaagcccgugauccugaaggacggccccgagcgcgucauccucgccgggcccaugccggugaccgucgccuccgccgcccagcggcgcggccggaucggccgcaaccacaacaaggagggggaccaguacaucuacaugggccagccccugaacaacgacgaggaccacgcgcacuggaccgaggccaagaugcugcucgacaacaucaacacccccgaggggaucauccccgcccuguucgagccggagcgcgagaaguccgccgccaucgacggcgaguaccggcugcgcggggaggcgcggaagacguucguggagcucaugcgccggggcgaccugcccguguggcuguccuacaaggucgccagcgagggcuuccaguacagcgaccgccgguggugcuucgacggggagcgcaacaaccaggugcucgaggagaacauggacguggagaucuggaccaaggagggcgagcggaagaagcugcgcccccgguggcuggacgcccgcaccuacuccgacccccucgcccugcgggaguucaaggaguucgccgcggggcgccggagcgucuccggcgaccugauccucgagaucggcaagcugccgcagcaccugacccagcgcgcccagaacgcccucgacaaccuggugaugcugcacaacagcgagcagggcgggcgggccuaccgccacgcgauggaggagcuccccgacacgaucgagacccugaugcugcucgcccugaucgccgugcugaccgggggcgucacccucuucuuccuguccgggcggggccugggcaagaccagcaucgggcuccugugcgugauggccuccagcgugcugcucuggauggccuccgucgagccccacuggaucgcggccagcaucauccuggaguucuuccugauggugcuccugauccccgagccggaccgccagcggacgccccaggacaaccagcuggccuacguggucaucggccuccuguucaugauccugaccguggccgccaacgagauggggcuccuggagaccaccaagaaggaccugggcaucgggcacguggcggucgagaaccaccaccacgccgccaugcucgacguggaccugcaccccgccuccgccuggacgcuguacgcgguggccaccaccaucaucaccccgaugaugcgccacacgaucgagaacaccaccgccaacaucagccucaccgccaucgccaaccaggcggccauccugaugggccuggacaagggcuggcccaucuccaagauggacaucggggucccccuccuggcccugggcugcuacagccaggugaacccccucacgcugaccgccgcggugcugaugcucgucgcccacuacgccaucaucgggccgggccugcaggccaaggccacccgcgaggcgcagaagcggaccgccgccgggaucaugaagaaccccacgguggacggcaucguggccaucgaccuggaccccgucguguacgacgccaaguucgagaagcagcucggccagaucaugcugcugauccucugcaccucccagauccugcugaugcgcaccaccugggcgcucugcgagagcaucacgcuggccaccgggccccugaccacccucugggagggcuccccggggaaguucuggaacacgaccaucgccgugagcauggccaacaucuuccggggcuccuaccuggccggcgcggggcuggccuucagccucaugaagucccugggcgggggccgccgggggaccggcgcccagggcgagacccugggggagaaguggaagcgccagcucaaccagcuguccaagagcgaguucaacacguacaagcgguccggcaucauggaggucgaccgcagcgaggccaaggaggggcugaagcggggcgagaccaccaagcacgcggugucccgcgggaccgccaagcuccggugguucguggagcgcaaccuggucaagcccgagggcaaggugaucgaccugggcugcgggcggggcggguggagcuacuacugcgccggccugaagaaggugacggaggucaagggguacaccaagggcggccccgggcacgaggagcccaucccgauggccaccuacggcuggaaccucgugaagcugcacuccgggaaggacguguucuucaucccgcccgagaagugcgacacccugcucugcgacaucggcgagagcucccccaacccgacgaucgaggaggggcgcacccugcggguccugaagaugguggagcccuggcuccgcggcaaccaguucugcaucaagauccugaaccccuacaugcccagcguggucgagacccuggagcagaugcagcggaagcacggcgggaugcucgugcgcaacccgcugucccggaacagcacccacgagauguacuggguguccugcggcaccgggaacaucgucagcgccgugaacaugacgucccgcaugcugcucaaccgcuucaccauggcgcaccggaagcccaccuacgagcgcgacguggaccugggcgccggcacccggcacgucgccguggagcccgagguggccaaccuggacaucaucgggcagcgcaucgagaacaucaagcacgagcacaagagcacguggcacuacgacgaggacaaccccuacaagaccugggccuaccacggcuccuacgaggucaagccgagcggguccgcgagcagcauggugaacggcgucgugaagcuccugaccaagcccugggacgugauccccauggucacccagaucgccaugacggacaccacccccuucgggcagcagcggguguucaaggagaagguggacacccgcacgccgaaggccaagcggggcaccgcccagaucauggaggucaccgccaaguggcuguggggcuuccucucccgcaacaagaagccccggaucugcacccgcgaggaguucacgcggaaggugcgcagcaacgcggccaucggggccguguucgucgacgagaaccaguggaacuccgccaaggaggcgguggaggacgagcgguucugggaccuggugcaccgcgagcgggagcugcacaagcagggcaagugcgcgaccugcgucuacaacaugauggggaagcgcgagaagaagcucggcgaguucgggaaggccaagggcagccgggccaucugguacauguggcugggcgcccgcuuccuggaguucgaggcgcucggguucaugaacgaggaccacugguucucccgggagaacagccuguccggcguggagggggagggccugcacaagcucggguacauccugcgcgacaucagcaacauccccggcggcaacauguacgccgacgacaccgccgggugggacacccggaucacggaggacgaccugcagaacgaggcccgcaucaccgacaucauggagccggagcacgcccuccuggcgaaguccaucuucaagcugaccuaccagaacaaggugguccgcgugcagcggcccgccaagaacggcaccgugauggacgucaucagccgccgggaccagcgcggguccggccaggugggcacguacgggcucaacaccuucaccaacauggaggcccagcugauccggcagauggagagcgagggcaucuucucccccagcgagcuggagacccccaaccucgccgagcgcgugcuggacuggcuggagaaguacggggucgagcggcucaagcgcauggccaucuccggcgacgacugcguggugaagccgaucgacgaccgguucgcgacggcccugaccgcccugaacgacauggggaagguccgcaaggacaucccccagugggagcccagcaagggcuggaacgacuggcagcagguccccuucugcucccaccacuuccaccagcucaucaugaaggacggccgggagaucguggucccgugccgcaaccaggacgagcugguggggcgggcccgcgugagccagggcgccggguggagccugcgggagaccgcgugccucggcaaguccuacgcccagauguggcagcugauguacuuccaccgccgggaccugcgccucgccgccaacgcgaucugcagcgccguccccguggacuggauccccaccucccggacgaccuggagcauccacgcccaccaccaguggaugaccaccgaggacaugcuguccguguggaaccgcgucuggaucgaggagaaccccuggauggaggacaagacgcacaucagcuccuggggcgacgugccguaccugggcaagcgcgaggaccaguggugcggcagccucaucgggcugaccgcccgggccaccugggcgaccaacauccagguggccaucaaccagguccgccggcugaucggcaacgagaacuaccucgacuacaugaccuccaugaagcgcuucaagaacgagagcgaccccgagggggcccugugguga

SEQ ID NO: 8291 - RNA, 9879 nt, Artificial Sequence
  derived and/or modified CDS sequence (opt1) from DENV-1__EU677151__SS-prME
agcgugaccaugcugcucaugcugauccccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacacgaugaccuacaagugcccccggaucaccgagguggagcccgacgacgucgacugcuggugcaacaccaccgacaccugggugaccuacgggaccugcagccagacgggcgagcaccggcgggacaagcggagcguggcccucgcgccccacgucggccuggggcuggagacccgcgccgagaccuggaugagcagcgagggcgcguggaagcagauccagaagguggagaccugggcccuccggcaccccggguucacggugaucgcccuguuccuggcccacgcgaucggcaccagcaucacccagaaggggaucaucuucauccuccugaugcuggucacccccuccauggccaugcggugcgugggcaucggcagccgggacuucguggaggggcucuccggcgccacgugggucgacguggugcuggagcacgggagcugcgucaccaccauggccaaggacaagcccacccuggacaucgagcuccugaagacggaggugaccaaccccgccgugcugcgcaagcucugcaucgaggcgaagaucuccaacaccaccacggacagccggugccccacccagggcgaggccacccuggucgaggagcaggacgccaacuucgugugccgccggaccuucguggaccgcggcugggggaacggcugcgggcuguucggcaaggggucccucaucacgugcgccaaguucaagugcgucaccaagcuggagggcaagaucgugcaguacgagaaccugaaguacagcgugaucgucaccgugcacaccggcgaccagcaccaggucgggaacgaguccacggagcacggcaccaccgccaccaucacgccccaggcgcccacgagcgagauccagcucaccgacuacggggcccugacccuggacugcagcccccggaccggccucgacuucaacgagauggugcugcugacgaugaaggagaaguccuggcucgugcacaagcagugguuccuggaccugccgcuccccuggaccagcggggccuccaccagccaggagaccuggaaccgccaggaccugcuggucacguucaagaccgcccacgccaagaagcaggagguggugguccucggcucccaggagggcgcgaugcacaccgcccugaccggggccacggagauccagaccagcggcaccaccacgaucuucgccgggcaccugaagugccggcucaagauggacaagcugacccugaagggcauguccuacgugaugugcaccgggagcuucaagcucgagaaggagguggccgagacccagcacggcacgguccuggugcagaucaaguacgagggcaccgacgcgcccugcaagauccccuucuccacccaggacgagaagggggugacccagaacggccgccugaucacggccaacccgaucgucaccgacaaggagaagcccgugaacaucgaggccgagccgcccuucggggagagcuacaucgugaucggcgccggcgagaaggcgcugaagcucuccugguucaagaaggggagcuccaucggcaagauguucgaggccaccgcccgcggggcccgccggauggccauccugggcgacaccgcgugggacuucgggagcaucggcggcgucuucacguccguggggaagcuggugcaccagaucuucggcaccgccuacgggguccucuucagcggcguguccuggaccaugaagaucgggaucggcgugcugcugaccuggcucggccugaacagccgcuccacgagccuguccaugaccugcaucgccgucgggcucgugacccuguaccugggcgugaugguccaggccgacagcgggugcgugaucaacuggaagggccgcgagcucaagugcgggagcggcaucuucgugaccaacgagguccacacguggaccgagcaguacaaguuccaggccgacuccccgaagcggcugagcgcggccaucggcaaggccugggaggagggggugugcggcauccgcuccgccacccggcuggagaacaucauguggcgccagaucagcaacgagcucaaccacauccugcuggagaacgacaugaaguucaccguggucgugggggacguggucggcauccucgcccaggggaagaagaugauccggccccagcccauggagcacaaguacuccuggaaguccuggggcaaggcgaagaucaucggcgccgacgugcagaacaccacguucaucaucgacgggcccaacaccccggagugccccgacgaccagcgcgccuggaacaucugggagguggaggacuacggcuucgggaucuucaccaccaacaucuggcugaagcugcgggacuccuacacgcaggucugcgaccaccgccucaugagcgccgcgaucaaggacuccaaggccgugcacgccgacaugggcuacuggaucgagagcgagaagaacgagaccuggaagcuggcccgggccuccuucaucgaggugaagaccugcaucuggcccaagagccacacccugugguccaacggcguccucgagagcgagaugaucauccccaagaucuacgggggcccgaucucccagcacaacuaccgccccggguacuucacgcagaccgcgggccccuggcaccuggggaagcuggagcucgacuucgaccugugcgagggcaccaccgugguggucgacgagcacugcggcaaccgcggggccagccugcgcacgaccaccgugaccggcaagaucauccacgaguggugcugccgguccugcacgcucccgccccugcgcuucaagggggaggacggcugcugguacgggauggagauccggcccgugaaggagaaggaggagaaccuggucaagagcauggugagcgccggcuccggcgagguggacagcuucucccucgggcugcugugcaucagcaucaugaucgaggaggucaugcgcucccgguggagccgcaagaugcucaugaccggcacccuggccguguucuuccugcucaucauggggcagcugaccuggaacgaccugauccgguccugcaucauggugggcgccaacgcgagcgaccgcauggggaugggcacgaccuaccucgcccugauggccaccuucaagaugcgccccauggucgccgugggccugcuguuccggcgccugaccucccgggagguccugcuccugacgaucgggcugagccucguggccuccguggagcugccgaacagccuggaggagcucggcgacgggcuggcgaugggcaucaugauccugaagcuccugaccgacuuccaguccuaccagcugugggccacccuccugagccugaccuucaucaagacgaccuucucccuccacuacgccuggaagaccauggccaugguccugagcaucgugucccugcucccccugugccugagcaccacgucccagaagaccaccuggcuccccgugcugcugggcagccucgggugcaagccccugaccauguuccugaucgcggagaacaagaucuggggccgcaagagcuggccgcucaacgaggggaucauggccgucggcaucguguccauccugcugagcucccuccugaagaacgacgugccccuggccgggccccucaucgccggcggcaugcugaucgccugcuacgucaucagcggguccagcgcggaccugucccucgagaaggccgccgaggugagcugggaggaggaggccgagcacuccggcgccagccacaacauccugguggagguccaggacgacgggacgaugaagaucaaggacgaggagcgggacgacacccugaccauccuccugaaggcgacccugcucgccguguccggcguguacccccugagcaucccggccacccuguucgucugguacuucuggcagaagaagaagcagcgcuccggggugcucugggacacgcccuccccgcccgagguggagcgggccguccuggacgacggcaucuaccgcaucaugcagcggggccugcuggggcgcucccaggugggcgugggggucuuccaggagaacguguuccacaccauguggcacgugacccggggcgccguccucauguaccaggggaagcgccuggagccgagcugggcguccgugaagaaggaccugaucagcuacggcggcggguggcggcuccagggcuccuggaacaccggggaggaggugcaggucaucgccguggagcccggcaagaaccccaagaacgugcagacggcccccgggaccuucaagaccccggagggcgaggucggcgccaucgcccuggacuucaagcccgggaccagcggcagccccaucgugaaccgcgaggggaagaucgugggccuguacggcaacggggucgugacgaccuccggcaccuacgugagcgcgaucgcccaggccaaggccucccaggaggggccccucccggagaucgaggacgaggucuuccggaagcgcaaccugaccaucauggaccugcaccccggcagcgggaagacgcggcgcuaccuccccgcgaucgugcgggaggccaucaagcgcaagcugcggacccugauccucgccccgacccgcguggucgccuccgagauggccgaggcgcugaagggcaugcccauccgcuaccagaccacggccgucaagagcgagcacaccggccgggagaucguggaccugaugugccacgccaccuucaccaugcgccuccugucccccguccgggugcccaacuacaacaugaucaucauggacgaggcccacuucacggacccgagcuccaucgccgcgcgcggguacaucagcacccgggugggcaugggggaggccgccgccaucuucaugaccgccacgccgcccggcuccgucgaggcguucccccagagcaacgccgugauccaggacgaggagcgcgacaucccggagcgguccuggaacagcggguacgaguggaucacggacuuccccggcaagaccgugugguucguccccuccaucaagagcggcaacgacaucgccaacugccugcgcaagaacgggaagcgggugauccagcucucccgcaagaccuucgacaccgaguaccagaagacgaagaacaacgacugggacuacguggucaccaccgacaucagcgagaugggcgccaacuuccgggcggaccgcgugaucgacccccggcgcugccugaagccggucauccugaaggacgggcccgagcgggugauccucgccggccccaugcccgugaccgucgccuccgccgcccagcgccgggggcgcaucggccggaaccacaacaaggagggcgaccaguacaucuacauggggcagccgcugaacaacgacgaggaccacgcgcacuggacggaggccaagaugcugcucgacaacaucaacacccccgagggcaucauccccgcccuguucgagcccgagcgcgagaaguccgccgccaucgacggggaguaccgccugcggggcgaggcgcgcaagaccuucguggagcucaugcggcgcggggaccugccgguguggcugagcuacaaggucgccuccgagggcuuccaguacagcgaccggcgcuggugcuucgacggcgagcggaacaaccaggugcucgaggagaacauggacguggagaucuggaccaaggagggggagcgcaagaagcugcggccccgcuggcuggacgcccggacguacuccgacccccucgcccugcgcgaguucaaggaguucgccgcgggccggcgcagcgucuccggggaccugauccucgagaucggcaagcugccccagcaccugacccagcgggcccagaacgcccucgacaaccuggugaugcugcacaacagcgagcagggcgggcgcgccuaccggcacgcgauggaggagcucccggacaccaucgagacccugaugcugcucgcccugaucgccgugcugacgggcggggucacccucuucuuccuguccggccgcgggcugggcaagaccagcaucggccuccugugcgugauggccuccagcgcccugcucuggauggcguccguggagccccacuggaucgccgccagcaucauccuggaguucuuccugaugguccuccugauccccgagcccgaccggcagcgcaccccgcaggacaaccagcuggccuacguggugaucgggcuccuguucaugauccugaccgucgccgcgaacgagaugggccuccuggagacgaccaagaaggaccuggggaucggccacguggccguggagaaccaccaccacgccaccaugcucgacgucgaccugcaccccgccuccgccuggacccuguacgcgguggccacgaccaucaucacccccaugaugcggcacaccaucgagaacacgaccgccaacaucagccucaccgccaucgccaaccaggcggccauccugauggggcuggacaagggcuggccgaucuccaagauggacaucggcgugccccuccuggcccuggggugcuacagccaggucaacccccucacccugacggccgcggugcugaugcucguggcccacuacgccaucaucggccccgggcugcaggccaaggccacccgcgaggcgcagaagcgcaccgccgccggcaucaugaagaacccgaccgucgacgggaucguggccaucgaccuggaccccguggucuacgacgccaaguucgagaagcagcucggccagaucaugcugcugauccucugcacgucccagauccugcugaugcggaccaccugggcgcucugcgagagcaucacccuggccacgggcccccugaccacccucugggaggggucccccggcaaguucuggaacaccacgaucgccgugagcauggccaacaucuuccgcgggagcuaccuggccggcgcgggccuggccuucucccucaugaagucccucgggggcgggcggcgcgggaccggggcccagggcgagacccugggcgagaaguggaagcggcagcucaaccagcuguccaagagcgaguucaacaccuacaagcgcuccgggaucauggagguggaccggagcgaggccaaggagggccugcgccgcggggagacgaccaagcacgcggucucccgcggcaccgccaagcuccggugguucguggagcgcaaccuggugaagccggaggggaaggucaucgaccugggcugcggccgcggcggguggagcuacuacugcgccgggcugaagaaggugaccgaggugaagggguacacgaagggcggccccggccacgaggagcccauccccauggccaccuacggguggaaccucgucaagcugcacuccggcaaggacguguucuucaucccgcccgagaagugcgacacccugcucugcgacaucggggagagcucccccaaccccaccaucgaggagggccgcacgcugcgggugcugaagauggucgagccguggcuccgcgggaaccaguucugcaucaagauccugaaccccuacaugcccagcgugguggagacccuggagcagaugcagcggaagcacggcggcaugcucguccgcaacccccugucccggaacagcacccacgagauguacuggguguccugcgggaccggcaacaucgugagcgccgucaacaugaccucccgcaugcugcucaaccgcuucacgauggcgcaccggaagccgaccuacgagcgcgacguggaccugggggccggcacccggcacguggccgucgagcccgagguggccaaccuggacaucaucggccagcgcaucgagaacaucaagcacgagcacaagagcaccuggcacuacgacgaggacaaccccuacaagacgugggccuaccacggguccuacgaggucaagcccagcggcagcgcguccagcauggugaacgggguggucaagcuccugaccaagccgugggacgugauccccauggugacccagaucgccaugaccgacacgacccccuucggccagcagcgggucuucaaggagaagguggacacccgcacccccaaggccaagcgggggacggcccagaucauggaggugaccgcccgcuggcuguggggcuuccucucccggaacaagaagccgcgcaucugcacccgggaggaguucacccgcaagguccggagcaacgcggccaucggcgccguguucguggacgagaaccaguggaacuccgccaaggaggcggucgaggacgagcgcuucugggaccuggugcaccgggagcgcgagcugcacaagcaggggaagugcgccacgugcguguacaacaugaugggcaagcgggagaagaagcucggggaguucggcaaggccaaggggagccgcgccaucugguacauguggcugggcgcccgguuccuggaguucgaggcgcucggcuucaugaacgaggaccacugguucucccgcgagaacagccuguccggggucgagggcgaggggcugcacaagcucggcuacauccugcgggacaucagcaagauccccgggggcaacauguacgccgacgacaccgccggcugggacacccgcaucaccgaggacgaccugcagaacgaggccaagaucacggacaucauggagcccgagcacgcccuccuggcgaccuccaucuucaagcugaccuaccagaacaagguggugcgcguccagcggccggcccgcaacgggaccgugauggacgugaucagccggcgcgaccagcggggcuccgggcaggucggcacguacggccucaacaccuucaccaacauggaggcccagcugauccgccagauggagagcgaggggaucuucucccccagcgagcuggagacccccaaccucgccgagcgggugcuggacuggcuggagaagcacggcguggagcgccucaagcggauggccaucuccggggacgacugcgucgugaagcccaucgacgaccgcuucgcgacggcccugagcgcccugaacgacaugggcaaggugcggaaggacaucccgcagugggagcccagcaagggguggaacgacuggcagcagguccccuucugcucccaccacuuccaccagcucaucaugaaggacggccgcgagaucguggugcccugccggaaccaggacgagcuggucggccgcgcccgggugagccagggggccggcuggucccugcgcgagaccgcgugccucggcaagagcuacgcccagauguggcagcugauguacuuccaccggcgcgaccugcggcucgccgccaacgcgaucugcuccgccgugccggucgacugggugcccaccagccgcaccacgugguccauccacgcccaccaccaguggaugaccaccgaggacaugcugagcguguggaaccgcgucuggaucgaggagaaccccuggauggaggacaagacccacaucuccagcuggggcgacgugcccuaccuggggaagcgggaggaccaguggugcggcucccucaucggccugacggcccgcgccaccugggcgaccaacauccagguggccaucaaccagguccggcgccugaucgggaacgagaacuaccucgacuacaugaccagcaugaagcgguucaagaacgaguccgacccggagggcgcccugugguga

SEQ ID NO: 8292 - RNA, 9879 nt, Artificial Sequence
  derived and/or modified CDS sequence (opt1) from DENV-1__EU677152__SS-prME
agcgugaccaugcugcucaugcugaugcccaccgcccuggccuuccaccucacgacccggggcggggagccccacaugaucgugagcaagcaggagcggggcaagagccugcuguucaagaccagcgcgggggugaacaugugcacccucaucgccauggaccugggcgaguucugcgaggacacgaugaccuacaagugcccccgcaucaccgaggccgagcccgacgacguggacugcuggugcaacgccaccgacacgugggugaccuacgggaccugcagccagaccggcgagcaccggcgggacaagcgguccguggcccuggcgccccacgugggccucgggcuggagacgcgcaccgagaccuggaugagcuccgagggcgccuggaagcagauccagcgggucgagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugcccgacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaagaccguccaguacgagaaccugaaguacagcgugaucgugaccguccacacgggcgaccagcaccagguggggaacgaguccaccgagcacggcaccaccgcgaccaucacgccccaggcccccagcaccgagauccagcugaccgacuacggggcccucacccuggacugcagcccccggacgggccuggacuucaacgagaugguccuccugaccaugaaggagaaguccuggcuggugcacaagcagugguuccucgaccugccgcugcccuggaccagcggggccuccaccagccaggagacguggaaccggaaggaccuccuggugaccuucaagaccgcccacgcgaagaagcaggaggucguggugcugggcucccaggagggcgccaugcacaccgcccucacgggggccaccgagauccagaccagcggcaccacgaccaucuucgccgggcaccugaagugccgccugaagauggacaagcucacccugaagggcauguccuacgucaugugcaccgggagcuucaagcuggagaaggagguggcggagacgcagcacggcaccgugcucguccagaucaaguacgagggcaccgacgcccccugcaagauccccuucuccacccaggacgagaagggggugacgcagaacggccggcugaucaccgccaacccgaucgugaccgacaaggagaagcccgucaacaucgaggccgagccgcccuucggggagagcuacaucgugaucggcgcgggcgagaaggcccugaagcuguccugguucaagaaggggagcuccaucggcaagauguucgaggccaccgcccgcggggcccggcgcauggcgauccucggcgacacggccugggacuucgggagcaucggcggcguguucaccuccgucgggaagcuggugcaccagaucuucggcaccgccuacggggugcuguucagcggcgucuccuggaccaugaagaucgggaucggcgugcuccugacguggcugggccucaacagccgcuccaccagccuguccaugaccugcaucgccguggggcuggucacccucuaccugggcgugauggugcaggccgacagcgggugcgucaucaacuggaagggccgggagcugaagugcgggagcggcaucuucgugacgaacgaggugcacaccuggaccgagcaguacaaguuccaggcggacuccccgaagcgccucagcgccgccaucggcaaggccugggaggagggggucugcggcauccgguccgccacccgccuggagaacaucauguggaagcagaucagcaacgagcugaaccacauccuccuggagaacgacaugaaguucaccgugguggucggggacguggcgggcauccuggcccaggggaagaagaugauccggccccagcccauggaguacaaguacuccuggaaguccuggggcaaggccaagaucaucggcgccgacgugcagaacacgaccuucaucaucgacgggcccaacaccccggagugccccgacgaccagcgcgcguggaacaucugggaggucgaggacuacggcuucgggaucuucaccacgaacaucuggcucaagcugcgggacuccuacacccaggugugcgaccaccgccugaugagcgccgccaucaaggacuccaaggccgugcacgccgacaugggcuacuggaucgagagcgagaagaacgagaccuggaagcucgcgcgggccuccuucaucgaggucaagaccugcaucuggcccaagagccacacgcugugguccaacggcgugcuggagagcgagaugaucauccccaagaucuacgggggcccgaucucccagcacaacuaccgccccggguacuucacccagaccgccggccccuggcaccucgggaagcuggagcuggacuucgaccucugcgagggcaccacgguggucguggacgagcacugcggcaaccgggggccgagccugcgcaccaccaccgugacgggcaagaucauccacgaguggugcugccgguccugcacccugccgccccugcgcuucaagggggaggacggcugcugguacgggauggagauccggcccgucaaggagaaggaggagaaccuggucaagagcauggugagcgccggcuccggcgaggucgacagcuucucccuggggcuccugugcaucagcaucaugaucgaggaggugaugcgcucccgguggagccgcaagaugcugaugaccggcacccucgccguguucuuccugcugaucauggggcagcucacguggaacgaccugauccggcugugcaucauggucggcgcgaacgccuccgaccgcauggggaugggcaccaccuaccucgcccugauggccaccuucaagaugcgcccgauguucgccgugggccuccuguuccggcgccugacgagccgggaggugcugcuccugaccaucgggcugucccucgucgcgagcguggagcugcccaacucccuggaggagcucggcgacgggcuggccaugggcaucaugauccugaagcuccugaccgacuuccagagccaccagcugugggccacccuccugucccugacguucaucaagaccaccuucagccuccacuacgccuggaagaccauggcgaugguccuguccaucgugagccuguucccccucugccuguccacgaccagccagaagaccaccuggcugcccgugcuccugggcucccuggggugcaagccgcucacgauguuccugaucgccgagaacaagaucuggggccgcaagagcuggccccugaacgaggggaucauggccgucggcaucgugagcauccuccuguccagccugcucaagaacgacgugccccuggccgggccccugaucgccggcggcaugcucaucgcgugcuacgucaucuccgggagcuccgccgaccugagccuggagaaggccgccgagguguccugggaggaggaggccgagcacagcggcgcgucccacaacauccucguggagguccaggacgacgggaccaugaagaucaaggacgaggagcgggacgacacccugaccauccugcucaaggccacccugcuggccgugagcggcguguacccgcucuccauccccgccacgcuguucgucugguacuucuggcagaagaagaagcagcgcagcggggugcugugggacacccccagcccgcccgagguggagcgggccguccucgacgacggcaucuaccgcaucaugcagcggggccugcuggggcgcagccaggugggcgugggggucuuccaggagaacguguuccacaccauguggcacgugacccggggcgcgguccugauguaccaggggaagcgccucgagcccuccugggccagcgugaagaaggaccugaucuccuacggcggcggguggcggcugcagggcagcuggaacacgggggaggaggugcaggucaucgccguggagcccggcaagaaccccaagaacgugcagaccgcccccgggaccuucaagaccuccgagggcgaggucggcgccaucgcgcucgacuucaagcccgggacgagcggcagccccaucgugaaccgcgaggggaagaucgugggccuguacggcaacggggucgugaccaccuccggcaccuacgugagcgccaucgcccaggccaaggcgucccaggaggggccccugccggagaucgaggacgaggucuuccggaagcgcaaccucacgaucauggaccugcaccccggcagcgggaagacccggcgcuaccugcccgccaucgugcgggaggccaucaagcgcaagcuccggacccugauccuggccccgacccgcguggucgccuccgagauggcggaggcccucaagggcaugcccauccgcuaccagacgaccgccgucaagagcgagcacaccggcaaggagaucguggaccugaugugccacgccaccuucacgaugcggcugcucucccccguccgcgugcccaacuacaacaugaucaucauggacgaggcccacuucaccgacccgagcuccaucgcggcccggggguacaucagcacccgcgugggcaugggggaggccgccgccaucuucaugaccgcgacgccgcccggcuccgucgaggccuucccccagagcaacgccgugauccaggacgaggagcgggacaucccggagcgcuccuggaacagcggguacgaguggaucaccgacuuccccggcaagaccgugugguucguccccuccaucaagagcggcaacgacaucgccaacugccugcggaagaacgggaagcgcgugauccagcugucccggaagaccuucgacacggaguaccagaagaccaagaacaacgacugggacuacguggucaccaccgacaucagcgagaugggcgcgaacuuccgcgccgaccgggugaucgacccccgccggugccucaagccggugauccugaaggacgggcccgagcgcgucauccuggccggccccaugcccgugacggucgccuccgccgcgcagcggcgcgggcggaucggccgcaaccacaacaaggagggcgaccaguacaucuacauggggcagccgcucaacaacgacgaggaccacgcccacuggaccgaggccaagaugcugcuggacaacaucaacacccccgagggcaucauccccgcccucuucgagcccgagcgggagaaguccgccgcgaucgacggggaguaccgccugcgcggcgaggcccggaagaccuucguggagcugaugcgccgcggggaccucccgguguggcugagcuacaaggucgccuccgagggcuuccaguacagcgaccgccgguggugcuucgacggcgagcgcaacaaccaggugcuggaggagaacauggacguggagaucuggacgaaggagggggagcggaagaagcuccgcccccgguggcuggacgcccgcaccuacuccgacccccuggcccuccgggaguucaaggaguucgcggccggccgccggagcgucuccggggaccugauccuggagaucggcaagcucccccagcaccugacccagcgcgcccagaacgcccuggacaaccucgugaugcugcacaacagcgagcagggcgggcgggcguaccgccacgccauggaggagcugccggacaccaucgagacgcucaugcugcuggcccucaucgccgugcugaccggcggggucacccuguucuuccucuccggccgggggcugggcaagaccagcaucggccugcucugcgugauggccuccagcgugcugcuguggauggcguccgucgagccccacuggaucgccgccagcaucauccucgaguucuuccugauggugcugcucauccccgagcccgaccgccagcggaccccgcaggacaaccagcuggccuacguggucaucgggcuccucuucaugauccugacgguggccgcgaacgagaugggccugcucgagaccaccaagaaggaccuggggaucggccacgccgccguggagaaccaccaccacgccgccaugcuggacgucgaccuccaccccgcguccgccuggacccuguacgccguggccacgaccaucaucacccccaugaugcgccacaccaucgagaacacgaccgccaacaucagccugaccgcgaucgccaaccaggccgccauccucauggggcuggacaagggcuggccgaucuccaagauggacaucggcgugccccugcucgcgcuggggugcuacagccaggucaacccccugacccucacggccgccgugcugaugcugguggcccacuacgccaucaucggccccgggcuccaggcgaaggccacccgggaggcccagaagcgcaccgccgccggcaucaugaagaacccgaccgucgacgggaucguggcgaucgaccuggaccccguggucuacgacgccaaguucgagaagcagcugggccagaucaugcuccugauccugugcacgucccagauccuccugaugcgcaccaccugggcccugugcgagagcaucacccucgccacgggcccccugaccacccugugggaggggucccccggcaaguucuggaacaccacgaucgccgugagcauggcgaacaucuuccgggggagcuaccucgccggcgccggccuggccuucucccugaugaagucccucgggggcgggcgccggggcaccggggcgcagggcgagacccugggcgagaaguggaagcgccagcugaaccagcucuccaagagcgaguucaacaccuacaagcgguccgggaucauggagguggaccgcagcgaggccaaggagggccugaagcgcggggagacgaccaagcacgccgucucccgcggcaccgccaagcugcggugguucguggagcgcaaccucgugaagccggaggggaaggucaucgaccugggcugcggccgcggcggguggagcuacuacugcgccgggcugaagaaggugaccgaggugaagggguacacgaagggcgggcccggccacgaggagcccauccccauggcgaccuacggguggaaccuggucaagcuccacuccggcaaggacguguucuucaucccgcccgagaagugcgacacccugcugugcgacaucggggagagcucccccaaccccaccaucgaggagggccgcacgcuccgggugcugaagauggucgagccguggcugcgcgggaaccaguucugcaucaagauccucaaccccuacaugcccagcgugguggagacccuggagcagaugcagcggaagcacggcggcaugcugguccgcaacccccucucccggaacagcacccacgagauguacuggguguccugcgggaccggcaacaucgugagcgccgucaacaugaccucccgcaugcugcugaaccgguucacgauggcccaccgcaagccgaccuacgagcgcgacguggaccucggggccggcacccggcacguggccgucgagcccgagguggcgaaccuggacaucaucggccagcgcaucgagaacaucaagcacgagcacaagagcaccuggcacuacgacgaggacaaccccuacaagacgugggccuaccacggguccuacgaggugaagcccagcggcagcgccuccagcauggucaacgggguggucaagcugcucaccaagccgugggacgugauccccauggugacccagaucgccaugaccgacacgacccccuucggccagcagcgggucuucaaggagaagguggacacccgcacccccaaggccaagcgggggacggcgcagaucauggaggugaccgccaaguggcuguggggcuuccugucccgcaacaagaagccgcggaucugcacccgcgaggaguucacccggaagguccgcagcaacgccgccaucggcgcgguguucguggacgagaaccaguggaacuccgccaaggaggccgucgaggacgagcgguucugggaccucgugcaccgcgagcgggagcugcacaagcaggggaagugcgccacgugcguguacaacaugaugggcaagcgcgagaagaagcugggggaguucggcaaggccaaggggagccgggcgaucugguacauguggcucggcgcccgcuuccuggaguucgaggcccugggcuucaugaacgaggaccacugguucucccgggagaacagccucuccggggucgagggcgaggggcugcacaagcugggcuacauccuccgcgacaucagcaagauccccgggggcaacauguacgccgacgacaccgccggcugggacacccggaucaccgaggacgaccugcagaacgaggcgaagaucacggacaucauggagcccgagcacgcccugcucgccaaguccaucuucaagcugaccuaccagaacaagguggugcgcguccagcggccggccaagaacgggaccgugauggacgugaucagccgccgcgaccagcggggcuccgggcaggucggcaccuacggccugaacacguucaccaacauggaggcccagcucauccgccagauggagagcgaggggaucuucucccccagcgagcuggagacccccaaccuggcgggccgggugcucgacuggcuggagaagcacgggguggagcgccugaagcggauggccaucuccggcgacgacugcgucgugaagcccaucgacgaccgcuucgccaccgcccucacggcccugaacgacauggggaaggugcggaaggacaucccgcagugggagcccagcaagggcuggaacgacuggcagcagguccccuucugcagccaccacuuccaccagcugaucaugaaggacggccgcgagaucguggugcccugccggaaccaggacgagcucgucgggcgcgcgcgggugucccagggcgccggguggagccugcgcgagaccgccugccugggcaaguccuacgcccagauguggcagcucauguacuuccaccggcgcgaccugcggcuggcggccaacgccaucugcagcgccgugccggucgacugggugcccaccucccgcaccacguggagcauccacgcccaccaccaguggaugaccaccgaggacaugcucuccguguggaaccgggucuggaucgaggagaaccccuggauggaggacaagacccacaucagcuccuggggcgacgugcccuaccugggcaagcgcgaggaccaguggugcggcagccugaucgggcucacggcgcgggccaccugggccaccaacauccagguggccaucaaccagguccgccgccugaucggcaacgagaacuaccuggacuacaugaccuccaugaagcgguucaagaacgagagcgacccggagggggcccucugguga

SEQ ID NO: 8293 - RNA, 9879 nt, Artificial Sequence
  derived and/or modified CDS sequence (opt1) from DENV-1__EU677155__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgagaccgagcccgacgacguggacugcuggugcaacgccaccgacaccugggugaccuacgggaccugcagccagacgggcgagcaccggcgggacaagcgguccguggcccucgcgccccacgugggccuggggcuggagacccgcaccgagaccuggaugagcuccgagggcgcguggaagcagauccagcgggucgagacgugggcccuccggcaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagguggccgagacccagcacggcaccgugcugguccagaucaaguacgagggcaccgacgcgcccugcaagauccccuucagcacgcaggacgagaagggggugacccagaacggccggcugaucaccgccaacccgaucgugaccgacaaggagaagcccgucaacaucgaggccgagccgcccuucggggaguccuacaucgugaucggcgccggcgagaaggcgcugaagcucagcugguucaagaagggguccagcaucggcaagauguucgaggccacggcccgcggggcccggcgcauggccauccugggcgacaccgcgugggacuucggguccaucggcggcguguucaccagcgucgggaagcuggugcaccagaucuucggcaccgccuacggggugcuguucuccggcgucagcuggacgaugaagaucgggaucggcgugcugcugaccuggcucggccugaacucccgcagcaccucccugagcaugaccugcaucgccguggggcucgucacgcuguaccugggcgugauggugcaggccgacuccgggugcgucaucaacuggaagggccgggagcucaagugcgggagcggcaucuucgugaccaacgaggugcacaccuggaccgagcaguacaaguuccaggccgacagcccgaagcgccuguccgcggccaucggcaaggccugggaggagggggucugcggcauccggagcgccacccgccuggagaacaucauguggaagcagaucuccaacgagcucaaccacauccugcuggagaacgacaugaaguucacggugguggucggggacguggccggcauccucgcgcaggggaagaagaugauccggccccagcccauggaguacaaguacagcuggaaguccuggggcaaggccaagaucaucggcgccgacgugcagaacaccaccuucaucaucgacgggcccaacaccccggagugccccgacgaccagcgcgccuggaacaucugggaggucgaggacuacggcuucgggaucuucacgaccaacaucuggcugaagcugcgggacagcuacacccaggugugcgaccaccgccucauguccgcggccaucaaggacagcaaggccgugcacgccgacaugggcuacuggaucgaguccgagaagaacgagaccuggaagcuggcccgggcgagcuucaucgaggucaagacgugcaucuggcccaagucccacacccuguggagcaacggcgugcucgaguccgagaugaucauccccaagaucuacgggggcccgaucagccagcacaacuaccgccccggguacuucacccagaccgccggccccuggcaccuggggaagcuggagcucgacuucgaccugugcgagggcacgaccguggucguggacgagcacugcggcaaccgggggccgucccugcgcaccaccacggugaccggcaagaucauccacgaguggugcugccggagcugcacccugccgccccuccgcuuccgcggggaggacggcugcugguacgggauggagauccgccccgucaaggagaaggaggagaaccuggugaaguccauggugagcgccggcagcggcgaggucgacuccuucagccucgggcugcugugcaucuccaucaugaucgaggaggugaugcggagccgcuggucccggaagaugcucaugaccggcacgcuggccguguucuuccugcucaucauggggcagcugaccuggaacgaccugauccgccucugcaucauggucggcgccaacgcgagcgaccgcauggggaugggcaccaccuaccuggcccugauggccacguucaagaugcggccgauguucgccgugggccuccuguuccgccggcugaccucccgcgaggugcuccugcugaccaucgggcucagccuggucgccuccguggagcugcccaacagccucgaggagcugggcgacgggcuggcgaugggcaucaugauccucaagcugcugaccgacuuccagucccaccagcucugggccacgcugcugagccucaccuucaucaagaccaccuucucccugcacuacgccuggaagacgauggccaugguccugagcaucgugucccucuucccccugugccugagcaccaccucccagaagaccacguggcuccccgugcugcugggcagccucgggugcaagccgcugaccauguuccugaucgcggagaacaagaucuggggccggcgcuccuggccccucaacgaggggaucauggccgucggcaucgugagcauccugcugagcucccuccugaagaacgacgugccccuggccgggccccucaucgccggcggcaugcugaucgccugcuacgucaucagcggguccagcgcggaccugucccucgagaaggccgccgaggugagcugggaggaggaggccgagcacuccggcaccagccacaacauccugguggagguccaggacgacgggaccaugaagaucaaggacgaggagcgggacgacacccugacgauccuccugaaggccacccugcucgcgguguccggcguguacccgcugagcauccccgccacccuguucgucugguacuucuggcagaagaagaagcagcgcuccggggugcucugggacacccccagcccgcccgagguggagcgggccguccuggacgacggcaucuaccgcaucaugcagcggggccugcuggggcgcucccaggugggcgugggggucuuccaggagaacguguuccacacgauguggcacgugacccggggcgccguccucauguaccaggggaagcgccuggagcccagcugggccuccgugaagaaggaccugaucagcuacggcggcggguggcggcuccagggcuccuggaacaccggggaggaggugcaggucaucgcgguggagcccggcaagaaccccaagaacgugcagaccgcccccgggacguucaagacccccgagggcgaggucggcgccaucgcccuggacuucaagcccgggaccagcggcucccccaucgugaaccgcgaggggaagaucgugggccuguacggcaacggggucgugaccacgagcggcaccuacgugagcgccaucgcgcaggccaaggccucccaggaggggccgcuccccgagaucgaggacgaggucuuccggaagcgcaaccugaccaucauggaccugcaccccggcagcgggaagacccggcgcuaccucccggccaucgugcgggaggcgaucaagcgcaagcugcgcacgcugauccucgcccccacccggguggucgccuccgagauggccgaggcccugaagggcaugcccauccgcuaccagaccaccgcggucaagagcgagcacacgggcaaggagaucguggaccugaugugccacgccaccuucaccaugcggcuccugucccccguccgcgugccgaacuacaacaugaucaucauggacgaggcccacuucaccgaccccagcuccaucgccgcccggggguacaucagcacgcgcgugggcaugggggaggcggccgccaucuucaugaccgccacgccgcccggcuccgucgaggccuucccgcagagcaacgcggugauccaggacgaggagcgggacauccccgagcgcuccuggaacagcggguacgaguggaucaccgacuuccccggcaagacggugugguucguccccuccaucaagagcggcaacgacaucgccaacugccugcggaagaacgggaagcgcgugauccagcucucccggaagaccuucgacaccgaguaccagaagaccaagaacaacgacugggacuacguggucacgaccgacaucagcgagaugggcgccaacuuccgcgccgaccgggugaucgacccgcgccggugccugaagcccgugauccugaaggacgggcccgagcgcgucauccucgcgggccccaugccggugaccgucgccuccgccgcccagcggcgcgggcggaucggccgcaaccacaacaaggagggcgaccaguacaucuacauggggcagccccugaacaacgacgaggaccacgcccacuggaccgaggcgaagaugcugcucgacaacaucaacacgcccgagggcaucauccccgcccuguucgagccggagcgcgagaaguccgccgccaucgacggggaguaccggcugcgcggcgaggcccggaagaccuucguggagcucaugcgccgcggggaccugcccguguggcuguccuacaaggucgcgagcgagggcuuccaguacagcgaccgccgguggugcuucgacggcgagcgcaacaaccaggugcucgaggagaacauggacguggagaucuggaccaaggagggggagcggaagaagcugcgcccccgguggcuggacgcccgcaccuacuccgacccccucgcccugcgggaguucaaggaguucgccgccggccgccggagcgucuccggggaccugauccucgagaucggcaagcugccgcagcaccugacgcagcgcgcgcagaacgcccucgacaaccuggugaugcugcacaacagcgagcagggcgggcgggccuaccgccacgccauggaggagcuccccgacaccaucgagacccugaugcugcucgcgcugaucgccgugcugaccggcggggucacccucuucuuccuguccggccgggggcugggcaagacgagcaucggccuccugugcgugauggccuccagcgugcugcucuggauggccuccgucgagccccacuggaucgccgcgagcaucauccuggaguucuuccugauggugcuccugauccccgagccggaccgccagcggacgccccaggacaaccagcuggccuacguggucaucgggcuccuguucaugauccugaccguggccgccaacgagaugggccuccuggagaccacgaagaaggaccuggggaucggccacguggccgucgagaaccaccaccacgcggccaugcucgacguggaccugcaccccgccuccgccuggacccuguacgccguggcgaccaccaucaucacgccgaugaugcgccacaccaucgagaacaccaccgccaacaucagccucacggccaucgccaaccaggccgcgauccugauggggcuggacaagggcuggcccaucuccaagauggacaucggcgucccccuccuggcccuggggugcuacagccaggugaacccccucacccugaccgccgccgugcugaugcucgucgcgcacuacgccaucaucggcccggggcugcaggccaaggccacccgcgaggcccagaagcggacggcggccggcaucaugaagaaccccaccguggacgggaucguggccaucgaccuggaccccgucguguacgacgccaaguucgagaagcagcucggccagaucaugcugcugauccucugcaccucccagauccugcugaugcgcaccacgugggcccucugcgagagcaucacccuggcgaccggcccccugaccacgcucugggagggguccccgggcaaguucuggaacaccaccaucgccgugagcauggccaacaucuuccggggguccuaccuggccggcgccggccuggcguucagccucaugaagucccucgggggcgggcgccgggggaccggggcccagggcgagacgcugggcgagaaguggaagcgccagcucaaccagcuguccaagagcgaguucaacaccuacaagcgguccgggaucauggaggucgaccgcagcgaggccaaggagggccugaagcgcggggagaccaccaagcacgccgugucccgcggcacggcgaagcuccggugguucguggagcgcaaccuggucaagcccgaggggaaggugaucgaccugggcugcggccgcggcggguggagcuacuacugcgccgggcugaagaaggugaccgaggucaagggguacaccaagggcggccccggccacgaggagcccaucccgauggccaccuacggguggaaccucgugaagcugcacuccggcaaggacguguucuucaucccgcccgagaagugcgacacgcugcucugcgacaucggggagagcucccccaacccgaccaucgaggagggccgcacccugcggguccugaagaugguggagcccuggcuccgcgggaaccaguucugcaucaagauccugaaccccuacaugcccagcguggucgagacccuggagcagaugcagcggaagcacggcggcaugcucgugcgcaacccgcugucccggaacagcacccacgagauguacuggguguccugcgggacgggcaacaucgucagcgccgugaacaugaccucccgcaugcugcucaaccgcuucaccauggcccaccggaagcccaccuacgagcgcgacguggaccugggggcgggcacgcggcacgucgccguggagcccgagguggccaaccuggacaucaucggccagcgcaucgagaacaucaagcacgagcacaagagcaccuggcacuacgacgaggacaaccccuacaagaccugggccuaccacggguccuacgaggucaagccgagcggcuccgccagcagcauggugaacggggucgugaagcuccugaccaagcccugggacgugauccccauggucacgcagaucgcgaugaccgacaccacccccuucggccagcagcggguguucaaggagaagguggacacgcgcaccccgaaggccaagcgggggaccgcccagaucauggaggucaccgccaaguggcuguggggcuuccucucccgcaacaagaagccccggaucugcacgcgcgaggaguucacccggaaggugcgcagcaacgccgcgaucggcgccguguucgucgacgagaaccaguggaacuccgccaaggaggccguggaggacgagcgguucugggaccuggugcaccgcgagcgggagcugcacaagcaggggaagugcgcgaccugcgucuacaacaugaugggcaagcgcgagaagaagcucggggaguucggcaaggccaaggggagccgggccaucugguacauguggcugggcgcccgcuuccuggaguucgaggcccucggcuucaugaacgaggaccacugguucucccgggagaacagccuguccgggguggagggcgaggggcugcacaagcucggcuacauccugcgcgacaucagcaagauccccgggggcaacauguacgcggacgacaccgccggcugggacacgcggaucaccgaggacgaccugcagaacgaggcccgcaucaccgacaucauggagccggagcacgcccuccuggccggguccaucuucaagcugaccuaccagaacaaggugguccgcgugcagcggcccgcgaagaacggcacggugauggacgucaucagccgccgggaccagcgcggguccggccaggugggcaccuacgggcucaacaccuucaccaacauggaggcccagcugauccggcagauggagagcgagggcaucuucucccccagcgagcuggagacgcccaaccucgccgagcgcgugcuggacuggcuggagaaguacggggucgagcggcucaagcgcauggccaucuccggcgacgacugcguggugaagccgaucgacgaccgguucgccaccgcgcugaccgcccugaacgacauggggaagguccgcaaggacaucccccagugggagcccagcaagggcuggaacgacuggcagcagguccccuucugcucccaccacuuccaccagcucaucaugaaggacggccgggagaucguggucccgugccgcaaccaggacgagcugguggggcgggcccgcgugagccagggcgccggguggagccugcgggagaccgccugccucggcaaguccuacgcgcagauguggcagcugauguacuuccaccgccgggaccugcgccucgccgccaacgccaucugcagcgcgguccccguggacuggauccccacgucccggaccaccuggagcauccacgcccaccaccaguggaugaccacggaggacaugcuguccguguggaaccgcgucuggaucgaggagaaccccuggauggaggacaagacccacaucagcuccuggggcgacgugccguaccugggcaagcgcgaggaccaguggugcggcagccucaucgggcugaccgcccgggccaccugggccaccaacauccagguggcgaucaaccagguccgccggcugaucggcaacgagaacuaccucgacuacaugacguccaugaagcgcuucaagaacgagagcgaccccgagggggcccugugguga

SEQ ID NO: 8294 - RNA, 9879 nt, Artificial Sequence
  derived and/or modified CDS sequence (opt1) from DENV-1__EU677157__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgagaccgagcccgacgacguggacugcuggugcaacgccacggacaccugggucaccuacgggaccugcagccagacgggcgagcaccggcgggacaagcgguccguggcccucgcgccccacgugggccuggggcuggagacccgcaccgagaccuggaugagcuccgagggcgccuggaagcagauccagcgggucgagacgugggcccuccggcaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacgcugguggaccggggcugggggaacggcugcggccuguucggcaaggggucccugaucacgugcgccaaguucaagugcgugaccaagcuggagggcaagaucguccaguacgagaaccucaaguacagcgugaucgugaccguccacacgggcgaccagcaccagguggggaacgaguccaccgagcacggcaccaccgccaccaucacgccccaggcgcccaccaccgagauccagcugaccgacuacggggcccugacgcucgacugcagcccccgcaccggccuggacuucaacgagaugguccugcucaccaugaaggagaaguccuggcuggugcacaagcagugguuccuggaccucccccugcccuggaccagcggggccagcacgucccaggagaccuggaaccggcaggaccugcucgugaccuucaagaccgcccacgccaagaagcaggaggucguggugcugggcagccaggagggcgcgaugcacacggcccugaccggggccaccgagauccagaccuccggcacgaccaccaucuucgccgggcaccucaagugccgccugaagauggacaagcugacccucaagggcaugagcuacgucaugugcacgggguccuucaagcuggagaaggagcuggccgagacccagcacggcaccgugcuggugcagaucaaguacgagggcaccgacgcgcccugcaagauccccuucagcacgcaggacgagaagggggucacccagaacggccggcucaucaccgccaacccgaucgugaccgacaaggagaagcccgugaacaucgaggccgagccgcccuucggggaguccuacaucgucaucggcgccggcgagaaggcgcugaagcugagcugguucaagaagggguccagcaucggcaagauguucgaggccacggcccgcggggcccggcgcauggccauccucggcgacaccgcgugggacuucggguccaucggcggcguguucaccagcguggggaagcugguccaccagaucuucggcaccgccuacggggugcuguucuccggcgugagcuggacgaugaagaucgggaucggcguccuccugaccuggcugggccucaacucccgcagcaccucccugagcaugaccugcaucgccguggggcuggugacgcucuaccugggcgucauggugcaggccgacuccgggugcgugaucaacuggaagggccgggagcugaagugcgggagcggcaucuucgucaccaacgaggugcacaccuggaccgagcaguacaaguuccaggccgacagcccgaagcgccucuccgcggccaucggcaaggccugggaggagggggugugcggcauccggagcgccacccgccuggagaacaucauguggaagcagaucuccaacgagcugaaccacauccuccuggagaacgacaugaaguucacggucguggugggggacgucgccggcauccuggcgcaggggaagaagaugauccggccccagcccauggaguacaaguacagcuggaaguccuggggcaaggccaagaucaucggcgccgacgugcagaacaccaccuucaucaucgacgggcccaacaccccggagugccccgacgaccagcgcgccuggaacaucugggagguggaggacuacggcuucgggaucuucacgaccaacaucuggcucaagcugcgggacagcuacacccaggucugcgaccaccgccugauguccgcggccaucaaggacagcaaggccgugcacgccgacaugggcuacuggaucgaguccgagaagaacgagaccuggaagcucgcccgggcgagcuucaucgaggugaagacgugcaucuggcccaagucccacacccuguggagcaacggcguccuggaguccgagaugaucauccccaagaucuacgggggcccgaucagccagcacaacuaccgccccggguacuucacccagaccgccggccccuggcaccucgggaagcuggagcuggacuucgaccucugcgagggcacgaccgugguggucgacgagcacugcggcaaccgggggccgucccugcgcaccaccacggugaccggcaagaucauccacgaguggugcugccggagcugcacccugccgccccugcgcuuccgcggggaggacggcugcugguacgggauggagauccgccccgugaaggagaaggaggagaaccuggucaaguccauggugagcgccggcagcggcgagguggacuccuucagccuggggcuccugugcaucuccaucaugaucgaggaggucaugcggagccgcuggucccggaagaugcugaugaccggcacgcucgccguguucuuccugcugaucauggggcagcucaccuggaacgaccugauccgccugugcaucauggugggcgccaacgcgagcgaccgcauggggaugggcaccaccuaccucgcccugauggccacguucaagaugcggccgauguucgccgucggccuccucuuccgccggcugaccucccgcgaggugcugcuccugaccaucgggcugagccucguggccuccgucgagcugcccaacagccuggaggagcucggcgacgggcuggcgaugggcaucaugauccugaagcuccugaccgacuuccagucccaccagcugugggccacgcuccugagccugaccuucaucaagaccaccuucucccuccacuacgccuggaagacgauggccauggugcugagcaucgucucccuguucccccucugccugagcaccaccucccagaagaccacguggcugcccgugcuccugggcagccuggggugcaagccgcucaccauguuccugaucgcggagaacaagaucuggggccggcgcuccuggccccugaacgaggggaucauggccgugggcaucgucagcauccuccugagcucccugcucaagaacgacgugccccuggccgggccccugaucgccggcggcaugcucaucgccugcuacgugaucagcggguccagcgcggaccugucccuggagaaggccgccgaggucagcugggaggaggaggccgagcacuccggcgccagccacaacauccucguggaggugcaggacgacgggaccaugaagaucaaggacgaggagcgggacgacacccugaccauccugcucaaggcgacgcugcuggccgucuccggcguguacccgcucagcauccccgccacccuguucgugugguacuucuggcagaagaagaagcagcgcuccgggguccugugggacacccccagcccgcccgagguggagcgggccgugcuggacgacggcaucuaccgcaucaugcagcggggccuccuggggcgcucccaggucggcguggggguguuccaggagaacgucuuccacaccauguggcacgugacgcggggcgccgugcugauguaccaggggaagcgccucgagcccagcugggcguccgucaagaaggaccugaucagcuacggcggcggguggcggcugcagggcuccuggaacaccggggaggagguccaggugaucgccgucgagcccggcaagaaccccaagaacgugcagaccgcccccgggaccuucaagacgcccgagggcgaggugggcgccaucgcccucgacuucaagcccgggaccagcggcucccccaucgucaaccgcgaggggaagaucgugggccuguacggcaacgggguggucaccaccagcggcacguacgugagcgcgaucgcccaggccaaggccucccaggaggggccgcugcccgagaucgaggacgagguguuccggaagcgcaaccucaccaucauggaccugcaccccggcagcgggaagacccggcgcuaccugccggcgaucguccgggaggccaucaagcgcaagcuccgcacccugauccuggcccccacgcgggugguggccuccgagauggccgaggcgcucaagggcaugcccauccgcuaccagaccaccgccgucaagagcgagcacaccggcaaggagaucguggaccugaugugccacgccacguucaccaugcggcugcucucccccgugcgcgucccgaacuacaacaugaucaucauggacgaggcccacuucaccgaccccagcuccaucgccgcgcggggguacaucagcacccgcgugggcaugggggaggccgccgccaucuucaugacggccacgccgcccggcuccguggaggcguucccgcagagcaacgccgucauccaggacgaggagcgggacauccccgagcgcuccuggaacagcggguacgaguggaucaccgacuuccccggcaagaccgugugguucgugcccuccaucaagagcggcaacgacaucgccaacugccugcggaagaacgggaagcgcgucauccagcugucccggaagacguucgacaccgaguaccagaagaccaagaacaacgacugggacuacguggugaccacggacaucagcgagaugggcgccaacuuccgcgcggaccgggucaucgacccgcgccggugccucaagcccgugauccugaaggacgggcccgagcgcgugauccuggccggccccaugccggucaccguggccuccgccgcccagcggcgcgggcggaucggccgcaaccacaacaaggagggcgaccaguacaucuacauggggcagccccucaacaacgacgaggaccacgcgcacuggaccgaggccaagaugcugcuggacaacaucaacacccccgagggcaucauccccgcccucuucgagccggagcgcgagaaguccgccgccaucgacggggaguaccggcugcgcggcgaggcgcggaagacguucgucgagcugaugcgccgcggggaccuccccguguggcuguccuacaagguggccagcgagggcuuccaguacagcgaccgccgguggugcuucgacggcgagcgcaacaaccagguccuggaggagaacauggacguggagaucuggaccaaggagggggagcggaagaagcuccgcccccgguggcuggacgcccgcaccuacuccgacccccuggcccuccgggaguucaaggaguucgccgcgggccgccggagcguguccggggaccugauccuggagaucggcaagcucccgcagcaccugacccagcgcgcccagaacgcccuggacaaccucgucaugcugcacaacagcgagcagggcgggcgggccuaccgccacgcgauggaggagcugcccgacacgaucgagacccucaugcugcuggcccucaucgccgugcugaccggcggggugacccuguucuuccucuccggccgggggcugggcaagaccagcaucggccugcucugcgucauggccuccagcgugcugcuguggauggccuccguggagccccacuggaucgcggccagcaucauccucgaguucuuccugaugguccugcucauccccgagccggaccgccagcggacgccccaggacaaccagcuggccuacguggugaucgggcuccucuucaugauccugaccgucgccgccaacgagaugggccugcucgagaccaccaagaaggaccuggggaucggccacguggcgguggagaaccaccaccacgccgccaugcuggacgucgaccuccaccccgccuccgccuggacgcuguacgcgguggccaccaccaucaucaccccgaugaugcgccacacgaucgagaacaccaccgccaacaucagccugaccgccaucgccaaccaggcggccauccucauggggcuggacaagggcuggcccaucuccaagauggacaucggcgugccccugcucgcccuggggugcuacagccaggucaacccccugacgcucaccgccgcggugcugaugcugguggcccacuacgccaucaucggcccggggcuccaggccaaggccacccgcgaggcgcagaagcggaccgccgccggcaucaugaagaaccccacggucgacgggaucguggccaucgaccuggaccccguggucuacgacgccaaguucgagaagcagcugggccagaucaugcuccugauccugugcaccucccagauccuccugaugcgcaccaccugggcgcugugcgagagcaucacgcucgccaccggcccccugaccacccugugggagggguccccgggcaaguucuggaacacgaccaucgccgugagcauggccaacaucuuccggggguccuaccucgccggcgcgggccuggccuucagccugaugaagucccucgggggcgggcgccggggcaccggggcccagggcgagacccugggcgagaaguggaagcgccagcugaaccagcucuccaagagcgaguucaacacguacaagcgguccgggaucauggagguggaccgcagcgaggccaaggagggccugaagcgcggggagaccaccaagcacgcggucucccgcggcaccgccaagcugcggugguucguggagcgcaaccuggugaagcccgaggggaaggucaucgaccucggcugcggccgcggcggguggagcuacuacugcgccgggcugaagaaggugacggaggugaagggguacaccaagggcgggcccggccacgaggagcccaucccgauggccaccuacggguggaaccuggucaagcuccacuccggcaaggacguguucuucaucccgcccgagaagugcgacacccugcugugcgacaucggggagagcucccccaacccgacgaucgaggagggccgcacccuccgggugcugaagauggucgagcccuggcugcgcgggaaccaguucugcaucaagauccucaaccccuacaugcccagcgugguggagacccuggagcagaugcagcggaagcacggcggcaugcugguccgcaacccgcucucccggaacagcacccacgagauguacuggguguccugcgggaccggcaacaucgugagcgccgucaacaugacgucccgcaugcugcugaaccgcuucaccauggcgcaccggaagcccaccuacgagcgcgacguggaccucggggccggcacccggcacguggccgucgagcccgagguggccaaccuggacaucaucggccagcgcaucgagaacaucaagcacgagcacaagagcacguggcacuacgacgaggacaaccccuacaagaccugggccuaccacggguccuacgaggugaagccgagcggcuccgcgagcagcauggucaacgggguggucaagcugcucaccaagcccugggacgugauccccauggugacccagaucgccaugacggacaccacccccuucggccagcagcgggucuucaaggagaagguggacacccgcacgccgaaggccaagcgggggaccgcccagaucauggaggugaccgccaaguggcuguggggcuuccugucccgcaacaagaagccccggaucugcacccgcgaggaguucacgcggaagguccgcagcaacgcggccaucggcgccguguucguggacgagaaccaguggaacuccgccaaggaggcggucgaggacgagcgguucugggaccucgugcaccgcgagcgggagcugcacaagcaggggaagugcgcgaccugcguguacaacaugaugggcaagcgcgagaagaagcugggggaguucggcaaggccaaggggagccgggccaucugguacauguggcucggcgcccgcuuccuggaguucgaggcgcugggcuucaugaacgaggaccacugguucucccgggagaacagccucuccggggucgagggcgaggggcugcacaagcugggcuacauccuccgcgacaucagcaagauccccgggggcaacauguacgccgacgacaccgccggcugggacacccggaucacggaggacgaccugcagaacgaggcccgcaucaccgacaucauggagccggagcacgcccugcucgcgaaguccaucuucaagcugaccuaccagaacaagguggugcgcguccagcggcccgccaagaacgggaccgugauggacgugaucagccgccgggaccagcgcggcuccgggcaggucggcacguacggccugaacaccuucaccaacauggaggcccagcucauccggcagauggagagcgaggggaucuucucccccagcgagcuggagacccccaaccuggccaagcgcgugcucgacuggcuggagaaguacggcguggagcggcugaagcgcauggccaucuccggggacgacugcgucgugaagccgaucgacgaccgguucgcgacggcccucaccgcccugaacgacaugggcaaggugcgcaaggacaucccccagugggagcccagcaagggguggaacgacuggcagcagguccccuucugcucccaccacuuccaccagcugaucaugaaggacggccgggagaucguggugccgugccgcaaccaggacgagcucgucggccgggcccgcgugagccagggggccggcuggagccugcgggagaccgcgugccuggggaaguccuacgcccagauguggcagcucauguacuuccaccgccgggaccugcgccuggccgccaacgcgaucugcagcgccgugcccgucgacuggauccccaccucccggacgaccuggagcauccacgcccaccaccaguggaugaccaccgaggacaugcucuccguguggaaccgcguguggaucgaggagaaccccuggauggaggacaagacgcacaucagcuccuggggcgacgucccguaccuggggaagcgcgaggaccaguggugcggcagccugaucggccucaccgcccgggccaccugggcgaccaacauccagguggccaucaaccaggugcgccggcugaucgggaacgagaacuaccuggacuacaugaccuccaugaagcgcuucaagaacgagagcgaccccgagggcgcccucugguga

SEQ ID NO: 8295 - RNA, 9879 nt, Artificial Sequence
  derived and/or modified CDS sequence (opt1) from DENV-1__EU677158__SS-prME
agcgugaccaugcugcugaugcugaugcccaccgcccuggccuuccaccucaccacccggggcggggagccccacaugaucgugagcaagcaggagcggggcaagagccugcuguucaagaccuccgccggggugaacaugugcacccucaucgccauggaccugggcgagcugugcgaggacaccaugaccuacaagugcccccggaucaccgagaccgagcccgacgacguggacugcuggugcaacgccacggacaccugggucaccuacgggaccugcagccagacgggcgagcaccggcgggacaagcgguccguggcccucgcgccccacgugggccuggggcuggagacccgcaccgagaccuggaugagcuccgagggcgcguggaagcagauccagcgggucgagacgugggcccuccggcaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagguggccgagacccagcacggcaccgugcugguccagaucaaguacgagggcaccgacgcgcccugcaagauccccuuccugacgcaggacgagaagggggugacccagaacggccggcugaucaccgccaacccgaucgugaccgacaaggagaagcccgucaacaucgaggccgagccgcccuucggggagagcuacaucaucaucggcgccggcgagaaggcgcucaagcuguccugguucaagaaggggagcuccaucggcaagauguucgaggccacggcccgcggggcccggcgcauggccauccugggcgacaccgcgugggacuucgggagcaucggcggcguguucaccuccguggggaagcucguccaccagaucuucggcaccgccuacggggugcuguucagcggcguguccuggacgaugaagaucgggaucggcguccugcucaccuggcugggccugaacagccgcuccaccagccucuccaugaccugcaucgccguggggcuggugacgcuguaccucggcgucauggugcaggccgacagcgggugcgugaucaacuggaagggccgggagcugaagugcggguccggcaucuucgucaccaacgaggugcacaccuggaccgagcaguacaaguuccaggccgacagcccgaagcgccugagcgcggccaucggcaaggccugggaggagggggugugcggcauccgguccgccacccgccucgagaacaucauguggaagcagaucagcaacgagcugaaccacauccugcucgagaacgacaugaaguucacggucguggugggggacgucgccggcauccuggcgcaggggaagaagaugauccggccccagcccauggaguacaaguacuccuggaaguccuggggcaaggccaagaucaucggcgccgacgugcagaacaccaccuucaucaucgacgggcccaacaccccggagugccccgacgaccagcgcgccuggaacaucugggagguggaggacuacggcuucgggaucuucacgaccaacaucuggcugaagcuccgggacuccuacacccaggucugcgaccaccgccugaugagcgcggccaucaaggacuccaaggccgugcacgccgacaugggcuacuggaucgagagcgagaagaacgagaccuggaagcuggcccgggcguccuucaucgaggugaagacgugcaucuggcccaagagccacacccucugguccaacggcguccuggagagcgagaugaucauccccaagaucuacgggggcccgaucucccagcacaacuaccgccccggguacuucacccagaccgccggccccuggcaccuggggaagcucgagcuggacuucgaccugugcgagggcacgaccgugguggucgacgagcacugcggcaaccgggggccgagccuccgcaccaccacggugaccggcaagaucauccacgaguggugcugccgguccugcacccugccgccccugcgcuuccgcggggaggacggcugcugguacgggauggagauccgccccgugaaggagaaggaggagaaccucgucaagagcaugguguccgccggcagcggcgagguggacagcuucucccuggggcugcucugcaucagcaucaucaucgaggaggucaugcggucccgcuggagccggaagaugcugaugaccggcacgcuggccguguucgugcuccugaucauggggcagcugaccuggaacgaccucauccgccugugcaucauggucggcgccaacgcguccgaccgcauggggaugggcaccaccuaccuggcccucauggccacguucaagaugcggccgauguucgccgugggccugcuguuccgccggcucaccagccgcgaggugcugcugcucaccaucgggcugucccuggucgccagcguggagcuccccaacucccuggaggagcugggcgacgggcucgcgaugggcaucaugauccugaagcugcucaccgacuuccagagccaccagcugugggccacgcugcucucccugaccuucaucaagaccaccuucagccugcacuacgccuggaagacgauggccaugguccucuccaucgugagccuguucccccugugccucuccaccaccagccagaagaccacguggcugcccgugcugcucggcucccuggggugcaagccgcugaccauguuccucaucgcggagaacaagaucuggggccggcgcagcuggccccugaacgaggggaucauggccgucggcaucguguccauccugcucagcagccugcugaagaacgacgugccccucgccgggccccugaucgccggcggcaugcugaucgccugcuacgucaucuccgggagcuccgcggaccucagccuggagaaggccgccgagguguccugggaggaggaggccgagcacagcggcgccucccacaacauccugguggagguccaggacgacgggaccaugaagaucaaggacgaggagcgggacgacacccucaccauccugcugaaggcgacgcuccuggccgugagcggcguguacccgcuguccauccccgccacccucuucgucugguacuucuggcagaagaagaagcagcgcagcggggugcugugggacacccccagcccgcccgagguggagcgggccguccuggacgacggcaucuaccgcaucaugcagcggggccugcucgggcgcagccaggugggcgugggggucuuccaggagaacguguuccacaccauguggcacgugacgcggggcgccguccugauguaccaggggaagcgccuggagcccuccugggcgagcgugaagaaggaccucaucuccuacggcggcggguggcggcugcagggcagcuggaacaccggggaggaggugcaggucaucgccguggagcccggcaagaaccccaagaacgugcagaccgcccccgggaccuucaagacgcccgagggcgaggucggcgccaucgcccuggacuucaagcccgggaccuccggcagccccaucgugaaccgcgaggggaagaucgugggccucuacggcaacggggucgugaccaccuccggcacguacgugagcgcgaucgcccaggccaaggccagccaggaggggccgcugcccgagaucgaggacgaggucuuccggaagcgcaaccugaccaucauggaccuccaccccggcuccgggaagacccggcgcuaccugccggcgaucgugcgggaggccaucaagcgcaagcugcgcacccucauccuggcccccacgcggguggucgccagcgagauggccgaggcgcugaagggcaugcccauccgcuaccagaccaccgccgugaaguccgagcacaccggcaaggagaucguggaccucaugugccacgccacguucaccaugcggcugcugagccccguccgcgugccgaacuacaacaugaucaucauggacgaggcccacuucaccgaccccuccagcaucgccgcgcggggguacaucuccacccgcgugggcaugggggaggccgccgccaucuucaugacggccacgccgcccggcagcgucgaggcguucccgcaguccaacgccgugauccaggacgaggagcgggacauccccgagcgcagcuggaacuccggguacgaguggaucaccgacuuccccggcaagaccgugugguucguccccagcaucaaguccggcaacgacaucgccaacugccuccggaagaacgggaagcgcgugauccagcugagccggaagacguucgacaccgaguaccagaagaccaagaacaacgacugggacuacguggucaccacggacaucuccgagaugggcgccaacuuccgcgcggaccgggugaucgacccgcgccggugccugaagcccgugauccucaaggacgggcccgagcgcgucauccuggccggccccaugccggugaccgucgccagcgccgcccagcggcgcgggcggaucggccgcaaccacaacaaggagggcgaccaguacaucuacauggggcagccccugaacaacgacgaggaccacgcgcacuggaccgaggccaagaugcuccuggacaacaucaacacccccgagggcaucauccccgcccuguucgagccggagcgcgagaaguccgccgccaucgacggggaguaccggcuccgcggcgaggcgcggaagacguucguggagcugaugcgccgcggggaccugcccguguggcucagcuacaaggucgccuccgagggcuuccaguacagcgaccgccgguggugcuucgacggcgagcgcaacaaccaggugcuggaggagaacauggacguggagaucuggaccaaggagggggagcggaagaagcugcgcccccgguggcucgacgcccgcaccuacagcgacccccuggcccugcgggaguucaaggaguucgccgcgggccgccgguccgucagcggggaccucauccuggagaucggcaagcugccgcagcaccucacccagcgcgcccagaacgcccuggacaaccuggugaugcuccacaacuccgagcagggcgggcgggccuaccgccacgcgauggaggagcugcccgacacgaucgagacccugaugcuccuggcccugaucgccgugcucaccggcggggucacccuguucuuccugagcggccgggggcucggcaagaccuccaucggccugcugugcgugauggccagcuccgugcuccuguggauggccagcgucgagccccacuggaucgcggccuccaucauccuggaguucuuccucauggugcugcugauccccgagccggaccgccagcggacgccccaggacaaccagcucgccuacguggucaucgggcugcuguucaugauccucaccguggccgccaacgagaugggccugcuggagaccaccaagaaggaccucgggaucggccacguggcggucgagaaccaccaccacgccgccaugcuggacguggaccugcaccccgccagcgccuggacgcucuacgcgguggccaccaccaucaucaccccgaugaugcgccacacgaucgagaacaccaccgccaacaucucccugaccgccaucgccaaccaggcggccauccugauggggcucgacaagggcuggcccaucagcaagauggacaucggcgucccccugcuggcccucgggugcuacucccaggugaacccccugacgcugaccgccgcggugcucaugcuggucgcccacuacgccaucaucggcccggggcugcaggccaaggccacccgcgaggcgcagaagcggaccgccgccggcaucaugaagaaccccacgguggacgggaucguggccaucgaccucgaccccgucguguacgacgccaaguucgagaagcagcugggccagaucaugcugcucauccugugcaccagccagauccugcucaugcgcaccaccugggcgcugugcgaguccaucacgcuggccaccggcccccucaccacccugugggaggggagcccgggcaaguucuggaacacgaccaucgccguguccauggccaacaucuuccgggggagcuaccuggccggcgcgggccucgccuucucccugaugaagucccucgggggcgggcgccgggggaccggggcccagggcgagacccucggcgagaaguggaagcgccagcugaaccagcugagcaaguccgaguucaacacguacaagcggagcgggaucauggaggucgaccgcuccgaggccaaggagggccucaagcgcggggagaccaccaagcacgcggugagccgcggcaccgccaagcugcggugguucguggagcgcaaccuggucaagcccgaggggaaggugaucgaccugggcugcggccgcggcgggugguccuacuacugcgccgggcucaagaaggugacggaggucaagggguacaccaagggcggccccggccacgaggagcccaucccgauggccaccuacggguggaaccuggugaagcugcacagcggcaaggacguguucuucaucccgcccgagaagugcgacacccuccugugcgacaucggggaguccagccccaacccgacgaucgaggagggccgcacccugcggguccucaagaugguggagcccuggcugcgcgggaaccaguucugcaucaagauccugaaccccuacaugcccuccguggucgagacccucgagcagaugcagcggaagcacggcggcaugcuggugcgcaacccgcugagccggaacuccacccacgagauguacugggugagcugcgggaccggcaacaucgucuccgccgugaacaugacgagccgcaugcuccugaaccgcuucaccauggcgcaccggaagcccaccuacgagcgcgacguggaccugggggccggcacccggcacgucgccguggagcccgagguggccaaccucgacaucaucggccagcgcaucgagaacaucaagcacgagcacaaguccacguggcacuacgacgaggacaaccccuacaagaccugggccuaccacgggagcuacgaggucaagccguccggcagcgcguccagcauggugaacggggucgugaagcugcugaccaagcccugggacgugauccccauggucacccagaucgccaugacggacaccacccccuucggccagcagcggguguucaaggagaagguggacacccgcacgccgaaggccaagcgggggaccgcccagaucauggaggucaccgccaaguggcucuggggcuuccugagccgcaacaagaagccccggaucugcacccgcgaggaguucacgcggaaggugcgcuccaacgcggccaucggcgccguguucgucgacgagaaccaguggaacagcgccaaggaggcgguggaggacgagcgguucugggaccuggugcaccgcgagcgggagcuccacaagcaggggaagugcgcgaccugcgucuacaacaugaugggcaagcgcgagaagaagcugggggaguucggcaaggccaaggggucccgggccaucugguacauguggcugggcgcccgcuuccucgaguucgaggcgcugggcuucaugaacgaggaccacugguucagccgggagaacucccugagcgggguggagggcgaggggcuccacaagcugggcuacauccugcgcgacaucuccaagauccccgggggcaacauguacgccgacgacaccgccggcugggacacccggaucacggaggacgaccuccagaacgaggcccgcaucaccgacaucauggagccggagcacgcccugcuggccaagagcaucuucaagcucaccuaccagaacaaggugguccgcgugcagcggcccgccaagaacgggaccgugauggacgucaucucccgccgggaccagcgcggcagcggccagguggggacguacggccugaacaccuucaccaacauggaggcccagcugauccggcagauggaguccgaggggaucuucagccccuccgagcucgagacccccaaccuggccgagcgcgugcuggacuggcucgagaaguacggcgucgagcggcugaagcgcauggccaucagcggggacgacugcguggugaagccgaucgacgaccgguucgcgacggcccugaccgcccucaacgacaugggcaagguccgcaaggacaucccccagugggagcccuccaagggguggaacgacuggcagcagguccccuucugcagccaccacuuccaccagcugaucaugaaggacggccgggagaucguggucccgugccgcaaccaggacgagcuggugggccgggcccgcgugucccagggggccggcuggagccuccgggagaccgcgugccugggcaagagcuacgcccagauguggcagcugauguacuuccaccgccgggaccuccgccuggccgccaacgcgaucugcuccgccguccccguggacuggauccccaccagccggacgaccugguccauccacgcccaccaccaguggaugaccaccgaggacaugcugagcguguggaaccgcgucuggaucgaggagaaccccuggauggaggacaagacgcacaucuccagcuggggcgacgugccguaccucgggaagcgcgaggaccaguggugcggcucccugaucggccugaccgcccgggccaccugggcgaccaacauccagguggccaucaaccagguccgccggcucaucgggaacgagaacuaccuggacuacaugaccagcaugaagcgcuucaagaacgagggcgaccccgagggggcccugugguga

SEQ ID NO: 8296 - RNA, 9879 nt, Artificial Sequence
  derived and/or modified CDS sequence (opt1) from DENV-1__EU677159__SS-prME
agcgugaccaugcugcucaugcugaugcccaccgcccuggccuuccaccucaccacccgcggcggggagccccacaugaucgugagcaagcaggagcggggcaagagccugcuguucaagaccagcgcgggggugaacaugugcacccucaucgccauggaccugggcgagcugugcgaggacaccaugaccuacaagugcccccgcaucaccgaggccgagcccgacgacguggacugcuggugcaacgccaccgacacgugggugaccuacgggaccugcagccagaccggcgagcaccggcgcgacaagcgguccguggcccucgcgccccacgugggccuggggcuggagacgcgcaccgagaccuggaugagcuccgagggcgccuggaagcagauccagcgggucgagaccugggcccuccgccaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcggugcugcggaagcucugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacaccggcgaccagcaccagguggggaacgaguccacggagcacggcaccaccgcgaccaucacgccccaggcccccacgaccgagauccagcucaccgacuacggggcccugacccuggacugcagcccccgcacgggccucgacuucaacgagaugguccugcugaccaugaaggagaaguccuggcucgugcacaagcagugguuccuggaccugccccuccccuggaccagcggggccagcaccucccaggagacguggaaccggcaggaccugcuggugaccuucaagaccgcccacgcgaagaagcaggaggucguggugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgucaugugcaccggguccuucaagcucgagaaggagguggcggagacgcagcacggcaccgugcugguccagaucaaguacgagggcaccgacgcccccugcaagauccccuucagcacccaggacgagaagggggugacgcagaacggccggcugaucaccgccaacccgaucgugaccgacaaggagaagcccgucaacaucgaggccgagccgcccuucggggaguccuacaucgugaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcgucgggaagcuggugcaccagaucuucggcaccgccuacgggguccucuucuccggcgucagcuggaccaugaagaucgggaucggcgugcugcugacguggcucggccugaacucccgcagcaccucccugagcaugaccugcaucgccguggggcucgucacccuguaccugggcgugauggugcaggccgacuccgggugcgucaucaacuggaagggccgggagcucaagugcgggagcggcaucuucgugacgaacgaggugcacaccuggaccgagcaguacaaguuccaggcggacagcccgaagcgccuguccgccgccaucggcaaggccugggaggagggggucugcggcauccggagcgccacccgccuggagaacaucauguggaagcagaucuccaacgagcucaaccacauccugcuggagaacgacaugaagcucaccgugguggucggggacguggcgggcauccuggggcagggcaagaagaugauccggccccagcccauggaguacaaguacagcuggaaguccuggggcaaggccaagaucaucggggccgacgcccagaacacgaccuucaucaucgacggccccaacaccccggagugccccgacgaccagcgcgcguggaacaucugggagguggaggacuacggguucggcaucuucaccacgaacaucuggcugaagcuccgggacagcuacacccaggucugcgaccaccgccugauguccgccgccaucaaggacagcaaggccgugcacgccgacaugggcuacuggaucgaguccgagaagaacgagaccuggaagcuggcgcgggccagcuucaucgaggugaagaccugcaucuggcccaagucccacacgcucuggagcaacgggguccuggaguccgagaugaucauccccaagaucuacggcgggccgaucagccagcacaacuaccgccccggcuacuucacccagaccgccgggcccuggcaccugggcaagcucgagcuggacuucgaccugugcgagggcaccacggugguggucgacgagcacugcgggaaccggggcccgucccuccgcaccaccaccgugacggggaagaucauccacgaguggugcugccggagcugcacccugccgccccugcgcuuccggggcgaggacgggugcugguacggcauggagauccgccccgugaaggagaaggaggagaaccucgucaaguccauggugagcgccggcagcggggagguggacuccuucagccugggccugcucugcaucuccaucaugaucgaggaggucaugcggagccgcuggucccggaagaugcugaugaccgggacccuggccguguucuuccuccugaucaugggccagcugacguggaacgaccucauccgccugugcaucauggugggggcgaacgccagcgaccgcaugggcaugggcaccaccuaccuggcccucauggccaccuucaagaugcggccgauguucgccgucgggcugcuguuccgccggcucacgucccgcgaggugcugcugcucaccaucgggcugagccugguggcguccgucgagcuccccaacagccuggaggagcugggggacggccucgccaugggcaucaugauccugaagcugcucaccgacuuccagucccaccagcugugggccacccugcucagccugacguucaucaagaccaccuucucccugcacuacgccuggaagaccauggcgauggugcucagcaucgucucccuguucccccugugccucagcacgaccucccagaagaccaccuggcugcccgugcugcucgggagccugggcugcaagccgcugacgauguuccucaucgccgagaacaagaucugggggcggaaguccuggccccugaacgagggcaucauggccguggggaucgucagcauccugcucagcucccugcugaagaacgacgugccccucgccggcccccugaucgccggcgggaugcugaucgcgugcuacgugaucagcggcuccagcgccgaccucucccuggagaaggccgccgaggucagcugggaggaggaggccgagcacuccggggcgagccacaacauccugguggaggugcaggacgacggcaccaugaagaucaaggacgaggagcgcgacgacacccucaccauccugcugaaggccacccuccuggccgucuccgggguguacccgaucagcauccccgccacgcuguucgugugguacuucuggcagaagaagaagcagcgguccggcguccucugggacacccccagcccgcccgagguggagcgcgccgugcuggacgacggcaucuaccggaucaugcagcgcgggcugcugggccggucccaggucggggugggcguguuccaggagaacgucuuccacaccauguggcacgugacccgcggggcggugcucauguaccagggcaagcggcuggagcccagcugggccuccgucaagaaggaccugaucagcuacggcgggggcuggcgccuccggggguccuggaacacgggcgaggagguccaggugaucgccgucgagcccgggaagaaccccaagaacgugcagaccgcccccggcaccuucaagacccccgagggcgaggugggggccaucgcgcuggacuucaagcccggcacgagcgggucccccaucgucaaccgcgagggcaagaucgugggccuguacgggaacggcguggucaccaccagcgggaccuacgugagcgccaucgcccaggccaaggcgucccaggagggcccgcuccccgagaucgaggacgagguguuccggaagcgcaaccugacgaucauggaccugcaccccgggagcggcaagacccggcgcuaccucccggccaucguccgggaggccaucaagcgcaagcugcgcacccugauccucgcccccacccgggugguggccuccgagauggcggaggcccugaagggcaugcccauccgcuaccagacgaccgccgucaagagcgagcacaccgggaaggagaucguggaccugaugugccacgccaccuucacgaugcggcuccugucccccgugcgcgucccgaacuacaacaugaucaucauggacgaggcccacuucaccgaccccagcuccaucgcggcccggggcuacaucagcacccgcguggggaugggcgaggccgccgccaucuucaugaccgcgacgccgcccggguccguggaggccuucccgcagagcaacgccgucauccaggacgaggagcgggacauccccgagcgcuccuggaacagcggcuacgaguggaucaccgacuuccccggcaagaccgugugguucgugcccuccaucaagagcgggaacgacaucgccaacugccugcggaagaacggcaagcgcgucauccagcucucccggaagaccuucgacacggaguaccagaagaccaagaacaacgacugggacuacguggugaccaccgacaucagcgagaugggggcgaacuuccgcgccgaccgggucaucgacccgcgccggugccugaagcccgugauccugaaggacggccccgagcgcgugauccucgccgggcccaugccggucacgguggccuccgccgcgcagcggcgcggccggaucggccgcaaccacaacaaggagggggaccaguacaucuacaugggccagccccugaacaacgacgaggaccacgcccacuggaccgaggccaagaugcugcucgacaacaucaacacccccgaggggaucauccccgcccuguucgagccggagcgcgagaaguccgccgcggucgacggcgaguaccggcugcgcggggaggcccggaagaccuucguggagcucaugcgccggggcgaccugcccguguggcuguccuacaaggucgccagcgagggcuuccaguacagcgaccgccgguggugcuucgacggggagcgcaacaaccaggugcucgaggagaacauggacguggagaucuggacgaaggagggcgagcggaagaagcugcgcccccgguggcuggacgcccgcaccuacuccgacccccucgcccugcgggaguucaaggaguucgcggccgggcgccggagcgucuccggcgaccugauccucgagaucggcaagcugccgcagcaccugacccagcgcgcccagaacgcccucgacaaccuggugaugcugcacaacagcgagcagggcgggcgggcguaccgccacgccauggaggagcuccccgacaccaucgagacgcugaugcugcucgcccugaucgccgugcugaccgggggcgucacccucuucuuccuguccgggcggggccugggcaagaccagcaucgggcuccugugcgugauggccuccagcgugcugcucuggauggcguccgucgagccccacuggaucgccgccagcaucauccuggaguucuuccugauggugcuccugauccccgagccggaccgccagcggacgccccaggacaaccagcuggccuacguggucaucggccuccuguucaugauccugacgguggccgcgaacgagauggggcuccuggagaccaccaagaaggaccugggcaucgggcacguggccgucgagaaccaccaccacgccgccaugcucgacguggaccugcaccccgccuccgcguggacccuguacgccguggccacgaccaucaucaccccgaugaugcgccacaccaucgagaacacgaccgccaacaucagccucaccgccaucgcgaaccaggccgccauccugaugggccuggacaagggcuggcccaucuccaagauggacaucggggucccccuccuggcccugggcugcuacagccaggugaacccccucacccugacggcggccgugcugaugcucgucgcccacuacgccaucaucgggccgggccugcaggccaaggcgacccgcgaggcccagaagcggaccgccgccgggaucaugaagaaccccaccguggacggcaucguggccaucgaccuggaccccgucguguacgacgcgaaguucgagaagcagcucggccagaucaugcugcugauccucugcacgucccagauccugcugaugcgcaccaccugggcccucugcgagagcaucacccuggccacggggccccugaccacccucugggagggcuccccggggaaguucuggaacaccacgaucgccgugagcauggccaacaucuuccggggcuccuaccuggcgggcgccgggcuggccuucagccucaugaagucccugggcgggggccgccgggggaccggcgcccagggcgagacccugggggagaaguggaagcgccagcucaaccagcuguccaagagcgaguucaacaccuacaagcgguccggcaucauggaggucgaccgcagcgaggcgaaggaggggcugaagcggggcgagacgaccaagcacgccgugucccgcgggaccgccaagcuccggugguucguggagcgcaaccuggucaagcccgagggcaaggugaucgaccugggcugcgggcggggcggguggagcuacuacugcgccggccugaagaaggugaccgaggucaagggguacacgaagggcggccccgggcacgaggagcccaucccgauggccaccuacggcuggaaccucgugaagcugcacuccgggaaggacguguucuucaucccgcccgagaagugcgacacccugcucugcgacaucggcgagagcucccccaacccgaccaucgaggaggggcgcacgcugcggguccugaagaugguggagcccuggcuccgcggcaaccaguucugcaucaagauccugaaccccuacaugcccagcguggucgaggcgcuggagcagaugcagcggaagcacggcgggaugcucgugcgcaacccgcugucccggaacagcacccacgagauguacuggguguccugcggcaccgggaacaucgucagcgccgugaacaugaccucccgcaugcugcucaaccgcuucaccauggcccaccggaagcccacguacgagcgcgacguggaccugggcaccggcacccggcacgucgccguggagcccgagguggccaaccuggacaucaucgggcagcgcaucgagaacaucaagcacgagcacaagagcaccuggcacuacgacgaggacaaccccuacaagacgugggcguaccacggcuccuacgaggucaagccgagcggguccgccagcagcauggugaacggcgucgugaagcuccugaccaagcccugggacgugauccccauggucacccagaucgccaugaccgacacgacccccuucgggcagcagcggguguucaaggagaagguggacacccgcaccccgaaggccaagcggggcacggcccagaucauggaggucaccgcgcgcuggcuguggggcuuccucucccggaacaagaagccccgcaucugcacccgggaggaguucacccgcaaggugcggagcaacgccgccaucggggccguguucgucgacgagaaccaguggaacuccgcgaaggaggccguggaggacgagcgcuucugggaccuggugcaccgggagcgcgagcugcacaagcagggcaagugcgccacgugcgucuacaacaugauggggaagcgggagaagaagcucggcgaguucgggaaggccaagggcagccgcgccaucugguacauguggcugggcgcgcgguuccuggaguucgaggcccucggguucaugaacgaggaccacugguucucccgcgagaacagccuguccggcguggagggggagggccugcacaagcucggguacauccugcgggacaucagcaagauccccggcggcaacauguacgccgacgacaccgccgggugggacacccgcaucaccgaggacgaccugcagaacgaggccaagaucacggacaucauggagccggagcacgcgcuccuggccaaggccaucuucaagcugaccuaccagaacaaggugguccgcgugcagcggcccgccaagaacggcaccgugauggacgucaucucccgccgggaccagcgcgggagcggccaggugggcaccuacgggcucaacacguucaccaacauggaggcccagcugauccggcagauggaguccgagggcaucuucagccccuccgagcuggagacccccaaccucgcggagcgcgcccuggacuggcuggggaaguacggcguggagcggcucaagcgcauggccaucagcggggacgacugcgucgugaagccgaucgacgaccgguucgccaccgcccugacggcgcugaacgacaugggcaaggugcgcaaggacaucccccagugggagcccuccaagggcuggaacgacuggcagcagguccccuucugcagccaccacuuccaccagcucaucaugaaggacgggcgggagaucguggugccgugccgcaaccaggacgagcuggucggccgggcccgcgugucccagggggccggcuggagccugcgggagaccgccugccucggcaagagcuacgcgcagauguggcagcugauguacuuccaccgccgggaccugcgccucgccgccaacgccaucugcuccgccgugcccgucgacugggugcccaccagccggaccacgugguccauccacgcgcaccaccaguggaugaccaccgaggacaugcugagcguguggaaccgcgucuggaucgaggagaaccccuggauggaggacaagacccacaucuccagcugggaggacgugccguaccugggcaagcgcgaggaccaguggugcggcucccucaucgggcugacggcccgggccaccugggccaccaacauccagguggccaucaaccagguccgccggcugaucggcaacgagaacuaccucgacuacaugaucagcaugaagcgcuucaagaacgaguccgaccccgagggggcgcugugguga

SEQ ID NO: 8297 - RNA, 9879 nt, Artificial Sequence
  derived and/or modified CDS sequence (opt1) from DENV-1__EU677160__SS-prME
agcgugaccaugcugcucaugcugaugcccaccgcccuggccuuccaccucacgacccggggcggggagccccacaugaucgugagcaagcaggagcggggcaagagccugcuguucaagaccagcgcgggggugaacaugugcacccucaucgccauggaccugggcgaguucugcgaggacacgaugaccuacaagugcccccgcaucaccgaggccgagcccgacgacguggacugcuggugcaacgccaccgacacgugggugaccuacgggaccugcagccagaccggcgagcaccggcgggacaagcgguccguggcccuggcgccccacgugggccucgggcuggagacgcgcaccgagaccuggaugagcuccgagggcgccuggaagcagauccagcggguggagaccugggcccugcgccaccccggguucacggugaucgcccucuuccuggcgcacgccaucggcaccagcaucacccagaaggggaucaucuucauccugcucgugcuggucacccccuccauggccaugcggugcgugggcaucggcagccgcgacuucguggaggggcuguccggcgccacgugggucgacguggugcucgagcacgggagcugcgucaccaccauggccaaggacaagcccacccuggacaucgagcugcucaagacggaggugaccaaccccgcggugcugcggaagcugugcaucgaggccaagaucuccaacaccaccacggacagccgcugcccgacccagggcgaggccacccucgucgaggagcaggacgccaacuucgugugccggcgcaccuucguggaccggggcugggggaacggcugcgggcuguucggcaaggggucccugaucacgugcgccaaguucaagugcgucaccaagcucgagggcaagaccgugcaguacgagaaccugaaguacagcgugaucgucaccgugcacacgggcgaccagcaccaggucgggaacgaguccaccgagcacggcaccaccgcgaccaucacgccccaggcccccagcaccgagauccagcugaccgacuacggggcccucacccuggacugcagcccccggacgggccuggacuucaacgagauggugcuccugaccaugaaggagaaguccuggcuggugcacaagcagugguuccucgaccugccgcugcccuggaccagcggggccuccaccagccaggagacguggaaccggaaggaccuccuggucaccuucaagaccgcccacgcgaagaagcaggagguggugguccugggcucccaggagggcgccaugcacaccgcccucacgggggccaccgagauccagaccagcggcaccacgaccaucuucgccgggcaccugaagugccgccugaagauggacaagcucacccugaagggcauguccuacgugaugugcaccgggagcuucaagcuggagaaggagguggcggagacgcagcacggcaccguccucgugcagaucaaguacgagggcaccgacgcccccugcaagauccccuucuccacccaggacgagaagggggugacgcagaacggccggcugaucaccgccaacccgaucgucaccgacaaggagaagcccgugaacaucgaggccgagccgcccuucggggagagcuacaucgugaucggcgcgggcgagaaggcccugaagcuguccugguucaagaaggggagcuccaucggcaagauguucgaggccaccgcccgcggggcccggcgcauggcgauccucggcgacacggccugggacuucgggagcaucggcggcgucuucaccuccguggggaagcuggugcaccagaucuucggcaccgccuacgggguccuguucagcggcguguccuggaccaugaagaucgggaucggcgugcuccugacguggcugggccucaacagccgcuccaccagccuguccaugaccugcaucgccgucgggcuggugacccucuaccugggcgugaugguccaggccgacagcgggugcgugaucaacuggaagggccgggagcugaagugcgggagcggcaucuucgugacgaacgagguccacaccuggaccgagcaguacaaguuccaggcggacuccccgaagcgccucagcgccgccaucggcaaggccugggaggagggggugugcggcauccgguccgccacccgccuggagaacaucauguggaagcagaucagcaacgagcugaaccacauccuccuggagaacgacaugaaguucaccguggucgugggggacguggcgggcauccuggcccaggggaagaagaugauccggccccagcccauggaguacaaguacuccuggaaguccuggggcaaggccaagaucaucggcgccgacguccagaacacgaccuucaucaucgacgggcccaacaccccggagugccccgacgaccagcgcgcguggaacaucugggagguggaggacuacggcuucgggaucuucaccacgaacaucuggcucaagcugcgggacuccuacacccaggugugcgaccaccgccugaugagcgccgccaucaaggacuccaaggccguccacgccgacaugggcuacuggaucgagagcgagaagaacgagaccuggaagcucgcgcgggccuccuucaucgaggugaagaccugcaucuggcccaagagccacacgcugugguccaacggcgugcuggagagcgagaugaucauccccaagaucuacgggggcccgaucucccagcacaacuaccgccccggguacuucacccagaccgccggccccuggcaccucgggaagcuggagcuggacuucgaccucugcgagggcaccacggucgugguggacgagcacugcggcaaccgggggccgagccugcgcaccaccaccgucacgggcaagaucauccacgaguggugcugccgguccugcacccugccgccccugcgcuucaagggggaggacggcugcugguacgggauggagauccggcccgugaaggagaaggaggagaaccuggucaagagccuggucagcgccggcuccggcgagguggacagcuucucccucgggcugcugugcaucagcaucaugaucgaggaggugaugcgcucccgguggagccgcaagaugcucaugaccggcacccuggccgucuucuuccugcucaucauggggcagcugacguggaacgaccugauccggcucugcaucauggugggcgcgaacgccuccgaccgcauggggaugggcaccaccuaccuggcccugauggccaccuucaagaugcgcccgauguucgccgugggccuccuguuccggcgccugacgagccgggagguccuccugcugaccaucgggcucucccugguggcgagcgucgagcugcccaacucccucgaggagcugggcgacgggcuggccaugggcaucaugauccucaagcugcugaccgacuuccagagccaccagcucugggccacccugcugucccucacguucaucaagaccaccuucagccugcacuacgccuggaagaccauggcgauggugcuguccaucgugagccucuucccccugugccuguccacgaccagccagaagaccaccuggcuccccguccugcugggcucccucgggugcaagccgcugacgauguuccugaucgccgagaacaagaucuggggccgcaagagcuggccccucaacgaggggaucauggccgugggcaucgugagcauccugcuguccagccuccugaagaacgacgucccccuggccgggccccucaucgccggcggcaugcugaucgcgugcuacgugaucuccgggagcuccgccgaccugagccucgagaaggccgccgagguguccugggaggaggaggccgagcacagcggcgcgucccacaacauccuggucgaggugcaggacgacgggaccaugaagaucaaggacgaggagcgggacgacacccugaccauccuccugaaggccacccugcucgccgugagcggcgucuacccgcuguccauccccgccacgcuguucgugugguacuucuggcagaagaagaagcagcgcagcggggugcucugggacacccccagcccgcccgaggucgagcgggccgugcuggacgacggcaucuaccgcaucaugcagcggggccugcuggggcgcagccaggugggcgucgggguguuccaggagaacguguuccacaccauguggcacgucacccggggcgcggugcucauguaccaggggaagcgccuggagcccuccugggccagcgugaagaaggaccugaucuccuacggcggcggguggcggcuccagggcagcuggaacacgggggaggagguccaggugaucgccguggagcccggcaagaaccccaagaacguccagaccgcccccgggaccuucaagaccuccgagggcgaggugggcgccaucgcgcuggacuucaagcccgggacgagcggcagccccaucgugaaccgcgaggggaagaucgucggccuguacggcaacgggguggugaccaccuccggcaccuacgucagcgccaucgcccaggccaaggcgucccaggaggggccccucccggagaucgaggacgagguguuccggaagcgcaaccugacgaucauggaccugcaccccggcagcgggaagacccggcgcuaccuccccgccaucgugcgggaggccaucaagcgcaagcugcggacccugauccucgccccgacccgcgucguggccuccgagauggcggaggcccugaagggcaugcccauccgcuaccagacgaccgccgucaagagcgagcacaccggcaaggagaucgucgaccugaugugccacgccaccuucacgaugcggcuccugucccccgugcgcgugcccaacuacaacaugaucaucauggacgaggcccacuucaccgacccgagcuccaucgcggcccggggguacaucagcacccgcgucggcaugggggaggccgccgccaucuucaugaccgcgacgccgcccggcuccguggaggccuucccccagagcaacgccgugauccaggacgaggagcgggacaucccggagcgcuccuggaacagcggguacgaguggaucaccgacuuccccggcaagaccgucugguucgugcccuccaucaagagcggcaacgacaucgccaacugccugcggaagaacgggaagcgcgugauccagcucucccggaagaccuucgacacggaguaccagaagaccaagaacaacgacugggacuacgucgugaccaccgacaucagcgagaugggcgcgaacuuccgcgccgaccgggugaucgacccccgccggugccugaagccggucauccugaaggacgggcccgagcgcgugauccucgccggccccaugcccgucacgguggccuccgccgcgcagcggcgcgggcggaucggccgcaaccacaacaaggagggcgaccaguacaucuacauggggcagccgcugaacaacgacgaggaccacgcccacuggaccgaggccaagaugcugcucgacaacaucaacacccccgagggcaucauccccgcccuguucgagcccgagcgggagaaguccgccgcgaucgacggggaguaccgccugcgcggcgaggcccggaagaccuucguggagcucaugcgccgcggggaccugccggucuggcugagcuacaagguggccuccgagggcuuccaguacagcgaccgccgguggugcuucgacggcgagcgcaacaaccaggugcucgaggagaacauggacgucgagaucuggacgaaggagggggagcggaagaagcugcgcccccgguggcuggacgcccgcaccuacuccgacccccucgcccugcgggaguucaaggaguucgcggccggccgccggagcguguccggggaccugauccucgagaucggcaagcugccccagcaccugacccagcgcgcccagaacgcccucgacaaccuggugaugcugcacaacagcgagcagggcgggcgggcguaccgccacgccauggaggagcucccggacaccaucgagacgcugaugcugcucgcccugaucgccguccugaccggcggggugacccucuucuuccuguccggccgggggcugggcaagaccagcaucggccuccugugcgugauggccuccagcguccugcucuggauggcguccguggagccccacuggaucgccgccagcaucauccuggaguucuuccugauggugcuccugauccccgagcccgaccgccagcggaccccgcaggacaaccagcuggccuacgucgugaucgggcuccuguucaugauccugacgguggccgcgaacgagaugggccuccuggagaccaccaagaaggaccuggggaucggccacgucgccguggagaaccaccaccacgccgccaugcucgacguggaccugcaccccgccuccgcguggacccuguacgccgucgccacgaccaucaucacccccaugaugcgccacaccaucgagaacacgaccgccaacaucagccucaccgccaucgcgaaccaggccgccauccugauggggcuggacaagggcuggccgaucuccaagauggacaucggcgugccccuccuggcccuggggugcuacagccaggugaacccccucacccugacggcggccguccugaugcucguggcccacuacgccaucaucggccccgggcugcaggccaaggcgacccgggaggcccagaagcgcaccgccgccggcaucaugaagaacccgaccguggacgggaucgucgccaucgaccuggaccccgugguguacgacgcgaaguucgagaagcagcucggccagaucaugcugcugauccucugcacgucccagauccugcugaugcgcaccaccugggcccucugcgagagcaucacccuggccacgggcccccugaccacccucugggaggggucccccggcaaguucuggaacaccacgaucgccgucagcauggccaacaucuuccgggggagcuaccuggcgggcgccggccuggccuucucccucaugaagucccucgggggcgggcgccgggggaccggggcccagggcgagacccugggcgagaaguggaagcgccagcucaaccagcuguccaagagcgaguucaacaccuacaagcgguccgggaucauggagguggaccgcagcgaggcgaaggagggccugaagcgcggggagacgaccaagcacgccgugucccgcggcaccgccaagcuccggugguucgucgagcgcaaccuggugaagccggaggggaaggugaucgaccugggcugcggccgcggcggguggagcuacuacugcgccgggcugaagaaggucaccgaggugaagggguacacgaagggcggccccggccacgaggagcccauccccauggccaccuacggguggaaccucgugaagcugcacuccggcaaggacgucuucuucaucccgcccgagaagugcgacacccugcucugcgacaucggggagagcucccccaaccccaccaucgaggagggccgcacgcugcgggugcugaagaugguggagccguggcuccgcgggaaccaguucugcaucaagauccugaaccccuacaugcccagcgucguggagacccuggagcagaugcagcggaagcacggcggcaugcucgugcgcaacccccugucccggaacagcacccacgagauguacugggucuccugcgggaccggcaacaucgugagcgcggugaacaugaccucccgcaugcugcucaaccgguucacgauggcccaccgcaagccgaccuacgagcgcgacgucgaccugggggccggcacccggcacguggccguggagcccgaggucgccaaccuggacaucaucggccagcgcaucgagaacaucaagcacgagcacaagagcaccuggcacuacgacgaggacaaccccuacaagacgugggcguaccacggguccuacgaggugaagcccagcggcagcgccuccagcauggucaacgggguggugaagcuccugaccaagccgugggacgucauccccauggugacccagaucgccaugaccgacacgacccccuucggccagcagcggguguucaaggagaaggucgacacccgcacccccaaggccaagcgggggacggcccagaucauggaggugaccgcgaaguggcuguggggcuuccucucccgcaacaagaagccgcggaucugcacccgcgaggaguucacccggaaggugcgcagcaacgccgccaucggcgccgucuucguggacgagaaccaguggaacuccgcgaaggaggccguggaggacgagcgguucugggaccugguccaccgcgagcgggagcugcacaagcaggggaagugcgccacgugcguguacaacaugaugggcaagcgcgagaagaagcucggggaguucggcaaggccaaggggagccgggccaucugguacauguggcugggcgcgcgcuuccuggaguucgaggcccucggcuucaugaacgaggaccacugguucucccgggagaacagccuguccgggguggagggcgaggggcugcacaagcucggcuacauccugcgcgacaucagcaagauccccgggggcaacauguacgccgacgacaccgccggcugggacacccggaucaccgaggacgaccugcagaacgaggccaagaucacggacaucauggagcccgagcacgcgcuccuggccaaguccaucuucaagcugaccuaccagaacaaggucgugcgcgugcagcggccggccaagaacgggaccgucauggacgugaucagccgccgcgaccagcggggcuccggccaggugggcaccuacggccucaacacguucaccaacauggaggcccagcugauccgccagauggagagcgaggggaucuucucccccagcgagcuggagacccccaaccucgcccggcgcguccuggacuggcuggagaagcacggcguggagcggcucaagcgcauggcgaucuccggggacgacugcguggucaagcccaucgacgaccgguucgccaccgcccugacggcccugaacgacaugggcaaggugcgcaaggacaucccgcagugggagcccagcaagggguggaacgacuggcagcagguccccuucugcagccaccacuuccaccagcucaucaugaaggacggccgggagaucgucgugcccugccgcaaccaggacgagcuggugggccgggcccgcgucucccagggggcgggcuggagccugcgggagaccgccugccucgggaaguccuacgcccagauguggcagcugauguacuuccaccgccgggaccugcgccucgccgcgaacgccaucugcagcgccgugccgguggacuggguccccaccucccggaccacguggagcauccacgcccaccaccaguggaugaccaccgaggacaugcuguccguguggaaccgcguguggaucgaggagaaccccuggauggaggacaagacccacaucagcuccuggggcgacguccccuaccuggggaagcgggaggaccaguggugcggcagccucaucggccugacggcccgcgcgaccugggccaccaacauccagguggccaucaaccaggugcgccggcugaucgggaacgagaacuaccucgacuacaugaccuccaugaagcgcuucaagaacgagagcgacccggagggcgcccugugguga

SEQ ID NO: 8298 - RNA, 9879 nt, Artificial Sequence
  derived and/or modified CDS sequence (opt1) from DENV-1__EU677162__SS-prME
agcgugaccaugcugcucaugcugaugcccaccgcccuggccuuccaccucacgacccggggcggggagccccacaugaucgugagcaagcaggagcggggcaagagccugcuguucaagaccagcgccggggugaacaugugcacccucaucgccauggaccugggggaguucugcgaggacaccaugaccuacaagugcccccgcaucaccgaggccgagcccgacgacguggacugcuggugcaacgccaccgacacgugggugaccuacgggaccugcagccagaccggggagcaccggcgcgacaagcgguccguggcccuggcgccccacgugggccucgggcuggagacgcgcaccgagaccuggaugagcuccgagggcgccuggaagcagauccagcggguggagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugcccgacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaagaucguccaguacgagaaccugaaguacagcgugaucgugaccguccacaccggcgaccagcaccagguggggaacgaguccacggagcacggcaccaccgcgaccaucacgccccaggcccccagcacggagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccagcggggccuccaccagccaggagaccuggaaccggaaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcauguccuacgucaugugcaccgggagcuucaagcuggagaaggagguggcggagacccagcacggcacggugcucguccagaucaaguacgagggcaccgacgcccccugcaagauccccuucuccacccaggacgagaagggggugacccagaacggccggcugaucacggccaacccgaucgugaccgacaaggagaagcccgucaacaucgaggccgagccgcccuucggggagagcuacaucgugaucggcgcgggcgagaaggcccugaagcuguccugguucaagaaggggagcuccaucggccgcauguucgaggccaccgcccgcggggcccgccgcauggcgauccucggcgacaccgccugggacuucgggagcaucggcggcguguucacguccgucgggaagcuggugcaccagaucuucggcaccgccuacggggugcuguucagcggcgucuccuggaccaugaagaucgggaucggcgugcuccugaccuggcugggccucaacagccgguccacgagccuguccaugaccugcaucgccguggggcuggucacccucuaccugggcgugauggugcaggccgacagcgggugcgucaucaacuggaagggccgcgagcugaagugcgggagcggcaucuucgugaccaacgaggugcacacguggaccgagcaguacaaguuccaggcggacuccccgaagcggcucagcgccgccaucggcaaggccugggaggagggggucugcggcauccgcuccgccacccggcuggagaacaucauguggaagcagaucagcaacgagcugaaccacauccuccuggagaacgacaugaaguucaccgugguggucggggacguggcgggcauccuggcccaggggaagaagaugauccgcccccagcccauggaguacaaguacuccuggaaguccuggggcaaggccaagaucaucggcgccgacgugcagaacaccacguucaucaucgacgggcccaacaccccggagugccccgacgaccagcgggcguggaacaucugggaggucgaggacuacggcuucgggaucuucaccaccaacaucuggcucaagcugcgcgacuccuacacccaggugugcgaccaccggcugaugagcgccgccaucaaggacuccaaggccgugcacgccgacaugggcuacuggaucgagagcgagaagaacgagaccuggaagcucgcgcgcgccuccuucaucgaggucaagaccugcaucuggcccaagagccacacccugugguccaacggcgugcuggagagcgagaugaucauccccaagaucuacgggggcccgaucucccagcacaacuaccggcccggguacuucacgcagaccgccggccccuggcaccucgggaagcuggagcuggacuucgaccucugcgagggcaccaccguggucguggacgagcacugcggcaaccgcgggccgagccugcggacgaccaccgugaccggcaagaucauccacgaguggugcugccgcuccugcacgcugccgccccugcgguucaagggggaggacggcugcugguacgggauggagauccgccccgucaaggagaaggaggagaaccuggucaagagcauggugagcgccggcuccggcgaggucgacagcuucucccuggggcuccugugcaucagcaucaugaucgaggaggugaugcggucccgcuggagccggaagaugcugaugaccggcacccucgccguguucuuccugcugaucauggggcagcucaccuggaacgaccugauccgccugugcaucauggucggcgcgaacgccuccgaccgcauggggaugggcacgaccuaccucgcccugauggccaccuucaagaugcggccgauguucgccgugggccuccuguuccgccggcugaccagccgcgaggugcugcuccugacgaucgggcugucccucgucgcgagcguggagcugcccaacucccuggaggagcucggcgacgggcuggccaugggcaucaugauccugaagcuccugaccgacuuccagagccaccagcugugggccacccuccugucccugaccuucaucaagacgaccuucagccuccacuacgccuggaagaccauggcgaugguccuguccaucgugagccuguucccccucugccuguccaccacgagccagaagaccaccuggcugcccgugcuccugggcucccuggggugcaagccgcucaccauguuccugaucgccgagaacaagaucuggggccgcaagagcuggccccugaacgaggggaucauggccgucggcaucgugagcauccuccuguccagccugcucaagaacgacgugccccuggccgggccccugaucgccggcggcaugcucaucgcgugcuacgucaucuccgggagcuccgccgaccugagccuggagaaggccgccgagguguccugggaggaggaggccgagcacagcggcgcgucccacaacauccucguggagguccaggacgacgggacgaugaagaucaaggacgaggagcgcgacgacacccugaccauccugcucaaggccacccugcuggccgugagcggcguguacccgcucuccauccccgccacccuguucgucugguacuucuggcagaagaagaagcagcggagcggggugcugugggacacgcccagcccgcccgagguggagcgcgccguccucgacgacggcaucuaccggaucaugcagcgcggccugcuggggcggagccaggugggcgugggggucuuccaggagaacguguuccacaccauguggcacgugacccgcggcgcgguccugauguaccaggggaagcggcucgagcccuccugggccagcgugaagaaggaccugaucuccuacggcggcggguggcgccugcagggcagcuggaacaccggggaggaggugcaggucaucgccguggagcccggcaagaaccccaagaacgugcagacggcccccgggaccuucaagaccuccgagggcgaggucggcgccaucgcgcucgacuucaagcccgggaccagcggcagccccaucgugaaccgggaggggaagaucgugggccuguacggcaacggggucgugacgaccuccggcaccuacgugagcgccaucgcccaggccaaggcgucccaggaggggccccugccggagaucgaggacgaggucuuccgcaagcggaaccucaccaucauggaccugcaccccggcagcgggaagacgcgccgguaccugcccgccaucgugcgcgaggccaucaagcggaagcuccgcacccugauccuggccccgacccgcguggucgccuccgagauggcggaggcccucaagggcaugcccauccgguaccagaccacggccgucaagagcgagcacaccggcaaggagaucguggaccugaugugccacgccaccuucaccaugcgccugcucucccccguccgggugcccaacuacaacaugaucaucauggacgaggcccacuucacggacccgagcuccaucgcggcccgcggguacaucagcacccgggugggcaugggggaggccgccgccaucuucaugaccgcgacgccgcccggcuccgucgaggccuucccccagagcaacgccgugauccaggacgaggagcgcgacaucccggagcgguccuggaacagcggguacgaguggaucacggacuuccccggcaagaccgugugguucguccccuccaucaagagcggcaacgacaucgccaacugccugcgcaagaacgggaagcgggugauccagcugucccgcaagaccuucgacaccgaguaccagaagacgaagaacaacgacugggacuacguggucaccaccgacaucagcgagaugggcgcgaacuuccgggccgaccgcgugaucgacccccggcgcugccucaagccggugauccugaaggacgggcccgagcgggucauccuggccggccccaugcccgugaccgucgccuccgccgcgcagcgccgggggcgcaucggccggaaccacaacaaggagggcgaccaguacaucuacauggggcagccgcucaacaacgacgaggaccacgcccacuggacggaggccaagaugcugcuggacaacaucaacacccccgagggcaucauccccgcccucuucgagcccgagcgcgagaaguccgccgcgaucgacggggaguaccgccugcggggcgaggcccgcaagaccuucguggagcugaugcggcgcggggaccucccgguguggcugagcuacaaggucgccuccgagggcuuccaguacagcgaccggcgcuggugcuucgacggcgagcggaacaaccaggugcuggaggagaacauggacguggagaucuggaccaaggagggggagcgcaagaagcuccggccccgcuggcuggacgcccggacguacuccgacccccuggcccuccgcgaguucaaggaguucgcggccggccggcgcagcgucuccggggaccugauccuggagaucggcaagcucccccagcaccugacccagcgggcccagaacgcccuggacaaccucgugaugcugcacaacagcgagcagggcgggcgcgcguaccggcacgccauggaggagcugccggacaccaucgagacccucaugcugcuggcccucaucgccgugcugacgggcggggucacccuguucuuccucuccggccgcgggcugggcaagaccagcaucggccugcucugcgugauggccuccagcgugcugcuguggauggcguccgucgagccccacuggaucgccgccagcaucauccucgaguucuuccugauggugcugcucauccccgagcccgaccggcagcgcaccccgcaggacaaccagcuggccuacguggucaucgggcuccucuucaugauccugaccguggccgcgaacgagaugggccugcucgagacgaccaagaaggaccuggggaucggccacguggccgucgagaaccaccaccacgccgccaugcuggacguggaccuccaccccgccuccgcguggacccuguacgccguggccaccacgaucaucacccccaugaugcggcacaccaucgagaacaccacggccaacaucagccugaccgccaucgcgaaccaggccgccauccucauggggcuggacaagggcuggccgaucuccaagauggacaucggcgucccccugcucgcccuggggugcuacagccaggugaacccccugacccucaccgcggccgugcugaugcuggucgcccacuacgccaucaucggccccgggcuccaggccaaggcgacgcgcgaggcccagaagcgcaccgccgccggcaucaugaagaacccgaccguggacgggaucguggccaucgaccuggaccccgucguguacgacgcgaaguucgagaagcagcugggccagaucaugcuccugauccugugcaccucccagauccuccugaugcggacgaccugggcccugugcgagagcaucacccucgccaccggcccccugacgacccugugggaggggucccccggcaaguucuggaacaccaccaucgccgugagcauggccaacaucuuccgcgggagcuaccucgcgggcgccggccuggccuucucccugaugaagucccucgggggcgggcggcgcggcacgggggcccagggcgagacccugggcgagaaguggaagcggcagcugaaccagcucuccaagagcgaguucaacaccuacaagcgcuccgggaucauggaggucgaccggagcgaggcgaaggagggccugaagcgcggggagaccacgaagcacgccgugucccggggcaccgccaagcugcgcugguucguggagcggaaccucgucaagccggaggggaaggugaucgaccugggcugcggccgcgggggcuggagcuacuacugcgccgggcugaagaaggugaccgaggucaagggcuacaccaagggcgggcccggccacgaggagcccauccccauggccacguacggguggaaccuggugaagcuccacuccggcaaggacguguucuucaucccgcccgagaagugcgacacccugcugugcgacaucggggagagcucccccaaccccaccaucgaggagggccggacccuccgcguccugaagaugguggagccguggcugcgggggaaccaguucugcaucaagauccucaaccccuacaugcccagcguggucgagacgcuggagcagaugcagcgcaagcacggcggcaugcuggugcggaacccccucucccgcaacagcacccacgagauguacuggguguccugcgggaccggcaacaucgucagcgcggugaacaugaccucccggaugcugcugaaccgcuucaccauggcccaccgcaagccgacguacgagcgggacguggaccucggggccggcacccgccacgucgccguggagcccgagguggccaaccuggacaucaucggccagcggaucgagaacaucaagcacgagcacaagagcaccuggcacuacgacgaggacaaccccuacaagaccugggcguaccacggguccuacgaggucaagcccagcggcagcgccuccagcauggugaacggggucgugaagcugcucacgaagccgugggacgugauccccauggucacccagaucgccaugaccgacaccacgcccuucggccagcagcgcguguucaaggagaagguggacacccggacccccaaggccaagcgcgggaccgcccagaucauggaggucacggcgaaguggcuguggggcuuccugucccggaacaagaagccgcgcaucugcacccgggaggaguucacccgcaaggugcggagcaacgccgccaucggcgccguguucgucgacgagaaccaguggaacuccgcgaaggaggccguggaggacgagcgcuucugggaccucgugcaccgggagcgcgagcugcacaagcaggggaagugcgcgaccugcgucuacaacaugaugggcaagcgggagaagaagcugggggaguucggcaaggccaaggggagccgcgccaucugguacauguggcucggcgcgcgguuccuggaguucgaggcccugggcuucaugaacgaggaccacugguucucccgcgagaacagccucuccgggguggagggcgaggggcugcacaagcugggcuacauccuccgggacaucagcaagauccccgggggcaacauguacgccgacgacacggccggcugggacacccgcaucaccgaggacgaccugcagaacgaggccaagaucaccgacaucauggagcccgagcacgcgcugcucgccaaguccaucuucaagcugacguaccagaacaaggugguccgggugcagcgcccggccaagaacgggaccgugauggacgucaucagccgccgggaccagcgcggcuccggccaggugggcaccuacggccugaacaccuucacgaacauggaggcccagcucauccggcagauggagagcgaggggaucuucucccccagcgagcuggagacccccaaccuggccggccgcgugcucgacuggcuggagaagcacggggucgagcggcugaagcgcauggcgaucuccggcgacgacugcguggugaagcccaucgacgaccgguucgccaccgcccucaccgcccugaacgacauggggaagguccgcaaggacaucccgcagugggagcccagcaagggcuggaacgacuggcagcagguccccuucugcagccaccacuuccaccagcugaucaugaaggacggccgggagaucgugguccccugccgcaaccaggacgagcucguggggcgggcccgcgugucccagggcgcgggguggagccugcgggagacggccugccugggcaaguccuacgcccagauguggcagcucauguacuuccaccgccgggaccugcgccuggccgcgaacgccaucugcagcgccgucccgguggacugggugcccaccucccggaccaccuggagcauccacgcccaccaccaguggaugacgaccgaggacaugcucuccgucuggaaccgcguguggaucgaggagaaccccuggauggaggacaagacccacaucagcuccuggggcgacgugcccuaccugggcaagcgggaggaccaguggugcggcagccugaucgggcucaccgcccgcgcgacgugggccaccaacauccaggucgccaucaaccaggugcgccggcugaucggcaacgagaacuaccuggacuacaugaccuccaugaagcgcuucaagaacgagagcgacccggagggggcccucugguga

SEQ ID NO: 8299 - RNA, 9879 nt, Artificial Sequence
  derived and/or modified CDS sequence (opt1) from DENV-1__EU677164__SS-prME
agcgugaccaugcugcucaugcugaugcccaccgcccuggccuuccaccucacgacccggggcggggagccccacaugaucgugagcaagcaggagcggggcaagagccugcuguucaagaccagcgccggggugaacaugugcacccucaucgccauggaccugggcgaguucugcgaggacaccaugaccuacaagugcccccgcaucaccgaggccgagcccgacgacguggacugcuggugcaacgccaccgacacgugggugaccuacgggaccugcagccagaccggcgagcaccggcgggacaagcgguccguggcccuggcgccccacgugggccucgggcuggagacgcgcaccgagaccuggaugagcuccgagggcgccuggaagcagauccagcggguggagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugcccgacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaagaccguccaguacgagaaccugaaguacagcgugaucgugaccguccacacgggcgaccagcaccagguggggaacgaguccaccgagcacggcaccaccgcgaccaucacgccccaggcccccagcaccgagauccagcugaccgacuacggggcccucacccuggacugcagcccccggacgggccuggacuucaacgagaugguccuccugaccaugaaggagaaguccuggcuggugcacaagcagugguuccucgaccugccgcugcccuggaccagcggggccuccaccagccaggagacguggaaccggaaggaccuccuggugaccuucaagaccgcccacgcgaagaagcaggaggucguggugcugggcucccaggagggcgccaugcacaccgcccucacgggggccaccgagauccagaccagcggcaccacgaccaucuucgccgggcaccugaagugccgccugaagauggacaagcucacccugaagggcauguccuacgucaugugcaccgggagcuucaagcuggagaaggagguggcggagacgcagcacggcaccgugcucguccagaucaaguacgagggcaccgacgcccccugcaagauccccuucuccacccaggacgagaagggggugacgcagaacggccggcugaucaccgccaacccgaucgugaccgacaaggagaagcccgucaacaucgaggccgagccgcccuucggggagagcuacaucgugaucggcgcgggcgagaaggcccugaagcuguccugguucaagaaggggagcuccaucggcaagauguucgaggccaccgcccgcggggcccggcgcaucgcgauccucggcgacacggccugggacuucgggagcaucggcggcguguucaccuccgucgggaagcuggugcaccagaucuucggcaccgccuacggggugcuguucagcggcgucuccuggaccaugaagaucgggaucggcgugcuccugacguggcugggccucaacagccgcuccaccagccuguccaugaccugcaucgccguggggcuggucacccucuaccugggcgugauggugcaggccgacagcgggugcgucaucaacuggaagggccgggagcugaagugcgggagcggcaucuucgugacgaacgaggugcacaccuggaccgagcaguacaaguuccaggcggacuccccgaagcgccucagcgccgccaucggcaaggccugggaggagggggucugcggcauccgguccgccacccgccuggagaacaucauguggaagcagaucagcaacgagcugaaccacauccuccuggagaacgacaugaaguucaccgugguggucggggacguggcgggcauccuggcccaggggaagaagaugauccggccccagcccauggaguacaaguacuccuggaaguccuggggcaaggccaagaucaucggcgccgacgugcagaacacgaccuucaucaucgacgggcccaacaccccggagugccccgacgaccagcgcgcguggaacaucugggaggucgaggacuacggcuucgggaucuucaccacgaacaucuggcucaagcugcgggacuccuacacccaggugugcgaccaccgccugaugagcgccgccaucaaggacuccaaggccgugcacgccgacaugggcuacuggaucgagagcgagaagaacgagaccuggaagcucgcgcgggccuccuucaucgaggucaagaccugcaucuggcccaagagccacacgcugugguccaacggcgugcuggagagcgagaugaucauccccaagaacuacgggggcccgaucucccagcacaacuaccgccccggguacuucacccagaccgccggccccuggcaccucgggaagcuggagcuggacuucgaccucugcgagggcaccacgguggucguggacgagcacugcggcaaccgggggccgagccugcgcaccaccaccgugacgggcaagaucauccacgaguggugcugccgguccugcacccugccgccccugcgcuucaagggggaggacggcugcugguacgggauggagauccggcccgucaaggagaaggaggagaaccuggucaagagcauggugagcgccggcuccggcgaggucgacagcuucucccuggggcuccugugcaucagcaucaugaucgaggaggugaugcgcucccgguggagccgcaagaugcugaugaccggcacccucgccgugcuguuccugcucaucauggggcagcugacguggaacgaccugauccggcucugcaucauggucggcgcgaacgccuccgaccgcauggggaugggcaccaccuaccuggcccugauggccaccuucaagaugcgcccgauguucgccgugggccuccuguuccggcgccugacgagccgggaggugcuccugcugaccaucgggcucucccuggucgcgagcguggagcugcccaacucccucgaggagcugggcgacgggcuggccaugggcaucaugauccucaagcugcugaccgacuuccagagccaccagcucugggccacccugcugucccucacguucaucaagaccaccuucagccugcacuacgccuggaagaccauggcgaugguccuguccaucgugagccucuucccccugugccuguccacgaccagccagaagaccaccuggcuccccgugcugcugggcucccucgggugcaagccgcugacgauguuccugaucgccgagaacaagaucuggggccgcaagagcuggccccucaacgaggggaucauggccgucggcaucgugagcauccugcuguccagccuccugaagaacgacgugccccuggccgggccccucaucgccggcggcaugcugaucgcgugcuacgucaucuccgggagcuccgccgaccugagccucgagaaggccgccgagguguccugggaggaggaggccgagcacagcggcgcgucccacaacauccugguggagguccaggacgacgggaccaugaagaucaaggacgaggagcgggacgacacccugaccacccuccugaaggccacgcugcucgccgugagcggcguguacccgcuguccauccccgccacccuguucgucugguacuucuggcagaagaagaagcagcgcagcggggugcucugggacacccccagcccgcccgagguggagcgggccguccuggacgacggcaucuaccgcaucaugcagcggggccugcuggggcgcagccaggugggcgugggggucuuccaggagaacguguuccacaccauguggcacgugacgcggggcgcgguccucauguaccaggggaagcgccuggagcccuccugggccagcgugaagaaggaccugaucuccuacggcggcggguggcggcuccagggcagcuggaacaccggggaggaggugcaggucaucgccguggagcccggcaagaaccccaagaacgugcagaccgcccccgggaccuucaagacguccgagggcgaggucggcgccaucgcgcuggacuucaagcccgggaccagcggcagccccaucgugaaccgcgaggggaagaucgugggccuguacggcaacggggucgugaccaccuccggcacguacgugagcgccaucgcccaggccaaggcgucccaggaggggccccucccggagaucgaggacgaggucuuccggaagcgcaaccugaccaucauggaccugcaccccggcagcgggaagacccggcgcuaccuccccgccaucgugcgggaggccaucaagcgcaagcugcggacccugauccucgccccgacgcgcguggucgccuccgagauggcggaggcccugaagggcaugcccauccgcuaccagaccaccgccgucaagagcgagcacaccggcaaggagaucguggaccugaugugccacgccacguucaccaugcggcuccugucccccguccgcgugcccaacuacaacaugaucaucauggacgaggcccacuucaccgacccgagcuccaucgcggcccggggguacaucagcacccgcgugggcaugggggaggccgccgccaucuucaugacggcgacgccgcccggcuccgucgaggccuucccccagagcaacgccgugauccaggacgaggagcgggacaucccggagcgcuccuggaacagcggguacgaguggaucaccgacuuccccggcaagaccgugugguucguccccuccaucaagagcggcaacgacaucgccaacugccugcggaagaacgggaagcgcgugauccagcucucccggaagacguucgacaccgaguaccagaagaccaagaacaacgacugggacuacguggucaccacggacaucagcgagaugggcgcgaacuuccgcgccgaccgggugaucgacccccgccggugccugaagccggugauccugaaggacgggcccgagcgcgucauccucgccggccccaugcccgugaccgucgccuccgccgcgcagcggcgcgggcggaucggccgcaaccacaacaaggagggcgaccaguacaucuacauggggcagccgcugaacaacgacgaggaccacgcccacuggaccgaggccaagaugcugcucgacaacaucaacacccccgagggcaucauccccgcccuguucgagcccgagcgggagaaguccgccgcgaucgacggggaguaccgccugcgcggcgaggcccggaagacguucguggagcucaugcgccgcggggaccugccgguguggcugagcuacaaggucgccuccgagggcuuccaguacagcgaccgccgguggugcuucgacggcgagcgcaacaaccaggugcucgaggagaacauggacguggagaucuggaccaaggagggggagcggaagaagcugcgcccccgguggcuggacgcccgcaccuacuccgacccccucgcccugcgggaguucaaggaguucgcggccggccgccggagcgucuccggggaccugauccucgagaucggcaagcugccccagcaccugacccagcgcgcccagaacgcccucgacaaccuggugaugcugcacaacagcgagcagggcgggcgggcguaccgccacgccauggaggagcucccggacacgaucgagacccugaugcugcucgcccugaucgccgugcugaccggcggggucacccucuucuuccuguccggccgggggcugggcaagaccagcaucggccuccugugcgugauggccuccagcgugcugcucuggauggcguccgucgagccccacuggaucgccgccagcaucauccuggaguucuuccugauggugcuccugauccccgagcccgaccgccagcggacgccgcaggacaaccagcuggccuacguggucaucgggcuccuguucaugauccugaccguggccgcgaacgagaugggccuccuggagaccaccaagaaggaccuggggaucggccacguggccgucgagaaccaccaccacgccgccaugcucgacguggaccugcaccccgccuccgcguggacgcuguacgccguggccaccaccaucaucacccccaugaugcgccacacgaucgagaacaccaccgccaacaucagccucaccgccaucgcgaaccaggccgccauccugauggggcuggacaagggcuggccgaucuccaagauggacaucggcgucccccuccuggcccuggggugcuacagccaggugaacccccucacgcugaccgcggccgugcugaugcucgucgcccacuacgccaucaucggccccgggcugcaggccaaggcgacccgggaggcccagaagcgcaccgccgccggcaucaugaagaacccgacgguggacgggaucguggccaucgaccuggaccccgucguguacgacgcgaaguucgagaagcagcucggccagaucaugcugcugauccucugcaccucccagauccugcugaugcgcaccaccugggcccucugcgagagcaucacgcuggccaccggcccccugaccacccucugggaggggucccccggcaaguucuggaacacgaccaucgccgugagcauggccaacaucuuccgggggagcuaccuggcgggcgccggccuggccuucucccucaugaagucccucgggggcgggcgccgggggaccggggcccagggcgagacccugggcgagaaguggaagcgccagcucaaccagcuguccaagagcgaguucaacacguacaagcgguccgggaucauggaggucgaccgcagcgaggcgaaggagggccugaagcgcggggagaccaccaagcacgccgugucccgcggcaccgccaagcuccggugguucguggagcgcaaccuggucaagccggaggggaaggugaucgaccugggcugcggccgcggcggguggagcuacuacugcgccgggcugaagaaggugacggaggucaagggguacaccaagggcgggcccggccacgaggagcccauccccauggccaccuacggguggaaccucgugaagcugcacuccggcaaggacguguucuucaucccgcccgagaagugcgacacccugcucugcgacaucggggagagcucccccaaccccacgaucgaggagggccgcacccugcggguccugaagaugguggagccguggcuccgcgggaaccaguucugcaucaagauccugaaccccuacaugcccagcguggucgagacccuggagcagaugcagcggaagcacggcggcaugcucgugcgcaacccccugucccggaacagcacccacgagauguacuggguguccugcgggaccggcaacaucgucagcgcggugaacaugacgucccgcaugcugcucaaccgguucaccauggcccaccgcaagccgaccuacgagcgcgacguggaccugggggccggcacccggcacgucgccguggagcccgagguggccaaccuggacaucaucggccagcgcaucgagaacaucaagcacgagcacaagagcacguggcacuacgacgaggacaaccccuacaagaccugggcguaccacggguccuacgaggucaagcccagcggcagcgccuccagcauggugaacggggucgugaagcuccugaccaagccgugggacgugauccccauggucacccagaucgccaugacggacaccacccccuucggccagcagcggguguucaaggagaagguggacacccgcacgcccaaggccaagcgggggaccgcccagaucauggaggucaccgcgaaguggcuguggggcuuccucucccgcaacaagaagccgcggaucugcacccgcgaggaguucacgcggaaggugcgcagcaacgccgccaucggcgccguguucgucgacgagaaccaguggaacuccgcgaaggaggccguggaggacgagcgguucugggaccuggugcaccgcgagcgggagcugcacaagcaggggaagugcgcgaccugcgucuacaacaugaugggcaagcgcgagaagaagcucggggaguucggcaaggccaaggggagccgggccaucugguacauguggcugggcgcgcgcuuccuggaguucgaggcccucggcuucaugaacgaggaccacugguucucccgggagaacagccuguccgggguggagggcgaggggcugcacaagcucggcuacauccugcgcgacaucagcaagauccccgggggcaacauguacgccgacgacaccgccggcugggacacccggaucacggaggacgaccugcagaacgaggccaagaucaccgacaucauggagcccgagcacgcgcuccuggccaaguccaucuucaagcugaccuaccagaacaaggugguccgcgugcagcggccggccaagaacgggaccgugauggacgucaucagccgccgcgaccagcggggcuccggccaggugggcacguacggccucaacaccuucaccaacauggaggcccagcugauccgccagauggagagcgaggggaucuucucccccagcgagcuggagacccccaaccucgccggccgggugcuggacuggcuggagaagcacggggucgagcgccucaagcggauggcgaucuccggcgacgacugcguggugaagcccaucgacgaccgcuucgccacggcccugaccgcccugaacgacauggggaagguccggaaggacaucccgcagugggagcccagcaagggcuggaacgacuggcagcagguccccuucugcagccaccacuuccaccagcucaucaugaaggacggccgcgagaucgugguccccugccggaaccaggacgagcugguggggcgcgcccgggugucccagggcgcgggguggagccugcgcgagaccgccugccucggcaaguccuacgcccagauguggcagcugauguacuuccaccggcgcgaccugcggcucgccgcgaacgccaucugcagcgccgucccgguggacugggugcccaccucccgcacgaccuggagcauccacgcccaccaccaguggaugaccaccgaggacaugcuguccgucuggaaccggguguggaucgaggagaaccccuggauggaggacaagacgcacaucagcuccuggggcgacgugcccuaccugggcaagcgcgaggaccaguggugcggcagccucaucgggcugaccgcccgggcgaccugggccaccaacauccaggucgccaucaaccaggugcgccgccugaucggcaacgagaacuaccucgacuacaugaccuccaugaagcgguucaagaacgagagcgacccggagggggcccugugguga

SEQ ID NO: 8300 - RNA, 9879 nt, Artificial Sequence
  derived and/or modified CDS sequence (opt1) from DENV-1__EU677165__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaucaccuacaagugcccccgcaucaccgagaccgagcccgacgacguggacugcuggugcaacgccacggacaccugggucaccuacgggaccugcagccagacgggcgagcaccggcgcgacaagcgguccguggcccucgcgccccacgugggccuggggcuggagacccgcaccgagaccuggaugagcuccgagggcgccuggaagcagauccagcgggucgagacgugggcccuccgccaccccggguucaccgugaucgcccuguuccuggcccacgcgaucggcaccagcaucacccagaaggggaucaucuucauccuccugaugcuggccacgcccuccauggccaugcggugcgugggcaucggcagccgcgacuucgucgaggggcucuccggcgccaccuggguggacgugguccuggagcacgggagcugcgugaccaccauggccaaggacaagcccacgcuggacaucgagcuccugaagaccgaggugaccaaccccgcgguccugcggaagcucugcaucgaggccaagaucuccaacaccacgaccgacagccgcugcccgacccagggcgaggccacccugguggaggagcaggacgccaacuucgugugccggcgcacguucgucgaccggggcugggggaacggcugcgggcuguucggcaaggggucccucaucacgugcgccaaguucaagugcgugaccaagcuggagggcaagaucgugcaguacgagaaccugaaguacagcgucaucgugaccgugcacacgggcgaccagcaccaggucgggaacgaguccaccgagcacggcaccaccgcgaccaucacgccccaggcccccaccaccgagauccagcucaccgacuacggggcccugacgcuggacugcagcccccgcaccggccucgacuucaacgagauggugcugcugaccaugaaggagaaguccuggcucguccacaagcagugguuccuggaccugccccuccccuggaccagcggggccagcacgucccaggagaccuggaaccggcaggaccugcuggugaccuucaagaccgcccacgcgaagaagcaggagguggucgugcucggcagccaggagggcgccaugcacacggcccugaccggggccaccgagauccagaccuccggcacgaccaccaucuucgccgggcaccugaagugccgccucaagauggacaagcugacccugcggggcaugagcuacgugaugugcacgggguccuucaagcucgagaaggaggucgcggagacccagcacggcaccgugcuggugcagaucaaguacgagggcaccgacgcccccugcaagauccccuucagcacgcaggacgagaagggggucacccagaacggccgccugaucaccgccaacccgaucgugaccgacaaggagaagcccgugaacaucgaggccgagccgcccuucggggaguccuacaucgucaucggcgcgggcgagaaggcccugaagcucagcugguucaagaagggguccagcaucggcaagauguucgaggccacggcccgcggggcccgccgcauggcgauccugggcgacaccgccugggacuucggguccaucggcggcguguucaccagcguggggaagcugguccaccagaucuucggcaccgccuacggggugcuguucuccggcgugagcuggacgaugaagaucgggaucggcguccugcugaccuggcucggccugaacucccggagcaccucccugagcaugaccugcaucgccguggggcucgugacgcuguaccugggcgucauggugcaggccgacuccgggugcgugaucaacuggaagggccgcgagcucaagugcgggagcggcaucuucgucaccaacgaggugcacaccuggaccgagcaguacaaguuccaggcggacagcccgaagcggcuguccgccgccaucggcaaggccugggaggagggggugugcggcauccgcagcgccacccggcuggagaacaucauguggaagcagaucuccaacgagcucaaccacauccugcuggagaacgacaugaaguucacggucguggugggggacgucgcgggcauccucgcccaggggaagaagaugauccgcccccagcccauggagcacaaguacagcuggaaguccuggggcaaggccaagaucaucggcgccgacgugcagaacaccaccuucaucaucgacgggcccaacaccccggagugccccgacgaccagcgggcguggaacaucugggagguggaggacuacggcuucgggaucuucacgaccaacaucuggcugaagcugcgcgacagcuacacccaggucugcgaccaccggcucauguccgccgccaucaaggacagcaaggccgugcacgccgacaugggcuacuggaucgaguccgagaagaacgagaccuggaagcuggcgcgcgccagcuucaucgaggugaagacgugcaucuggcccaagucccacacccuguggagcaacggcguccucgaguccgagaugaucauccccaagaucuacgggggcccgaucagccagcacaacuaccggcccggguacuucacccagaccgccggccccuggcaccuggggaagcuggagcucgacuucgaccugugcgagggcacgaccgugguggucgacgagcacugcggcaaccgcgggccgucccugcggaccaccacggugaccggcaagaucauccacgaguggugcugccgcagcugcacccugccgccccuccgguuccgcggggaggacggcugcugguacgggauggagauccggcccgugaaggagaaggaggagaaccuggucaaguccauggugagcgccggcagcggcgagguggacuccuucagccucgggcugcugugcaucuccaucaugaucgaggaggucaugcgcagccgguggucccgcaagaugcucaugaccggcacgcuggccguguucuuccugcucaucauggggcagcugaccuggaacgaccugauccgccucugcaucauggugggcgcgaacgccagcgaccggauggggaugggcaccaccuaccuggcccugauggccacguucaagaugcgcccgauguucgccgucggccuccuguuccggcgccugaccucccgggaggugcuccugcugaccaucgggcucagccugguggcguccgucgagcugcccaacagccucgaggagcugggcgacgggcuggccaugggcaucaugauccucaagcugcugaccgacuuccagucccaccagcucugggccacgcugcugagccucaccuucaucaagaccaccuucucccugcacuacgccuggaagacgauggcgauggugcugagcaucgucucccucuucccccugugccugagcaccaccucccagaagaccacguggcuccccgugcugcugggcagccucgggugcaagccgcugaccauguuccugaucgccgagaacaagaucuggggccgccgguccuggccccucaacgaggggaucauggccgugggcaucgucagcauccugcugagcucccuccugaagaacgacgugccccuggccgggccccucaucgccggcggcaugcugaucgcgugcuacgugaucagcggguccagcgccgaccugucccucgagaaggccgccgaggucagcugggaggaggaggccgagcacuccggcgcgagccacaacauccugguggaggugcaggacgacgggaccaugaagaucaaggacgaggagcgcgacgacacccugaccauccuccugaaggccacgcugcucgccgucuccggcguguacccgcugagcauccccgccacccuguucgugugguacuucuggcagaagaagaagcagcgguccgggguccucugggacacccccagcccgcccgagguggagcgcgccgugcuggacgacggcaucuaccggaucaugcagcgcggccugcuggggcggucccaggucggcguggggguguuccaggagaacgucuuccacaccauguggcacgugacgcgcggcgcggugcucauguaccaggggaagcggcuggagcccagcugggccuccgucaagaaggaccugaucagcuacggcggcggguggcgccuccagggcuccuggaacaccggggaggagguccaggugaucgccgucgagcccggcaagaaccccaagaacgugcagaccgcccccgggaccuucaagacgcccgagggcgaggugggcgccaucgcgcuggacuucaagcccgggaccagcggcucccccaucgucaaccgggaggggaagaucgugggccuguacggcaacgggguggucaccaccagcggcacguacgugagcgccaucgcccaggccaaggcgucccaggaggggccgcuccccgagaucgaggacgagguguuccgcaagcggaaccugaccaucauggaccugcaccccggcagcgggaagacccgccgguaccucccggccaucguccgcgaggccaucaagcgcaagcugcggacccugauccucgcccccacgcgcgugguggccuccgagauggcggaggcccugaagggcaugcccauccgguaccagaccaccgccgucaagagcgagcacaccggcaaggagaucguggaccugaugugccacgccacguucaccaugcgccuccugucccccgugcgggucccgaacuacaacaugaucaucauggacgaggcccacuucaccgaccccagcuccaucgcggcccgcggguacaucagcacccgggugggcaugggggaggccgccgccaucuucaugacggcgacgccgcccggcuccguggaggccuucccgcagagcaacgccgucauccaggacgaggagcgcgacauccccgagcgguccuggaacagcggguacgaguggaucaccgacuuccccggcaagaccgugugguucgugcccuccaucaagagcggcaacgacaucgccaacugccugcgcaagaacgggaagcgggucauccagcucucccgcaagacguucgacaccgaguaccagaagaccaagaacaacgacugggacuacguggugaccacggacaucagcgagaugggcgcgaacuuccgggccgaccgcgucaucgacccgcggcgcugccugaagcccgugauccugaaggacgggcccgagcgggugauccucgccggccccaugccggucaccguggccuccgccgcgcagcgccgggggcgcaucggccgcaaccacaacaaggagggcgaccaguacaucuacauggggcagccccugaacaacgacgaggaccacgcccacuggaccgaggccaagaugcugcucgacaacaucaacacccccgagggcaucauccccgcccuguucgagccggagcgggagaaguccgccgcgaucgacggggaguaccgccugcggggcgaggcccgcaagacguucgucgagcucaugcggcgcggggaccugcccguguggcuguccuacaagguggccagcgagggcuuccaguacagcgaccggcgcuggugcuucgacggcgagcggaacaaccagguccucgaggagaacauggacguggagaucuggaccaaggagggggagcgcaagaagcugcggccccgcuggcuggacgcccggaccuacuccgacccccucgcccugcgcgaguucaaggaguucgcggccggccggcgcagcguguccggggaccugauccucgagaucggcaagcugccgcagcaccugacccagcgggcccagaacgcccucgacaaccuggucaugcugcacaacagcgagcagggcgggcgcgcguaccggcacgccauggaggagcuccccgacacgaucgagacccugaugcugcucgcccugaucgccgugcugaccggcggggugacccucuucuuccuguccggccgcgggcugggcaagaccagcaucggccuccugugcgucauggccuccagcgugcugcucuggauggcguccguggagccccacuggaucgccgccagcaucauccuggaguucuuccugaugguccuccugauccccgagccggaccggcagcgcacgccccaggacaaccagcuggccuacguggugaucgggcuccuguucaugauccugaccgucgccgcgaacgagaugggccuccuggagaccaccaagaaggaccuggggaucggccacguggccguggagaaccaccaccacgccgccaugcucgacgucgaccugcaccccgccuccgcguggacgcuguacgccguggccaccaccaucaucaccccgaugaugcgccacacgaucgagaacaccaccgccaacaucagccucaccgccaucgcgaaccaggccgccauccugauggggcuggacaagggcuggcccaucuccaagauggacaucggcgugccccuccuggcccuggggugcuacagccaggucaacccccucacgcugaccgcggccgugcugaugcucguggcccacuacgccaucaucggcccggggcugcaggccaaggcgacccgggaggcccagaagcgcaccgccgccggcaucaugaagaaccccacggucgacgggaucguggccaucgaccuggaccccguggucuacgacgcgaaguucgagaagcagcucggccagaucaugcugcugauccucugcaccucccagauccugcugaugcggaccaccugggcccucugcgagagcaucacgcuggccaccggcccccugaccacccucugggagggguccccgggcaaguucuggaacacgaccaucgccgugagcauggccaacaucuuccgcggguccuaccuggcgggcgccggccuggccuucagccucaugaagucccucgggggcgggcggcgcgggaccggggcccagggcgagacccugggcgagaaguggaagcggcagcucaaccagcuguccaagagcgaguucaacacguacaagcgcuccgggaucauggagguggaccggagcgaggcgaaggagggccugaagcgcggggagaccaccaagcacgccgucucccggggcaccgccaagcuccgcugguucguggagcggaaccuggugaagcccgaggggaaggucaucgaccugggcugcggccgcgggggcuggagcuacuacugcgccgggcugaagaaggugacggaggugaagggcuacaccaagggcgggcccggccacgaggagcccaucccgauggccaccuacggguggaaccucgucaagcugcacuccggcaaggacguguucuucaucccgcccgagaagugcgacacccugcucugcgacaucggggagagcucccccaacccgacgaucgaggagggccggacccugcgcgugcugaagauggucgagcccuggcuccgggggaaccaguucugcaucaagauccugaaccccuacaugcccagcgugguggagacccuggagcagaugcagcgcaagcacggcggcaugcucguccggaacccgcugucccgcaacagcacccacgagauguacuggguguccugcgggaccggcaacaucgugagcgcggucaacaugacgucccgcaugcugcucaaccgguucaccauggcccaccgcaagcccaccuacgagcgggacguggaccugggggccggcacccgccacguggccgucgagcccgagguggccaaccuggacaucaucggccagcggaucgagaacaucaagcacgagcacaagagcacguggcacuacgacgaggacaaccccuacaagaccugggcguaccacggguccuacgaggugaagccgagcggcuccgccagcagcauggucaacgggguggucaagcuccugaccaagcccugggacgugauccccauggugacccagaucgccaugacggacaccacccccuucggccagcagcgcgucuucaaggagaagguggacacccggacgccgaaggccaagcgcgggaccgcccagaucauggaggugaccgcgaaguggcuguggggcuuccucgcccggaacaagaagccccgcaucugcacccgggaggaguucacgcgcaagguccgguccaacgccgccaucggcgcgguguucguggacgagaaccaguggaacagcgccaaggaggccgucgaggacgagcgcuucugggaccuggugcaccgggagcgcgagcugcacaagcaggggaagugcgcgaccugcguguacaacaugaugggcaagcgggagaagaagcucggggaguucggcaaggccaaggggucccgcgcgaucugguacauguggcugggcgcccgguuccuggaguucgaggcccucggcuucaugaacgaggaccacugguucagccgcgagaacucccugagcggggucgagggcgaggggcugcacaagcucggcuacauccugcgggacaucuccaagauccccgggggcaacauguacgccgacgacaccgccggcugggacacccgcaucacggaggacgaccugcagaacgaggcgcgcaucaccgacaucauggagccggagcacgcccuccuggccaagagcaucuucaagcugaccuaccagaacaagguggugcggguccagcgccccgccaagaacgggaccgugauggacgugaucucccggcgcgaccagcggggcagcgggcaggucggcacguacggccucaacaccuucaccaacauggaggcccagcugauccgccagauggaguccgaggggaucuucagccccuccgagcuggagacccccaaccucgcggagcgggugcuggacuggcuggagaaguacggcguggagcgccucaagcggauggccaucagcggggacgacugcgucgugaagccgaucgacgaccgcuucgccacggcccugaccgcccugaacgacaugggcaaggugcggaaggacaucccccagugggagcccuccaagggguggaacgacuggcagcagguccccuucugcagccaccacuuccaccagcucaucaugaaggacggccgcgagaucguggugccgugccggaaccaggacgagcuggucggccgcgcgcgggugucccagggggccggcuggagccugcgcgagaccgccugccucggcaagagcuacgcccagauguggcagcugauguacuuccaccggcgcgaccugcggcucgcggccaacgccaucugcuccgccgugcccgucgacuggauccccaccagccgcacgaccugguccauccacgcccaccaccaguggaugaccaccgaggacaugcugagcguguggaaccgcguguggaucgaggagaaccccuggauggaggacaagacgcacaucuccagcuggggcgacgucccguaccuggggaagcgggaggaccaguggugcggcucccucaucggccugaccgcgcgcgccaccugggccaccaacauccagguggccaucaaccaggugcggcgccugaucgggaacgagaacuaccucgacuacaugaccagcaugaagcgguucaagaacgaguccgaccccgagggcgcccugugguga

SEQ ID NO: 8301 - RNA, 9879 nt, Artificial Sequence
  derived and/or modified CDS sequence (opt1) from DENV-1__EU677140__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgagaccgagcccgacgacguggacugcuggugcaacgccacggacaccugggucaccuacgggaccugcagccagacgggcgagcaccggcgggacaagcgguccguggcccucgcgccccacgugggccuggggcuggagacccgcaccgagaccuggaugagcuccgagggcgccuggaagcagauccagcgggucgagacgugggcccuccggcaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagguggccgagacccagcacggcaccgugcugguccagaucaaguacgagggcaccgacgcgcccugcaagauccccuucagcacgcaggacgagaagggggugacccagaacggccggcugaucaccgccaacccgaucgugaccgacaaggagaagcccgucaacaucgaggccgagccgcccuucggggaguccuacaucaucaucggcgccggcgagaaggcgcugaagcucagcugguucaagaagggguccagcaucggcaagauguucgaggccacggcccgcggggcccggcgcauggccauccugggcgacaccgcgugggacuucggguccaucggcggcguguucaccagcguggggaagcugguccaccagaucuucggcaccgccuacggggugcuguucuccggcgugagcuggacgaugaagaucgggaucggcguccugcugaccuggcucggccugaacucccgcagcaccucccugagcaugaccugcaucgccguggggcucgugacgcuguaccugggcgucauggugcaggccgacuccgggugcgugaucaacuggaagggccgggagcucaagugcgggagcggcaucuucgucaccaacgaggugcacaccuggaccgagcaguacaaguuccaggccgacagcccgaagcgccuguccgcggccaucggcaaggccugggaggagggggugugcggcauccggagcgccacccgccuggagaacaucauguggaagcagaucuccaacgagcucaaccacauccugcuggagaacgacaugaaguucacggucguggugggggacgucgccggcauccucgcgcaggggaagaagaugauccggccccagcccauggaguacaaguacagcuggaaguccuggggcaaggccaagaucaucggcgccgacgugcagaacaccaccuucaucaucgacgggcccaacaccccggagugccccgacgaccagcgcgccuggaacaucugggagguggaggacuacggcuucgggaucuucacgaccaacaucuggcugaagcugcgggacagccacacccaggucugcgaccaccgccucauguccgcggccaucaaggacagcaaggccgugcacgccgacaugggcuacuggaucgaguccgagaagaacgagaccuggaagcuggcccgggcgagcuucaucgaggugaagacgugcaucuggcccaagucccacacccuguggagcaacggcguccucgaguccgagaugaucauccccaagaucuacgggggcccgaucagccagcacaacuaccgccccggguacuucacccagaccgccggccccuggcaccuggggaagcuggagcucgacuucgaccugugcgagggcacgaccgugguggucgacgagcacugcggcaaccgggggccgucccugcgcaccaccacggugaccggcaagaucauccacgaguggugcugccggagcugcacccugccgccccuccgcuuccgcggggaggacggcugcugguacgggauggagauccgccccgugaaggagaaggaggagaaccuggucaaguccauggugagcgccggcagcggcgagguggacuccuucagccucgggcugcugugcaucuccaucaugaucgaggaggucaugcggagccgcuggucccggaagaugcucaugaccggcacgcuggccguguucuuccugcucaucauggggcagcugaccuggaacgaccugauccgccucugcaucauggugggcgccaacgcgagcgaccgcauggggaugggcaccaccuaccuggcccugauggccacguucaagaugcggccgauguucgccgucggccuccuguuccgccggcugaccucccgcgaggugcuccugcugaccaucgggcucagccugguggccuccgucgagcugcccaacagccucgaggagcugggcgacgggcuggcgaugggcaucaugauccucaagcugcugaccgacuuccagucccaccagcucugggccacgcugcugagccucaccuucaucaagaccaccuucucccugcacuacgccuggaagacgauggccauggugcugagcaucgucucccucuucccccugugccugagcaccaccucccagaagaccacguggcuccccgugcugcugggcagccucgggugcaagccgcugaccauguuccugaucgcggagaacaagaucuggggccggcgcuccuggccccucaacgaggggaucauggccgugggcaucgucagcauccugcugagcucccuccugaagaacgacgugccccuggccgggccccucaucgccggcggcaugcugaucgccugcuacgugaucagcggguccagcgcggaccugucccucgagaaggccgccgaggucagcugggaggaggaggccgagcacuccggcgccagccacaacauccugguggaggugcaggacgacgggaccaugaagaucaaggacgaggagcgggacgacacccugaccauccuccugaaggcgacgcugcucgccgucuccggcguguacccgcugagcauccccgccacccuguucgugugguacuucuggcagaagaagaagcagcgcuccgggguccucugggacacccccagcccgcccgagguggagcgggccgugcuggacgacggcaucuaccgcaucaugcagcggggccugcuggggcgcucccaggucggcguggggguguuccaggagaacgucuuccacaccauguggcacgugacgcggggcgccgugcucauguaccaggggaagcgccuggagcccagcugggcguccgucaagaaggaccugaucagcuacggcggcggguggcggcuccagggcuccuggaacaccggggaggagguccaggugaucgccgucgagcccggcaagaaccccaagaacgugcagaccgcccccgggaccuucaagacgcccgagggcgaggugggcgccaucgcccuggacuucaagcccgggaccagcggcucccccaucgucaaccgcgaggggaagaucgugggccuguacggcaacgggguggucaccaccagcggcacguacgugagcgcgaucgcccaggccaaggccucccaggaggggccgcuccccgagaucgaggacgagguguuccggaagcgcaaccugaccaucauggaccugcaccccggcagcgggaagacccggcgcuaccucccggcgaucguccgggaggccaucaagcgcaagcugcgcacccugauccucgcccccacgcgggugguggccuccgagauggccgaggcgcugaagggcaugcccauccgcuaccagaccaccgccgucaagagcgagcacaccggcaaggagaucguggaccugaugugccacgccacguucaccaugcggcuccugucccccgugcgcgucccgaacuacaacaugaucaucauggacgaggcccacuucaccgaccccagcuccaucgccgcgcggggguacaucagcacccgcgugggcaugggggaggccgccgccaucuucaugacggccacgccgcccggcuccguggaggcguucccgcagagcaacgccgucauccaggacgaggagcgggacauccccgagcgcuccuggaacagcggguacgaguggaucaccgacuuccccggcaagaccgugugguucgugcccuccaucaagagcggcaacgacaucgccaacugccugcggaagaacgggaagcgcgucauccagcucucccggaagacguucgacaccgaguaccagaagaccaagaacaacgacugggacuacguggugaccacggacaucagcgagaugggcgccaacuuccgcgcggaccgggucaucgacccgcgccggugccugaagcccgugauccugaaggacgggcccgagcgcgugauccucgccggccccaugccggucaccguggccuccgccgcccagcggcgcgggcggaucggccgcaaccacaacaaggagggcgaccaguacaucuacauggggcagccccugaacaacgacgaggaccacgcgcacuggaccgaggccaagaugcugcucgacaacaucaacacccccgagggcaucauccccgcccuguucgagccggagcgcgagaaguccgccgccaucgacggggaguaccggcugcgcggcgaggcgcggaagacguucgucgagcucaugcgccgcggggaccugcccguguggcuguccuacaagguggccagcgagggcuuccaguacagcgaccgccgguggugcuucgacggcgagcgcaacaaccagguccucgaggagaacauggacguggagaucuggaccaaggagggggagcggaagaagcugcgcccccgguggcuggacgcccgcaccuacuccgacccccucgcccugcgggaguucaaggaguucgccgcgggccgccggagcguguccggggaccugauccucgagaucggcaagcugccgcagcaccugacccagcgcgcccagaacgcccucgacaaccuggucaugcugcacaacagcgagcagggcgggcgggccuaccgccacgcgauggaggagcuccccgacacgaucgagacccugaugcugcucgcccugaucgccgugcugaccggcggggugacccucuucuuccuguccggccgggggcugggcaagaccagcaucggccuccugugcgucauggccuccagcgugcugcucuggauggccuccguggagccccacuggaucgcggccagcaucauccuggaguucuuccugaugguccuccugauccccgagccggaccgccagcggacgccccaggacaaccagcuggccuacguggugaucgggcuccuguucaugauccugaccgucgccgccaacgagaugggccuccuggagaccaccaagaaggaccuggggaucggccacguggcgguggagaaccaccaccacgccgccaugcucgacgucgaccugcaccccgccuccgccuggacgcuguacgcgguggccaccaccaucaucaccccgaugaugcgccacacgaucgagaacaccaccgccaacaucagccucaccgccaucgccaaccaggcggccauccugauggggcuggacaagggcuggcccaucuccaagauggacaucggcgugccccuccuggcccuggggugcuacagccaggucaacccccucacgcugaccgccgcggugcugaugcucguggcccacuacgccaucaucggcccggggcugcaggccaaggccacccgcgaggcgcagaagcggaccgccgccggcaucaugaagaaccccacggucgacgggaucguggccaucgaccuggaccccguggucuacgacgccaaguucgagaagcagcucggccagaucaugcugcugauccucugcaccucccagauccugcugaugcgcaccaccugggcgcucugcgagagcaucacgcuggccaccggcccccugaccacccucugggagggguccccgggcaaguucuggaacacgaccaucgccgugagcauggccaacaucuuccggggguccuaccuggccggcgcgggccuggccuucagccucaugaagucccucgggggcgggcgccgggggaccggggcccagggcgagacccugggcgagaaguggaagcgccagcucaaccagcuguccaagagcgaguucaacacguacaagcgguccgggaucauggagguggaccgcagcgaggccaaggagggccugaagcgcggggagaccaccaagcacgcggucucccgcggcaccgccaagcuccggugguucguggagcgcaaccuggugaagcccgaggggaaggucaucgaccugggcugcggccgcgggggcuggagcuacuacugcgccgggcugaagaaggugacggaggugaagggcuacaccaagggcggccccggccacgaggagcccaucccgauggccaccuacggguggaaccucgucaagcugcacuccggcaaggacguguucuucaucccgcccgagaagugcgacacccugcucugcgacaucggggagagcucccccaacccgacgaucgaggagggccgcacccugcgggugcugaagauggucgagcccuggcuccgcgggaaccaguucugcaucaagauccugaaccccuacaugcccagcgugguggagacccuggagcagaugcagcggaagcacggcggcaugcucguccgcaacccgcugucccggaacagcacccacgagauguacuggguguccugcgggaccggcaacaucgugagcgccgucaacaugacgucccgcaugcugcucaaccgcuucaccauggcgcaccggaagcccaccuacgagcgcgacguggaccugggggccggcacccggcacguggccgucgagcccgagguggccaaccuggacaucaucggccagcgcaucgagaacaucaagcacgagcacaagagcacguggcacuacgacgaggacaaccccuacaagaccugggccuaccacggguccuacgaggugaagccgagcggcuccgcgagcagcauggucaacgggguggucaagcuccugaccaagcccugggacgugauccccauggugacccagaucgccaugacggacaccacccccuucggccagcagcgggucuucaaggagaagguggacacccgcacgccgaaggccaagcgggggaccgcccagaucauggaggugaccgccaaguggcuguggggcuuccucucccgcaacaagaagccccggaucugcacccgcgaggaguucacgcggaagguccgcagcaacgcggccaucggcgccguguucguggacgagaaccaguggaacuccgccaaggaggcggucgaggacgagcgguucugggaccuggugcaccgcgagcgggagcugcacaagcaggggaagugcgcgaccugcguguacaacaugaugggcaagcgcgagaagaagcucggggaguucggcaaggccaaggggagccgggccaucugguacauguggcugggcgcccgcuuccuggaguucgaggcgcucggcuucaugaacgaggaccacugguucucccgggagaacagccuguccggggucgagggcgaggggcugcacaagcucggcuacauccugcgcgacaucagcaagauccccgggggcaacauguacgccgacgacaccgccggcugggacacccggaucacggaggacgaccugcagaacgaggcccgcaucaccgacaucauggagccggagcacgcccuccuggcgaaguccaucuucaagcugaccuaccagaacaagguggugcgcguccagcggcccgccaagaacgggaccgugauggacgugaucagccgccgggaccagcgcggcuccgggcaggucggcacguacggccucaacaccuucaccaacauggaggcccagcugauccggcagauggagagcgaggggaucuucucccccagcgagcuggagacccccaaccucgccgagcgcgugcuggacuggcugaagaaguacggcguggagcggcucaagcgcauggccaucuccggggacgacugcgucgugaagccgaucgacgaccgguucgcgacggcccugaccgcccugaacgacaugggcaaggugcgcaaggacaucccccagugggagcccagcaagggguggaacgacuggcagcagguccccuucugcucccaccacuuccaccagcucaucaugaaggacggccgggagaucguggugccgugccgcaaccaggacgagcuggucggccgggcccgcgugagccagggggccggcuggagccugcgggagaccgcgugccucgggaaguccuacgcccagauguggcagcugauguacuuccaccgccgggaccugcgccucgccgccaacgcgaucugcagcgccgugcccgucgacuggauccccaccucccggacgaccuggagcauccacgcccaccaccaguggaugaccaccgaggacaugcuguccguguggaaccgcguguggaucgaggagaaccccuggauggaggacaagacgcacaucagcuccuggggcgacgucccguaccuggggaagcgcgaggaccaguggugcggcagccucaucggccugaccgcccgggccaccugggcgaccaacauccagguggccaucaaccaggugcgccggcugaucgggaacgagaacuaccucgacuacaugaccuccaugaagcgcuucaagaacgagggcgaccccgagggggcccugugguga

SEQ ID NO: 8302 - RNA, 9879 nt, Artificial Sequence
  derived and/or modified CDS sequence (opt1) from DENV-1__EU677166__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgagaccgagcccgacgacguggacugcuggugcaacgccacggacaccugggugaccuacgggaccugcagccagacgggcgagcaccggcgggacaagcgguccguggcccucgcgccccacgugggccuggggcuggagacccgcaccgagaccuggaugagcuccgagggcgccuggaagcagauccagcgggucgagacgugggcccuccggcaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagguggccgagacccagcacggcaccgugcugguccagaucaaguacgagggcaccgacgcgcccugcaagauccccuucagcacgcaggacgagaagggggugacccagaacggccggcugaucaccgccaacccgaucgugaccgacaaggagaagcccgucaacaucgaggccgagccgcccuucggggaguccuacaucgugaucggcgccggcgagaaggcgcugaagcucagcugguucaagaagggguccagcaucggcaagauguucgaggccacggcccgcggggcccggcgcauggccauccugggcgacaccgcgugggacuucggguccaucggcggcguguucaccagcgucgggaagcuggugcaccagaucuucggcaccgccuacggggugcuguucuccggcgucagcuggacgaugaagaucgggaucggcgugcugcugaccuggcucggccugaacucccgcagcaccucccugagcaugaccugcaucgccguggggcucgucacgcuguaccugggcgugauggugcaggccgacuccgggugcgucaucaacuggaagggccgggagcucaagugcgggagcggcaucuucgugaccaacgaggugcacaccuggaccgagcaguacaaguuccaggccgacagcccgaagcgccuguccgcggccaucggcaaggccugggaggagggggucugcggcauccggagcgccacccgccuggagaacaucauguggaagcagaucuccaacgagcucaaccacauccugcuggagaacgacaugaaguucacggugguggucggggacguggccggcauccucgcgcaggggaagaagaugauccggccccagcccauggaguacaaguacagcuggaaguccuggggcaaggccaagaucaucggcgccgacgugcagaacaccaccuucaucaucgacgggcccaacaccccggagugccccgacgaccagcgcgccuggaacaucugggaggucgaggacuacggcuucgggaucuucacgaccaacaucuggcugaagcugcgggacagcuacacccaggugugcgaccaccgccucauguccgcggccaucaaggacagcaaggccgugcacgccgacaugggcuacuggaucgaguccgagaagaacgagaccuggaagcuggcccgggcgagcuucaucgaggucaagacgugcaucuggcccaagucccacacccuguggagcaacggcgugcucgaguccgagaugaucauccccaagaucuacgggggcccgaucagccagcacaacuaccgccccggguacuucacccagaccgccggccccuggcaccuggggaagcuggagcucgacuucgaccugugcgagggcacgaccguggucguggacgagcacugcggcaaccgggggccgucccugcgcaccaccacggugaccggcaagaucauccacgaguggugcugccggagcugcacccugccgccccuccgcuuccgcggggaggacggcugcugguacgggauggagauccgccccgucaaggagaaggaggagaaccuggugaaguccauggugagcgccggcagcggcgaggucgacuccuucagccucgggcugcugugcaucuccaucaugaucgaggaggugaugcggagccgcuggucccggaagaugcucaugaccggcacgcuggccguguucuuccugcucaucauggggcagcugaccuggaacgaccugauccgccucugcaucauggucggcgccaacgcgagcgaccgcauggggaugggcaccaccuaccuggcccugauggccacguucaagaugcggccgauguucgccgugggccuccuguuccgccggcugaccucccgcgaggugcuccugcugaccaucgggcucagccuggucgccuccguggagcugcccaacagccucgaggagcugggcgacgggcuggcgaugggcaucaugauccucaagcugcugaccgacuuccagucccaccagcucugggccacgcugcugagccucaccuucaucaagaccaccuucucccugcacuacgccuggaagacgauggccaugguccugagcaucgugucccucuucccccugugccugagcaccaccucccagaagaccacguggcuccccgugcugcugggcagccucgggugcaagccgcugaccauguuccugaucgcggagaacaagaucuggggccggcgcuccuggccccucaacgaggggaucauggccgucggcaucgugagcauccugcugagcucccuccugaagaacgacgugccccuggccgggccccucaucgccggcggcaugcugaucgccugcuacgucaucagcggguccagcgcggaccugucccucgagaaggccgccgaggugagcugggaggaggaggccgagcacuccggcgccagccacaacauccugguggagguccaggacgacgggaccaugaagaucaaggacgaggagcgggacgacacccugaccauccuccugaaggcgacgcugcucgccguguccggcguguacccgcugagcauccccgccacccuguucgucugguacuucuggcagaagaagaagcagcgcuccggggugcucugggacacccccagcccgcccgagguggagcgggccguccuggacgacggcaucuaccgcaucaugcagcggggccugcuggggcgcucccaggugggcgugggggucuuccaggagaacguguuccacaccauguggcacgugacgcggggcgccguccucauguaccaggggaagcgccuggagcccagcugggcguccgugaagaaggaccugaucagcuacggcggcggguggcggcuccagggcuccuggaacaccggggaggaggugcaggucaucgccguggagcccggcaagaaccccaagaacgugcagaccgcccccgggaccuucaagacgcccgagggcgaggucggcgccaucgcccuggacuucaagcccgggaccagcggcucccccaucgugaaccgcgaggggaagaucgugggccuguacggcaacggggucgugaccaccagcggcacguacgugagcgcgaucgcccaggccaaggccucccaggaggggccgcuccccgagaucgaggacgaggucuuccggaagcgcaaccugaccaucauggaccugcaccccggcagcgggaagacccggcgcuaccucccggcgaucgugcgggaggccaucaagcgcaagcugcgcacccugauccucgcccccacgcggguggucgccuccgagauggccgaggcgcugaagggcaugcccauccgcuaccagaccaccgccgucaagagcgagcacaccggcaaggagaucguggaccugaugugccacgccacguucaccaugcggcuccugucccccguccgcgugccgaacuacaacaugaucaucauggacgaggcccacuucaccgaccccagcuccaucgccgcgcggggguacaucagcacccgcgugggcaugggggaggccgccgccaucuucaugacggccacgccgcccggcuccgucgaggcguucccgcagagcaacgccgugauccaggacgaggagcgggacauccccgagcgcuccuggaacagcggguacgaguggaucaccgacuuccccggcaagaccgugugguucguccccuccaucaagagcggcaacgacaucgccaacugccugcggaagaacgggaagcgcgugauccagcucucccggaagacguucgacaccgaguaccagaagaccaagaacaacgacugggacuacguggucaccacggacaucagcgagaugggcgccaacuuccgcgcggaccgggugaucgacccgcgccggugccugaagcccgugauccugaaggacgggcccgagcgcgucauccucgccggccccaugccggugaccgucgccuccgccgcccagcggcgcgggcggaucggccgcaaccacaacaaggagggcgaccaguacaucuacauggggcagccccugaacaacgacgaggaccacgcgcacuggaccgaggccaagaugcugcucgacaacaucaacacccccgagggcaucauccccgcccuguucgagccggagcgcgagaaguccgccgccaucgacggggaguaccggcugcgcggcgaggcgcggaagacguucguggagcucaugcgccgcggggaccugcccguguggcuguccuacaaggucgccagcgagggcuuccaguacagcgaccgccgguggugcuucgacggcgagcgcaacaaccaggugcucgaggagaacauggacguggagaucuggaccaaggagggggagcggaagaagcugcgcccccgguggcuggacgcccgcaccuacuccgacccccucgcccugcgggaguucaaggaguucgccgcgggccgccggagcgucuccggggaccugauccucgagaucggcaagcugccgcagcaccugacccagcgcgcccagaacgcccucgacaaccuggugaugcugcacaacagcgagcagggcgggcgggccuaccgccacgcgauggaggagcuccccgacacgaucgagacccugaugcugcucgcccugaucgccgugcugaccggcggggucacccucuucuuccuguccggccgggggcugggcaagaccagcaucggccuccugugcgugauggccuccagcgugcugcucuggauggccuccgucgagccccacuggaucgcggccagcaucauccuggaguucuuccugauggugcuccugauccccgagccggaccgccagcggacgccccaggacaaccagcuggccuacguggucaucgggcuccuguucaugauccugaccguggccgccaacgagaugggccuccuggagaccaccaagaaggaccuggggaucggccacguggcggucgagaaccaccaccacgccgccaugcucgacguggaccugcaccccgccuccgccuggacgcuguacgcgguggccaccaccaucaucaccccgaugaugcgccacacgaucgagaacaccaccgccaacaucagccucaccgccaucgccaaccaggcggccauccugauggggcuggacaagggcuggcccaucuccaagauggacaucggcgucccccuccuggcccuggggugcuacagccaggugaacccccucacgcugaccgccgcggugcugaugcucgucgcccacuacgccaucaucggcccggggcugcaggccaaggccacccgcgaggcgcagaagcggaccgccgccggcaucaugaagaaccccacgguggacgggaucguggccaucgaccuggaccccgucguguacgacgccaaguucgagaagcagcucggccagaucaugcugcugauccucugcaccucccagauccugcugaugcgcaccaccugggcgcucugcgagagcaucacgcuggccaccggcccccugaccacccucugggagggguccccgggcaaguucuggaacacgaccaucgccgugagcauggccaacaucuuccggggguccuaccuggccggcgcgggccuggccuucagccucaugaagucccucgggggcgggcgccgggggaccggggcccagggcgagacccugggcgagaaguggaagcgccagcucaaccagcuguccaagagcgaguucaacacguacaagcgguccgggaucauggaggucgaccgcagcgaggccaaggagggccugaagcgcggggagaccaccaagcacgcggugucccgcggcaccgccaagcuccggugguucguggagcgcaaccuggucaagcccgaggggaaggugaucgaccugggcugcggccgcgggggcuggagcuacuacugcgccgggcugaagaaggugacggaggucaagggcuacaccaagggcggccccggccacgaggagcccaucccgauggccaccuacggguggaaccucgugaagcugcacuccggcaaggacguguucuucaucccgcccgagaagugcgacacccugcucugcgacaucggggagagcucccccaacccgacgaucgaggagggccgcacccugcggguccugaagaugguggagcccuggcuccgcgggaaccaguucugcaucaagauccugaaccccuacaugcccagcguggucgagacccuggagcagaugcagcggaagcacggcggcaugcucgugcgcaacccgcugucccggaacagcacccacgagauguacuggguguccugcgggaccggcaacaucgucagcgccgugaacaugacgucccgcaugcugcucaaccgcuucaccauggcgcaccggaagcccaccuacgagcgcgacguggaccugggggccggcacccggcacgucgccguggagcccgagguggccaaccuggacaucaucggccagcgcaucgagaacaucaagcacgagcacaagagcacguggcacuacgacgaggacaaccccuacaagaccugggccuaccacggguccuacgaggucaagccgagcggcuccgcgagcagcauggugaacggggucgugaagcuccugaccaagcccugggacgugauccccauggucacccagaucgccaugacggacaccacccccuucggccagcagcggguguucaaggagaagguggacacccgcacgccgaaggccaagcgggggaccgcccagaucauggaggucaccgccaaguggcuguggggcuuccucucccgcaacaagaagccccggaucugcacccgcgaggaguucacgcggaaggugcgcagcaacgcggccaucggcgccguguucgucgacgagaaccaguggaacuccgccaaggaggcgguggaggacgagcgguucugggaccuggugcaccgcgagcgggagcugcacaagcaggggaagugcgcgaccugcgucuacaacaugaugggcaagcgcgagaagaagcucggggaguucggcaaggccaaggggagccgggccaucugguacauguggcugggcgcccgcuuccuggaguucgaggcgcucggcuucaugaacgaggaccacugguucucccgggagaacagccuguccgggguggagggcgaggggcugcacaagcucggcuacauccugcgcgacaucagcaagauccccgggggcaacauguacgccgacgacaccgccggcugggacacccggaucacggaggacgaccugcagaacgaggcccgcaucaccgacaucauggagccggagcacgcccuccuggcgcgcuccaucuucaagcugaccuaccagaacaaggugguccgggugcagcgccccgccaagaacgggaccgugauggacgucaucagccggcgcgaccagcggggcuccggccagguggggacguacggccucaacaccuucaccaacauggaggcccagcugauccgccagauggagagcgaggggaucuucucccccagcgagcuggagacccccaaccucgccgagcgggugcuggacuggcuggagaaguacggcgucgagcgccucaagcggauggccaucuccggggacgacugcguggugaagccgaucgacgaccgcuucgcgacggcccugaccgcccugaacgacaugggcaagguccggaaggacaucccccagugggagcccagcaagggguggaacgacuggcagcagguccccuucugcucccaccacuuccaccagcucaucaugaaggacggccgcgagaucguggucccgugccggaaccaggacgagcuggugggccgcgcccgggugagccagggggccggcuggagccugcgcgagaccgcgugccucgggaaguccuacgcccagauguggcagcugauguacuuccaccggcgcgaccugcggcucgccgccaacgcgaucugcagcgccguccccgugaacuggauccccaccucccgcacgaccuggagcauccacgcccaccaccaguggaugaccaccgaggacaugcuguccguguggaaccgcgucuggaucgaggagaaccccuggauggaggacaagacgcacaucagcuccuggggcgacgugccguaccuggggaagcgggaggaccaguggugcggcagccucaucggccugaccgcccgcgccaccugggcgaccaacauccagguggccaucaaccagguccggcgccugaucgggaacgagaacuaccucgacuacaugaccuccaugaagcgguucaagaacgagagcgaccccgagggcgcccugugguga

SEQ ID NO: 8303 - RNA, 9879 nt, Artificial Sequence
  derived and/or modified CDS sequence (opt1) from DENV-1__EU677170__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgagaccgagcccgacgacguggacugcuggugcaacgccacggacaccugggugaccuacgggaccugcagccagacgggcgagcaccggcgggacaagcgguccguggcccucgcgccccacgugggccuggggcuggagacccgcaccgagaccuggaugagcuccgagggcgccuggaagcagauccagcggguggagacgugggcccuccggcaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagguggccgagacccagcacggcaccgugcugguccagaucaaguacgagggcaccgacgcgcccugcaagauccccuucagcacgcaggacgagaagggggugacccagaacggccggcugaucaccgccaacccgaucgugaccgacaaggagaagcccgucaacaucgaggccgagccgcccuucggggaguccuacaucgugaucggcgccggcgagaaggcgcugaagcucagcugguucaagaagggguccagcaucggcaagauguucgaggccacggcccgcggggcccggcgcauggccauccugggcgacaccgcgugggacuucggguccaucggcggcguguucaccagcgucgggaagcuggugcaccagaucuucggcaccgccuacgggguccuguucuccggcgucagcuggacgaugaagaucgggaucggcgugcugcugaccuggcucggccugaacucccgcagcaccucccugagcaugaccugcaucgccguggggcucgucacgcuguaccugggcgugauggugcaggccgacuccgggugcgucaucaacuggaagggccgggagcucaagugcgggagcggcaucuucgugaccaacgaggugcacaccuggaccgagcaguacaaguuccaggccgacagcccgaagcgccuguccgcggccaucggcaaggccugggaggagggggucugcggcauccggagcgccacccgccuggagaacaucauguggaagcagaucuccaacgagcucaaccacauccugcuggagaacgacaugaaguucacggugguggucggggacguggccggcauccucgcgcaggggaagaagaugauccggccccagcccauggaguacaaguacagcuggaaguccuggggcaaggccaagaucaucggcgccgacgugcagaacaccaccuucaucaucgacgggcccaacaccccggagugccccgacgaccagcgcgccuggaacaucugggaggucgaggacuacggcuucgggaucuucacgaccaacaucuggaugaagcugcgggacagcuacacccaggugugcgaccaccgccugauguccgcggccaucaaggacagcaaggccgugcacgccgacaugggcuacuggaucgaguccgagaagaacgagaccuggaagcucgcccgggcgagcuucaucgaggucaagacgugcaucuggcccaagucccacacccuguggagcaacggcgugcuggaguccgagaugaucauccccaagaucuacgggggcccgaucagccagcacaacuaccgccccggguacuucacccagaccgccggccccuggcaccucgggaagcuggagcuggacuucgaccucugcgagggcacgaccguggucguggacgagcacugcggcaaccgggggccgucccugcgcaccaccacggugaccggcaagaucauccacgaguggugcugccggagcugcacccugccgccccugcgcuuccgcggggaggacggcugcugguacgggauggagauccgccccgucaaggagaaggaggagaaccuggugaaguccauggugagcgccggcagcggcgaggucgacuccuucagccuggggcuccugugcaucuccaucaugaucgaggaggugaugcggagccgcuggucccggaagaugcugaugaccggcacgcucgccguguucuuccugcugaucauggggcagcucaccuggaacgaccugauccgccugugcaucauggucggcgccaacgcgagcgaccgcauggggaugggcaccaccuaccucgcccugauggccacguucaagaugcggccgauguucgccgugggccuccucuuccgccggcugaccucccgcgaggugcugcuccugaccaucgggcugagccucgucgccuccguggagcugcccaacagccuggaggagcucggcgacgggcuggcgaugggcaucaugauccugaagcuccugaccgacuuccagucccaccagcugugggccacgcuccugagccugaccuucaucaagaccaccuucucccuccacuacgccuggaagacgauggccaugguccugagcaucgugucccuguucccccucugccugagcaccaccucccagaagaccacguggcugcccgugcuccugggcagccuggggugcaagccgcucaccauguuccugaucgcggagaacaagaucuggggccggcgcuccuggccccugaacgaggggaucauggccgucggcaucgugagcauccuccugagcucccugcucaagaacgacgugccccuggccgggccccugaucgccggcggcaugcucaucgccugcuacgucaucagcggguccagcgcggaccugucccuggagaaggccgccgaggugagcugggaggaggaggccgagcacuccggcgccagccacaacauccucguggagguccaggacgacgggaccaugaagaucaaggacgaggagcgggacgacacccugaccauccugcucaaggcgacgcugcuggccguguccggcguguacccgcucagcauccccgccacccuguucgucugguacuucuggcagaagaagaagcagcgcuccggggugcugugggacacccccagcccgcccgagguggagcgggccguccucgacgacggcaucuaccgcaucaugcagcggggccugcuggggcgcucccaggugggcgugggggucuuccaggagaacguguuccacaccauguggcacgugacgcggggcgccguccugauguaccaggggaagcgccucgagcccagcugggcguccgugaagaaggaccugaucagcuacggcggcggguggcggcugcagggcuccuggaacaccggggaggaggugcaggucaucgccguggagcccggcaagaaccccaagaacgugcagaccgcccccgggaccuucaagacgcccgagggcgaggucggcgccaucgcccucgacuucaagcccgggaccagcggcucccccaucgugaaccgcgaggggaagaucgugggccuguacggcaacggggucgugaccaccagcggcacguacgugagcgcgaucgcccaggccaaggccucccaggaggggccgcugcccgagaucgaggacgaggucuuccggaagcgcaaccucaccaucauggaccugcaccccggcagcgggaagacccggcgcuaccugccggcgaucgugcgggaggccaucaagcgcaagcuccgcacccugauccuggcccccacgcggguggucgccuccgagauggccgaggcgcucaagggcaugcccauccgcuaccagaccaccgccgucaagagcgagcacaccggcaaggagaucguggaccugaugugccacgccacguucaccaugcggcugcucucccccguccgcgugccgaacuacaacaugaucaucauggacgaggcccacuucaccgaccccagcuccaucgccgcgcggggguacaucagcacccgcgugggcaugggggaggccgccgccaucuucaugacggccacgccgcccggcuccgucgaggcguucccgcagagcaacgccgugauccaggacgaggagcgggacauccccgagcgcuccuggaacagcggguacgaguggaucaccgacuuccccggcaagaccgugugguucguccccuccaucaagagcggcaacgacaucgccaacugccugcggaagaacgggaagcgcgugauccagcugucccggaagacguucgacaccgaguaccagaagaccaagaacaacgacugggacuacguggucaccacggacaucagcgagaugggcgccaacuuccgcgcggaccgggugaucgacccgcgccggugccucaagcccgugauccugaaggacgggcccgagcgcgucauccuggccggccccaugccggugaccgucgccuccgccgcccagcggcgcgggcggaucggccgcaaccacaacaaggagggcgaccaguacaucuacauggggcagccccucaacaacgacgaggaccacgcgcacuggaccgaggccaagaugcugcuggacaacaucaacacccccgagggcaucauccccgcccucuucgagccggagcgcgagaaguccgccgccaucgacggggaguaccggcugcgcggcgaggcgcggaagacguucguggagcugaugcgccgcggggaccuccccguguggcuguccuacaaggucgccagcgagggcuuccaguacagcgaccgccgguggugcuucgacggcgagcgcaacaaccaggugcuggaggagaacauggacguggagaucuggaccaaggagggggagcggaagaagcuccgcccccgguggcuggacgcccgcaccuacuccgacccccuggcccuccgggaguucaaggaguucgccgcgggccgccggagcgucuccggggaccugauccuggagaucggcaagcucccgcagcaccugacccagcgcgcccagaacgcccuggacaaccucgugaugcugcacaacagcgagcagggcgggcgggccuaccgccacgcgauggaggagcugcccgacacgaucgagacccucaugcugcuggcccucaucgccgugcugaccggcggggucacccuguucuuccucuccggccgggggcugggcaagaccagcaucggccugcucugcgugauggccuccagcgugcugcuguggauggccuccgucgagccccacuggaucgcggccagcaucauccucgaguucuuccugauggugcugcucauccccgagccggaccgccagcggacgccccaggacaaccagcuggccuacguggucaucgggcuccucuucaugauccugaccguggccgccaacgagaugggccugcucgagaccaccaagaaggaccuggggaucggccacguggcggucgagaaccaccaccacgccgccaugcuggacguggaccuccaccccgccuccgccuggacgcuguacgcgguggccaccaccaucaucaccccgaugaugcgccacacgaucgagaacaccaccgccaacaucagccugaccgccaucgccaaccaggcggccauccucauggggcuggacaagggcuggcccaucuccaagauggacaucggcgucccccugcucgcccuggggugcuacagccaggugaacccccugacgcucaccgccgcggugcugaugcuggucgcccacuacgccaucaucggcccggggcuccaggccaaggccacccgcgaggcgcagaagcggaccgccgccggcaucaugaagaaccccacgguggacgggaucguggccaucgaccuggaccccgucguguacgacgccaaguucgagaagcagcugggccagaucaugcuccugauccugugcaccucccagauccuccugaugcgcaccaccugggcgcugugcgagagcaucacgcucgccaccggcccccugaccacccugugggagggguccccgggcaaguucuggaacacgaccaucgccgugagcauggccaacaucuuccggggguccuaccucgccggcgcgggccuggccuucagccugaugaagucccucgggggcgggcgccggggcaccggggcccagggcgagacccugggcgagaaguggaagcgccagcugaaccagcucuccaagagcgaguucaacacguacaagcgguccgggaucauggaggucgaccgcagcgaggccaaggagggccugaagcgcggggagaccaccaagcacgcggugucccgcggcaccgccaagcugcggugguucguggagcgcaaccucgucaagcccgaggggaaggugaucgaccugggcugcggccgcggcggguggagcuacuacugcgccgggcugaagaaggugacggaggucaagggguacaccaagggcggccccggccacgaggagcccaucccgauggccaccuacggguggaaccuggugaagcuccacuccggcaaggacguguucuucaucccgcccgagaagugcgacacccugcugugcgacaucggggagagcucccccaacccgacgaucgaggagggccgcacccuccggguccugaagaugguggagcccuggcugcgcgggaaccaguucugcaucaagauccucaaccccuacaugcccagcguggucgagacccuggagcagaugcagcggaagcacggcggcaugcuggugcgcaacccgcucucccggaacagcacccacgagauguacuggguguccugcgggaccggcaacaucgucagcgccgugaacaugacgucccgcaugcugcugaaccgcuucaccauggcgcaccggaagcccaccuacgagcgcgacguggaccucggggccggcacccggcacgucgccguggagcccgagguggccaaccuggacaucaucggccagcgcaucgagaacaucaagcacgagcacaagagcacguggcacuacgacgaggacaaccccuacaagaccugggccuaccacggguccuacgaggucaagccgagcggcuccgcgagcagcauggugaacggggucgugaagcugcucaccaagcccugggacgugauccccauggucacccagaucgccaugacggacaccacccccuucggccagcagcggguguucaaggagaagguggacacccgcacgccgaaggccaagcgggggaccgcccagaucauggaggucaccgccaaguggcuguggggcuuccugucccgcaacaagaagccccggaucugcacccgcgaggaguucacgcggaaggugcgcagcaacgcggccaucggcgccguguucgucgacgagaaccaguggaacuccgccaaggaggcgguggaggacgagcgguucugggaccucgugcaccgcgagcgggagcugcacaagcaggggaagugcgcgaccugcgucuacaacaugaugggcaagcgcgagaagaagcugggggaguucggcaaggccaaggggagccgggccaucugguacauguggcucggcgcccgcuuccuggaguucgaggcgcugggcuucaugaacgaggaccacugguucucccgggagaacagccucuccgggguggagggcgaggggcugcacaagcugggcuacauccuccgcgacaucagcaagauccccgggggcaacauguacgccgacgacaccgccggcugggacacccggaucacggaggacgaccugcagaacgaggcccgcaucaccgacaucauggagccggagcacgcccugcucgcgcgcuccaucuucaagcugaccuaccagaacaaggugguccgggugcagcgccccgccaagaacgggaccgugauggacgucaucagccggcgcgaccagcggggcuccggccagguggggacguacggccugaacaccuucaccaacauggaggcccagcucauccgccagauggagagcgaggggaucuucucccccagcgagcuggagacccccauccuggccgagcgggugcucgacuggcuggagaaguacggcgucgagcgccugaagcggauggccaucuccggggacgacugcguggugaagccgaucgacgaccgcuucgcgacggcccucaccgcccugaacgacaugggcaagguccggaaggacaucccccagugggagcccagcaagggguggaacgacuggcagcagguccccuucugcucccaccacuuccaccagcugaucaugaaggacggccgcgagaucguggucccgugccggaaccaggacgagcucgugggccgcgcccgggugagccagggggccggcuggagccugcgcgagaccgcgugccuggggaaguccuacgcccagauguggcagcucauguacuuccaccggcgcgaccugcggcuggccgccaacgcgaucugcagcgccguccccguggacuggauccccaccucccgcacgaccuggagcauccacgcccaccaccaguggaugaccaccgaggacaugcucuccguguggaaccgcgucuggaucgaggagaaccccuggauggaggacaagacgcacaucagcuccuggggcgacgugccguaccuggggaagcgggaggaccaguggugcggcagccugaucggccucaccgcccgcgccaccugggcgaccaacauccagguggccaucaaccagguccggcgccugaucgggaacgagaacuaccuggacuacaugaccuccaugaagcgguucaagaacgagagcgaccccgagggcgcccucugguga

SEQ ID NO: 8304 - RNA, 9879 nt, Artificial Sequence
  derived and/or modified CDS sequence (opt1) from DENV-1__EU677171__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgagaccgagcccgacgacguggacugcuggugcaacgccacggacaccugggugaccuacgggaccugcagccagacgggcgagcaccggcgggacaagcgguccguggcccucgcgccccacgugggccuggggcuggagacccgcaccgagaccuggaugagcuccgagggcgccuggaagcagauccagcgggucgagacgugggcccuccggcaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagguggccgagacccagcacggcaccgugcugguccagaucaaguacgagggcaccgacgcgcccugcaagauccccuucagcacgcaggacgagaagggggugacccagaacggccggcugaucaccgccaacccgaucgugaccgacaaggagaagcccgucaacaucgaggccgagccgcccuucggggaguccuacaucgugaucggcgccggcgagaaggcgcugaagcucagcugguucaagaagggguccagcaucggcaagauguucgaggccacggcccgcggggcccggcgcauggccauccugggcgacaccgcgugggacuucggguccaucggcggcguguucaccagcgucgggaagcuggugcaccagaucuucggcaccgccuacggggugcuguucuccggcgucagcuggacgaugaagaucgggaucggcgugcugcugaccuggcucggccugaacucccgcagcaccucccugagcaugaccugcaucgccguggggcucgucacgcuguaccugggcgugauggugcaggccgacuccgggugcgucaucaacuggaagggccgggagcucaagugcgggagcggcaucuucgugaccaacgaggugcacaccuggaccgagcaguacaaguuccaggccgacagcccgaagcgccuguccgcggccaucggcaaggccugggaggagggggucugcggcauccggagcgccacccgccuggagaacaucauguggaagcagaucuccaacgagcucaaccacauccugcuggagaacgacaugaaguucacggugguggucggggacguggccggcauccucgcgcaggggaagaagaugauccggccccagcccauggaguacaaguacagcuggaaguccuggggcaaggccaagaucaucggcgccgacgugcagaacaccaccuucaucaucgacgggcccaacaccccggagugccccgacgaccagcgcgccuggaacaucugggaggucgaggacuacggcuucgggaucuucacgaccaacaucuggcugaagcugcgggacagcuacacccaggugugcgaccaccgccucauguccgcggccaucaaggacagcaaggccgugcacgccgacaugggcuacuggaucgaguccgagaagaacgagaccuggaagcuggcccgggcgagcuucaucgaggucaagacgugcaucuggcccaagucccacacccuguggagcaacggcgugcucgaguccgagaugaucauccccaagaucuacgggggcccgaucagccagcacaacuaccgccccggguacuucacccagaccgccggccccuggcaccuggggaagcuggagcucgacuucgaccugugcgagggcacgaccguggucguggacgagcacugcggcaaccgggggccgucccugcgcaccaccacggugaccggcaagaucauccacgaguggugcugccggagcugcacccugccgccccuccgcuuccgcggggaggacggcugcugguacgggauggagauccgccccgucaaggagaaggaggagaaccuggugaaguccauggugagcgccggcagcggcgaggucgacuccuucagccucgggcugcugugcaucuccaucaugaucgaggaggugaugcggagccgcuggucccggaagaugcucaugaccggcacgcuggccguguucuuccugcucaucauggggcagcugaccuggaacgaccugauccgccucugcaucauggucggcgccaacgcgagcgaccgcauggggaugggcaccaccuaccuggcccugauggccacguucaagaugcggccgauguucgccgugggccuccuguuccgccggcugaccucccgcgaggugcuccugcugaccaucgggcucagccuggucgccuccguggagcugcccaacagccucgaggagcugggcgacgggcuggcgaugggcaucaugauccucaagcugcugaccgacuuccagucccaccagcucugggccacgcugcugagccucaccuucaucaagaccaccuucucccugcacuacgccuggaagacgauggccaugguccugagcaucgugucccucuucccccugugccugagcaccaccucccagaagaccacguggcuccccgugcugcugggcagccucgggugcaagccgcugaccauguuccugaucgcggagaacaagaucuggggccggcgcuccuggccccucaacgaggggaucauggccgucggcaucgugagcauccugcugagcucccuccugaagaacgacgugccccuggccgggccccucaucgccggcggcaugcugaucgccugcuacgucaucagcggguccagcgcggaccugucccucgagaaggccgccgaggugagcugggaggaggaggccgagcacuccggcgccagccacaacauccugguggagguccaggacgacgggaccaugaagaucaaggacgaggagcgggacgacacccugaccauccuccugaaggcgacgcugcucgccguguccggcguguacccgcugagcauccccgccacccuguucgucugguacuucuggcagaagaagaagcagcgcuccggggugcucugggacacccccagcccgcccgagguggagcgggccguccuggacgacggcaucuaccgcaucaugcagcggggccugcuggggcgcucccaggugggcgugggggucuuccaggagaacguguuccacaccauguggcacgugacgcggggcgccguccucauguaccaggggaagcgccuggagcccagcugggcguccgugaagaaggaccugaucagcuacggcggcggguggcggcuccagggcuccuggaacaccggggaggaggugcaggucaucgccguggagcccggcaagaaccccaagaacgugcagaccgcccccgggaccuucaagacgcccgagggcgaggucggcgccaucgcccuggacuucaagcccgggaccagcggcucccccaucgugaaccgcgaggggaagaucgugggccuguacggcaacggggucgugaccaccagcggcacguacgugagcgcgaucgcccaggccaaggccucccaggaggggccgcuccccgagaucgaggacgaggucuuccggaagcgcaaccugaccaucauggaccugcaccccggcagcgggaagacccggcgcuaccucccggcgaucgugcgggaggccaucaagcgcaagcugcgcacccugauccucgcccccacgcggguggucgccuccgagauggccgaggcgcugaagggcaugcccauccgcuaccagaccaccgccgucaagagcgagcacaccggcaaggagaucguggaccugaugugccacgccacguucaccaugcggcuccugucccccguccgcgugccgaacuacaacaugaucaucauggacgaggcccacuucaccgaccccagcuccaucgccgcgcggggguacaucagcacccgcgugggcaugggggaggccgccgccaucuucaugacggccacgccgcccggcuccgucgaggcguucccgcagagcaacgccgugauccaggacgaggagcgggacauccccgagcgcuccuggaacagcggguacgaguggaucaccgacuuccccggcaagaccgugugguucguccccuccaucaagagcggcaacgacaucgccaacugccugcggaagaacgggaagcgcgugauccagcucucccggaagacguucgacaccgaguaccagaagaccaagaacaacgacugggacuacguggucaccacggacaucagcgagaugggcgccaacuuccgcgcggaccgggugaucgacccgcgccggugccugaagcccgugauccugaaggacgggcccgagcgcgucauccucgccggccccaugccggugaccgucgccuccgccgcccagcggcgcgggcggaucggccgcaaccacaacaaggagggcgaccaguacaucuacauggggcagccccugaacaacgacgaggaccacgcgcacuggaccgaggccaagaugcugcucgacaacaucaacacccccgagggcaucauccccgcccuguucgagccggagcgcgagaaguccgccgccaucgacggggaguaccggcugcgcggcgaggcgcggaagacguucguggagcucaugcgccgcggggaccugcccguguggcuguccuacaaggucgccagcgagggcuuccaguacagcgaccgccgguggugcuucgacggcgagcgcaacaaccaggugcucgaggagaacauggacguggagaucuggaccaaggagggggagcggaagaagcugcgcccccgguggcuggacgcccgcaccuacuccgacccccucgcccugcgggaguucaaggaguucgccgcgggccgccggagcgucuccggggaccugauccucgagaucggcaagcugccgcagcaccugacccagcgcgcccagaacgcccucgacaaccuggugaugcugcacaacagcgagcagggcgggcgggccuaccgccacgcgauggaggagcuccccgacacgaucgagacccugaugcugcucgcccugaucgccgugcugaccggcggggucacccucuucuuccuguccggccgggggcugggcaagaccagcaucggccuccugugcgugauggccuccagcgugcugcucuggauggccuccgucgagccccacuggaucgcggccagcaucauccuggaguucuuccugauggugcuccugauccccgagccggaccgccagcggacgccccaggacaaccagcuggccuacguggucaucgggcuccuguucaugauccugaccguggccgccaacgagaugggccuccuggagaccaccaagaaggaccuggggaucggccacguggcggucgagaaccaccaccacgccgccaugcucgacguggaccugcaccccgccuccgccuggacgcuguacgcgguggccaccaccaucaucaccccgaugaugcgccacacgaucgagaacaccaccgccaacaucagccucaccgccaucgccaaccaggcggccauccugauggggcuggacaagggcuggcccaucuccaagauggacaucggcgucccccuccuggcccuggggugcuacagccaggugaacccccucacgcugaccgccgcggugcugaugcucgucgcccacuacgccaucaucggcccggggcugcaggccaaggccacccgcgaggcgcagaagcggaccgccgccggcaucaugaagaaccccacgguggacgggaucguggccaucgaccuggaccccgucguguacgacgccaaguucgagaagcagcucggccagaucaugcugcugauccucugcaccucccagauccugcugaugcgcaccaccugggcgcucugcgagagcaucacgcuggccaccggcccccugaccacccucugggagggguccccgggcaaguucuggaacacgaccaucgccgugagcauggccaacaucuuccggggguccuaccuggccggcgcgggccuggccuucagccucaugaagucccucgggggcgggcgccgggggaccggggcccagggcgagacccugggcgagaaguggaagcgccagcucaaccagcuguccaagagcgaguucaacacguacaagcgguccgggaucauggaggucgaccgcagcgaggccaaggagggccugaagcgcggggagaccaccaagcacgcggugucccgcggcaccgccaagcuccggugguucguggagcgcaaccuggucaagcccgaggggaaggugaucgaccugggcugcggccgcgggggcuggagcuacuacugcgccgggcugaagaaggugacggaggucaagggcuacaccaagggcggccccggccacgaggagcccaucccgauggccaccuacggguggaaccucgugaagcugcacuccggcaaggacguguucuucaucccgcccgagaagugcgacacccugcucugcgacaucggggagagcucccccaacccgacgaucgaggagggccgcacccugcggguccugaagaugguggagcccuggcuccgcgggaaccaguucugcaucaagauccugaaccccuacaugcccagcguggucgagacccuggagcagaugcagcggaagcacggcggcaugcucgugcgcaacccgcugucccggaacagcacccacgagauguacuggguguccugcgggaccggcaacaucgucagcgccgugaacaugacgucccgcaugcugcucaaccgcuucaccauggcgcaccggaagcccaccuacgagcgcgacguggaccugggggccggcacccggcacgucgccguggagcccgagguggccaaccuggacaucaucggccagcgcaucgagaacaucaagcacgagcacaagagcacguggcacuacgacgaggacaaccccuacaagaccugggccuaccacggguccuacgaggucaagccgagcggcuccgcgagcagcauggugaacggggucgugaagcuccugaccaagcccugggacgugauccccauggucacccagaucgccaugacggacaccacccccuucggccagcagcggguguucaaggagaagguggacacccgcacgccgaaggccaagcgggggaccgcccagaucauggaggucaccgccaaguggcuguggggcuuccucucccgcaacaagaagccccggaucugcacccgcgaggaguucacgcggaaggugcgcagcaacgcggccaucggcgccguguucgucgacgagaaccaguggaacuccgccaaggaggcgguggaggacgagcgguucugggaccuggugcaccgcgagcgggagcugcacaagcaggggaagugcgcgaccugcgucuacaacaugaugggcaagcgcgagaagaagcucggggaguucggcaaggccaaggggagccgggccaucugguacauguggcugggcgcccgcuuccuggaguucgaggcgcucggcuucaugaacgaggaccacugguucucccgggagaacagccuguccgggguggagggcgaggggcugcacaagcucggcuacauccugcgcgacaucagcaagauccccgggggcaacauguacgccgacgacaccgccggcugggacacccggaucacggaggacgaccugcagaacgaggcccgcaucaccgacaucauggagccggagcacgcccuccuggcgcgcuccaucuucaagcugaccuaccagaacaaggugguccgggugcagcgccccgccaagaacgggaccgugauggacgucaucagccggcgcgaccagcggggcuccggccagguggggacguacggccucaacaccuucaccaacauggaggcccagcugauccgccagauggagagcgaggggaucuucucccccagcgagcuggagacccccaaccucgccgagcgggugcuggacuggcuggagaaguacggcgucgagcgccucaagcggauggccaucuccggggacgacugcguggugaagccgaucgacgaccgcuucgcgacggcccugaccgcccugaacgacaugggcaagguccggaaggacaucccccagugggagcccagcaagggguggaacgacuggcagcagguccccuucugcucccaccacuuccaccagcucaucaugaaggacggccgcgagaucguggucccgugccggaaccaggacgagcuggugggccgcgcccgggugagccagggggccggcuggagccugcgcgagaccgcgugccucgggaaguccuacgcccagauguggcagcugauguacuuccaccggcgcgaccugcggcucgccgccaacgcgaucugcagcgccguccccguggacuggauccccaccucccgcacgaccuggagcauccacgcccaccaccaguggaugaccaccgaggacaugcuguccguguggaaccgcgucuggaucgaggagaaccccuggauggaggacaagacgcacaucagcuccuggggcgacgugccguaccuggggaagcgggaggaccaguggugcggcagccucaucggccugaccgcccgcgccaccugggcgaccaacauccagguggccaucaaccagguccggcgccugaucgggaacgagaacuaccucgacuacaugaccuccaugaagcgguucaagaacgagagcgaccccgagggcgcccugugguga

SEQ ID NO: 8305 - RNA, 9879 nt, Artificial Sequence
  derived and/or modified CDS sequence (opt1) from DENV-1__EU677172__SS-prME
agcgugaccaugcugcugaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgagaccgagcccgacgacguggacugcuggugcaacgccaccgacaccugggugaccuacgggaccugcagccagacgggcgagcaccggcgggacaagcgguccguggcccucgcgccccacgugggccuggggcuggagacccgcaccgagaccuggaugagcuccgagggcgccuggaagcagauccagcgggucgagacgugggcccuccggcaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagcuggccgagacccagcacggcaccgugcuggugcagaucaaguacgagggcaccgacgcgcccugcaagauccccuucagcacgcaggacgagaagggggucacccagaacggccggcugaucaccgccaacccgaucgugaccgacaaggagaagcccgugaacaucgaggccgagccgcccuucggggaguccuacaucgucaucggcgccggcgagaaggcgcucaagcugagcugguucaagaagggguccagcaucggcaagauguucgaggccacggcccgcggggcccggcgcauggccauccugggcgacaccgcgugggacuucggguccaucggcggcguguucaccagcguggggaagcucguccaccagaucuucggcaccgccuacggggugcuguucuccggcgugagcuggacgaugaagaucgggaucggcguccugcucaccuggcugggccugaacucccgcagcaccucccucagcaugaccugcaucgccguggggcuggugacgcuguaccucggcgucauggugcaggccgacuccgggugcgugaucaacuggaagggccgggagcugaagugcgggagcggcaucuucgucaccaacgaggugcacaccuggaccgagcaguacaaguuccaggccgacagcccgaagcgccuguccgcggccaucggcaaggccugggaggagggggugugcggcauccggagcgccacccgccucgagaacaucauguggaagcagaucuccaacgagcugaaccacauccugcucgagaacgacaugaaguucacggucguggugggggacgucgccggcauccuggcgcaggggaagaagaugauccggccccagcccauggaguacaaguacagcuggaaguccuggggcaaggccaagaucaucggcgccgacgcccagaacaccaccuucaucaucgacgggcccaacaccccggagugccccgacgaccagcgcgcguggaacaucugggagguggaggacuacggcuucgggaucuucacgaccaacaucuggcugaagcuccgggacagcuacacccaggugugcgaccaccgccugauguccgccgccaucaaggacagcaaggccguccacgccgacaugggcuacuggaucgaguccgagaagaacgagaccuggaagcuggcgcgggccagcuucaucgaggugaagacgugcaucuggcccaagucccacacccucuggagcaacggcgugcuggaguccgagaugaucauccccaagaucuacgggggcccgaucagccagcacaacuaccgccccggguacuucacccagaccgccggccccuggcaccuggggaagcucgagcuggacuucgaccugugcgagggcacgaccgucgugguggacgagcacugcggcaaccgggggccgucccuccgcaccaccacggucaccggcaagaucauccacgaguggugcugccggagcugcacccugccgccccugcgcuuccgcggggaggacggcugcugguacgggauggagauccgccccgugaaggagaaggaggagaaccucgugaaguccauggucagcgccggcagcggcgagguggacuccuucagccuggggcugcucugcaucuccaucaugaucgaggaggugaugcggagccgcuggucccggaagaugcugaugaccggcacgcuggccgucuucuuccuccugaccauggggcagcugaccuggaacgaccucauccgccugugcaucauggugggcgcgaacgccagcgaccgcauggggaugggcaccacguaccuggcccucauggccaccuucaagaugcggccgauguucgccgugggccugcuguuccgccggcucaccucccgcgagguccugcugcucaccaucgggcugagccugguggcguccguggagcuccccaacagccuggaggagcugggcgacgggcucgccaugggcaucaugauccugaagcugcucacggacuuccagucccaccagcugugggccacccugcucagccugaccuucaucaagaccacguucucccugcacuacgccuggaagaccauggcgaugguccucagcaucgugucccuguucccccugugccucagcaccaccucccagaagacgaccuggcugcccguccugcucggcagccuggggugcaagccgcugaccauguuccucaucgccgagaacaagaucuggggccggcgcuccuggccccugaacgaggggaucauggccgugggcaucgugagcauccugcucagcucccugcugaagaacgacgucccccucgccgggccccugaucgccggcggcaugcugaucgcgugcuacgugaucagcggguccagcgccgaccucucccuggagaaggccgccgaggugagcugggaggaggaggccgagcacuccggcgcgagccacaacauccuggucgaggugcaggacgacgggaccaugaagaucaaggacgaggagcgggacgacacccucacgauccugcugaaggccacccuccuggccguguccggcgucuacccgcugagcauccccgccacccucuucgugugguacuucuggcagaagaagaagcagcgcuccggggugcugugggacacccccagcccgcccgaggucgagcgggccgugcuggacgacggcaucuaccgcaucaugcagcggggccugcucgggcgcucccaggugggcgucgggguguuccaggagaacguguuccacacgauguggcacgucacccggggcgcggugcugauguaccaggggaagcgccuggagcccagcugggccuccgugaagaaggaccucaucagcuacggcggcggguggcggcugcagggcuccuggaacaccggggaggagguccaggugaucgccguggagcccggcaagaaccccaagaacguccagaccgcccccgggacguucaagacccccgagggcgaggugggcgccaucgcgcuggacuucaagcccgggaccagcggcucccccaucgugaaccgcgaggggaagaucgucggccucuacggcaacgggguggugaccacgagcggcaccuacgucagcgccaucgcccaggccaaggcgucccaggaggggccgcugcccgagaucgaggacgagguguuccggaagcgcaaccugaccaucauggaccuccaccccggcagcgggaagacccggcgcuaccugccggccaucgugcgggaggccaucaagcgcaagcugcgcacgcucauccuggcccccacccgggucguggccuccgagauggcggaggcccugaagggcaugcccauccgcuaccagaccaccgccgucaagagcgagcacacgggcaaggagaucgucgaccucaugugccacgccaccuucaccaugcggcugcugucccccgugcgcgugccgaacuacaacaugaucaucauggacgaggcccacuucaccgaccccagcuccaucgcggcccggggguacaucagcacgcgcgucggcaugggggaggccgccgccaucuucaugaccgcgacgccgcccggcuccguggaggccuucccgcagagcaacgccgugauccaggacgaggagcgggacauccccgagcgcuccuggaacagcggguacgaguggaucaccgacuuccccggcaagacggucugguucgugcccuccaucaagagcggcaacgacaucgccaacugccuccggaagaacgggaagcgcgugauccagcugucccggaagaccuucgacaccgaguaccagaagaccaagaacaacgacugggacuacgucgugacgaccgacaucagcgagaugggcgcgaacuuccgcgccgaccgggugaucgacccgcgccggugccugaagcccgucauccucaaggacgggcccgagcgcgugauccuggccggccccaugccggugaccgucgccuccgccgcgcagcggcgcgggcggaucggccgcaaccacaacaaggagggcgaccaguacaucuacauggggcagccccugaacaacgacgaggaccacgcccacuggaccgaggccaagaugcuccuggacaacaucaacacgcccgagggcaucauccccgcccuguucgagccggagcgcgagaaguccgccgcgaucgacggggaguaccggcuccgcggcgaggcccggaagaccuucguggagcugaugcgccgcggggaccugcccgucuggcucuccuacaagguggccagcgagggcuuccaguacagcgaccgccgguggugcuucgacggcgagcgcaacaaccaggugcuggaggagaacauggacgucgagaucuggaccaaggagggggagcggaagaagcugcgcccccgguggcucgacgcccgcaccuacuccgacccccuggcccugcgggaguucaaggaguucgcggccggccgccggagcguguccggggaccucauccuggagaucggcaagcugccgcagcaccucacgcagcgcgcccagaacgcccuggacaaccuggugaugcuccacaacagcgagcagggcgggcgggcguaccgccacgccauggaggagcugcccgacaccaucgagacccugaugcuccuggcccugaucgccguccucaccggcggggugacccuguucuuccuguccggccgggggcucggcaagacgagcaucggccugcugugcgugauggccuccagcguccuccuguggauggcguccguggagccccacuggaucgccgccagcaucauccuggaguucuuccucauggugcugcugauccccgagccggaccgccagcggacgccccaggacaaccagcucgccuacgucgugaucgggcugcuguucaugauccucaccguggccgcgaacgagaugggccugcuggagaccacgaagaaggaccucgggaucggccacgucgccguggagaaccaccaccacgccgccaugcuggacguggaccugcaccccgccuccgcguggacccucuacgccgucgccaccaccaucaucacgccgaugaugcgccacaccaucgagaacaccaccgccaacaucagccugacggccaucgcgaaccaggccgccauccugauggggcucgacaagggcuggcccaucuccaagauggacaucggcgugccccugcuggcccucgggugcuacagccaggugaacccccugacccugaccgcggccguccucaugcugguggcccacuacgccaucaucggcccggggcugcaggccaaggcgacccgcgaggcccagaagcggacggccgccggcaucaugaagaaccccaccguggacgggaucgucgccaucgaccucgaccccgugguguacgacgcgaaguucgagaagcagcugggccagaucaugcugcucauccugugcaccucccagauccugcucaugcgcaccacgugggcccugugcgagagcaucacccuggccaccggcccccucaccacgcugugggagggguccccgggcaaguucuggaacaccaccaucgccgucagcauggccaacaucuuccggggguccuaccuggcgggcgccggccucgccuucagccugaugaagucccucgggggcgggcgccgggggaccggggcccagggcgagacgcucggcgagaaguggaagcgccagcugaaccagcuguccaagagcgaguucaacaccuacaagcgguccgggaucauggagguggaccgcagcgaggcgaaggagggccucaagcgcggggagaccaccaagcacgccgugucccgcggcacggccaagcugcggugguucgucgagcgcaaccuggugaagcccgaggggaaggugaucgaccugggcugcggccgcgggggcuggagcuacuacugcgccgggcucaagaaggucaccgaggugaagggcuacaccaagggcggccccggccacgaggagcccaucccgauggccaccuacggguggaaccuggugaagcugcacuccggcaaggacgucuucuucaucccgcccgagaagugcgacacgcuccugugcgacaucggggagagcucccccaacccgaccaucgaggagggccgcacccugcgggugcucaagaugguggagcccuggcugcgcgggaaccaguucugcaucaagauccugaaccccuacaugcccagcgucguggagacccucgagcagaugcagcggaagcacggcggcaugcuggugcgcaacccgcugucccggaacagcacccacgagauguacugggucuccugcgggacgggcaacaucgugagcgcggugaacaugaccucccgcaugcuccugaaccgcuucaccauggcccaccggaagcccaccuacgagcgcgacgucgaccugggggccggcacgcggcacguggccguggagcccgaggucgccaaccucgacaucaucggccagcgcaucgagaacaucaagcacgagcacaagagcaccuggcacuacgacgaggacaaccccuacaagaccugggcguaccacggguccuacgaggugaagccgagcggcuccgccagcagcauggugaacggggucgugaagcugcugaccaagcccugggacgucauccccauggugacgcagaucgccaugaccgacaccacccccuucggccagcagcggguguucaaggagaaggucgacacgcgcaccccgaaggccaagcgggggaccgcccagaucauggaggugaccgcgaaguggcucuggggcuuccugucccgcaacaagaagccccggaucugcacgcgcgaggaguucacccggaaggugcgcagcaacgccgccaucggcgccgucuucguggacgagaaccaguggaacuccgcgaaggaggccguggaggacgagcgguucugggaccugguccaccgcgagcgggagcuccacaagcaggggaagugcgcgaccugcguguacaacaugaugggcaagcgcgagaagaagcugggggaguucggcaaggccaaggggagccgggccaucugguacauguggcugggcgcgcgcuuccucgaguucgaggcccugggcuucaugaacgaggaccacugguucucccgggagaacagccuguccgggguggagggcgaggggcuccacaagcugggcuacauccugcgcgacaucagcaagauccccgggggcaacauguacgccgacgacaccgccggcugggacacgcggaucaccgaggacgaccuccagaacgaggcccgcaucaccgacaucauggagccggagcacgcgcugcuggccaaguccaucuucaagcucaccuaccagaacaaggucgugcgcgugcagcggcccgccaagaacgggacggucauggacgugaucagccgccgggaccagcgcggcuccggccagguggggaccuacggccugaacaccuucaccaacauggaggcccagcugauccggcagauggagagcgaggggaucuucucccccagcgagcucgagacgcccaaccuggccgagcgcguccuggacuggcucgagaaguacggcguggagcggcugaagcgcauggcgaucuccggggacgacugcguggucaagccgaucgacgaccgguucgccaccgcccugaccgcccucaacgacaugggcaaggugcgcaaggacaucccccagugggagcccagcaagggguggaacgacuggcagcagguccccuucugcucccaccacuuccaccagcugaucaugaaggacggccgggagaucgucgugccgugccgcaaccaggacgagcuggugggccgggcccgcgucagccagggggcgggcuggagccuccgggagaccgccugccuggggaaguccuacgcccagauguggcagcugauguacuuccaccgccgggaccuccgccuggccgcgaacgccaucugcagcgccgugcccguggacuggauccccacgucccggaccaccuggagcauccacgcccaccaccaguggaugaccacggaggacaugcuguccgucuggaaccgcguguggaucgaggagaaccccuggauggaggacaagacccacaucagcuccuggggcgacgugccguaccucgggaagcgcgaggaccaguggugcggcagccugaucggccugaccgcccgggcgaccugggccaccaacauccaggucgccaucaaccaggugcgccggcucaucgggaacgagaacuaccuggacuacaugacguccaugaagcgcuucaagaacgagagcgaccccgagggcgcccugugguga

SEQ ID NO: 8306 - RNA, 9879 nt, Artificial Sequence
  derived and/or modified CDS sequence (opt1) from DENV-1__EU677173__SS-prME
agcgugaccaugcugcucaugcugaugcccaccgcccuggccuuccaccucaccacccggggcggggagccccacaugaucgugaccaagcaggagcggggcaagagccugcuguucaagaccagcgcgggggugaacaugugcacccucaucgccauggaccugggggagcugugcgaggacaccaugaccuacaagugcccccggaucaccgaggccgagcccgacgacguggacugcuggugcaacgccaccgacaccugggugaccuacgggaccugcucccagacgggggagcaccggcgcgacaagcggagcguggcccucgcgccccacgugggccuggggcuggagacccgcaccgagaccuggauguccagcgagggcgccuggaagcagauccagcgggucgagacgugggcccuccgccaccccggguucaccgugaucgcccuguuccuggcgcacgccaucggcaccuccaucacccagaaggggaucaucuucauccuccugaugcuggugacgcccagcauggccaugcggugcgucggcaucggcucccgcgacuucguggaggggcucagcggcgccaccuggguggacgucgugcuggagcacggguccugcgugaccaccauggccaaggacaagcccacgcuggacaucgagcuccugaagaccgaggucaccaaccccgcggugcugcggaagcucugcaucgaggccaagaucagcaacaccacgaccgacucccgcugccccacccagggcgaggccacccugauggaggagcaggacgccaacuucgugugccggcgcacguucgucgaccggggcugggggaacggcugcgggcuguucggcaaggggagccucaucacgugcgccaaguucaagugcgugaccaagcuggagggcaagaucgugcaguacgagaaccugaaguacuccgucaucgugaccgugcacacgggcgaccagcaccaggucgggaacgagagcaccgagcacggcaccaccgcgaccaucacgccccaggcccccaccuccgagauccagcucaccgacuacggggcccugacccuggacugcagcccccgcacgggccucgacuucaacgagauggugcugcugaccaugaaggagaaguccuggcucguccacaagcagugguuccuggaccugccgcuccccuggaccagcggggccaccacgagccaggagaccuggaaccggcaggaccugcuggugaccuucaagaccgcccacgcgaagaagcaggagguggucgugcucggcucccaggagggcgccaugcacacggcccugaccggggccaccgagauccagaccagcggcacgaccaccaucuucgccgggcaccugaagugccgccucaagauggacaagcugacccugaagggcauguccuacgugaugugcacggggagcuucaagcucgagaaggaggucgcggagacccagcacggcaccgugcuggugcagaucaaguacgagggcaccgacgcccccugcaagauccccuucuccacgcaggacgagaagggggucacccagaacggccggcugaucaccgccaacccgaucgugaccgacaaggagaagcccgugaacaucgaggccgagccgcccuucggggagagcuacaucgucaucggcgcgggcgagaaggcccugaagcucuccugguucaagaaggggagcuccaucggcaagauguucgaggccacggcccgcggggcccggcgcauggcgauccugggcgacaccgccugggacuucgggagcaucggcggcguguucaccuccguggggaagcugguccaccagaucuucggcaccgccuacgggguccuguucagcggcguguccuggacgaugaagaucgggaucggcguccugcugaccuggcucggccugaacagccgcuccaccagccuguccaugaccugcaucgccguggggcucgugacgcuguaccugggcgucauggugcaggccgacagcgggugcgugaucaacuggaagggccgggagcucaagugcggguccggcaucuucgucaccaacgaggugcacaccuggaccgagcaguacaaguuccaggcggacagcccgaagcgccugagcgccgccaucggcaaggccugggaggagggggugugcggcauccgguccgccacccgccuggagaacaucauguggaagcagaucagcaacgagcucaaccacauccugcuggagaacgacaugaaguucacggucguggugggggacgucgugggcauccucgcgcaggggaagaagaugauccggccccagcccauggagcacaaguacuccuggaaguccuggggcaaggccaagaucaucggcgccgacgugcagaacaccaccuucaucaucgacgggcccaacaccccggagugccccgacgaccagcgcgccuggaacaucugggaggucgaggacuacggcuucgggaucuucacgaccaacaucuggcugaagcugcgggacuccuacacccagaugugcgaccaccgccucaugagcgcggccaucaaggacuccaaggccgugcacgccgacaugggcuacuggaucgagagcgagaagaacgagaccuggaagcuggcccgggcguccuucaucgaggugaagacgugcaucuggcccaagagccacacccugugguccaacggcguccucgagagcgagaugaucauccccaagaucuacgggggcccgaucucccagcacaacuaccgccccggguacuucacccagaccgccggccccuggcaccuggggaagcuggagcucgacuucgaccugugcgagggcacgaccgugguggucgacgagcacugcggcaaccgggggccgagccugcgcaccaccacggugaccggcaagaucauccacgaguggugcugccgguccugcacccugccgccccuccgcuucaagggggaggacggcugcugguacgggauggagauccggcccgugaaggagaaggaggagaaccuggucaagagcaugguguccgccggcagcggcgagguggacagcuucucccucgggcugcugugcaucagcaucaugaucgaggaggucaugcgcucccgguggagccgcaagaugcucaugaccggcacgcuggccguguuccugcuccugaucauggggcagcugaccuggaacgaccucauccggcugugcaucauggugggcgccaacgcguccgaccgcauggggaugggcaccaccuaccuggcccucauggccacguucaagaugcgcccgauguucgccgucggccugcuguuccggcgccucaccagccgggaggugcugcugcucaccaucgggcugucccugguggccagcgucgagcuccccaacucccuggaggagcugggcgacgggcucgcgaugggcaucaugauccugaagcugcucaccgacuuccagagccaccagcugugggccacgcugcucucccugaccuucaucaagaccacccugagccuccacuacgccuggaagacgauggccauggugcuguccaucgucagccuguucccccucugccuguccaccaccagccagaagaccacguggcugcccgugcuccugggcucccuggggugcaagccgcucaccauguuccugaucaccgagaacaagaucuggggccgcaagagcuggccccugaacgaggggaucauggcggugggcgucguguccauccuccugagcagccugcucaagaacgacgugccccuggccgggccccugaucgccggcggcaugcucaucgccugcuacgucaucuccgggagcuccgccgaccugagccuggagaaggcggccgagguguccugggaggaggaggccgagcacagcggcgccucccacaacauccucguggagguccaggacgacgggaccaugaagaucaaggacgaggagcgggacgacacccugacgauccugcucaaggccacccugcuggcggugagcggcguguacccgcucuccauccccgccacccuguucgucugguacuucuggcagaagaagaagcagcgcagcggggugcugugggacacccccagcccgcccgagguggagcgggccguccuggacgacggcaucuaccgcaucaugcagcggggccuccuggggcgcagccaggugggcgugggggucuuccaggagaacguguuccacacgauguggcacgugacccggggcgccguccugauguaccaggggaagcgccucgagcccuccugggccagcgugaagaaggaccugaucuccuacggcggcggguggcggcugcagggcagcuggaacgcgggggaggaggugcaggucaucgccguggagcccggcaagaaccccaagaacgugcagaccgcccccgggaccuucaagacgcccgagggcgaggucggcgccaucgcccucgacuucaagcccgggaccuccggcagccccaucgugaaccgcgaggggaagaucgugggccuguacggcaacggggucgugaccaccuccggcacguacgugagcgcgaucgcccaggccaaggccagccaggaggggccgcugcccgagaucgaggacgaggucuuccggaagcgcaaccucaccaucauggaccugcaccccggcuccgggaagacccggcgcuaccugccggcgaucgugcgggaggccaucaagcgcaagcuccggacccugauccuggcccccacgcgcguggucgccagcgagauggccgaggcgcucaagggcaugcccauccgcuaccagaccaccgccgugaaguccgagcacaccggcaaggagaucguggaccugaugugccacgccacguucaccaugcggcugcucagccccguccgcgugccgaacuacaacaugaucaucauggacgaggcccacuucaccgaccccuccagcaucgccgcgcggggguacaucuccacccgcgugggcaugggggaggccgccgccaucuucaugacggccacgccgcccggcagcgucgaggcguucccgcaguccaacgccgugauccaggacgaggagcgggacauccccgagcgcagcuggaacuccggguacgaguggaucaccgacuuccccggcaagaccgugugguucguccccagcaucaaguccggcaacgacaucgccaacugccugcggaagaacgggaagcgcgugauccagcugagccggaagacguucgacaccgaguaccagaagaccaagaacaacgacugggacuacguggucaccacggacaucuccgagaugggcgccaacuuccgcgcggaccgggugaucgacccgcgccggugccucaagcccgugauccugaaggacgggcccgagcgcgucauccuggccggccccaugccggugaccgucgccagcgccgcccagcggcgcgggcggaucggccgcaaccacaacaaggagggcgaccaguacaucuacauggggcagccccucaacaacgacgaggaccacgcgcacuggaccgaggccaagaugcugcuggacaacaucaacacccccgagggcaucauccccgcccucuucgagccggagcgggagaaguccgccgccaucgacggggaguaccgccugcgcggcgaggcgcggaagacguucguggagcugaugcgccgcggggaccuccccguguggcugagcuacaaggucgccuccgagggcuuccaguacagcgaccgccgguggugcuucgacggcgagcgcaacaaccaggugcuggaggagaacauggacguggagaucuggaccaaggagggggagcggaagaagcuccgcccccgguggcuggacgcccgcaccuacagcgacccccuggcccuccgggaguucaaggaguucgccgcgggccgccgguccgucagcggggaccugauccuggagaucggcaagcucccgcagcaccugacccagcgcgcccagaacgcccuggacaaccucgugaugcugcacaacuccgagcagggcgggcgggccuaccgccacgcgauggaggagcugcccgacacgaucgagacccucaugcugcuggcccucaucgccgugcugaccggcggggucacccuguucuuccucagcggccgggggcugggcaagaccuccaucggccugcucugcgugauggccagcuccgugcugcuguggauggccagcgucgagccccacuggaucgcggccuccaucauccucgaguucuuccugauggugcugcucauccccgagccggaccgccagcggacgccccaggacaaccagcuggccuacguggucaucgggcuccucuucaugauccugaccguggccgccaacgagaugggccugcucgagaccaccaagaaggaccuggggaucggccacguggcggucgagaaccaccaccacgccacgaugcuggacguggaccuccaccccgccagcgccuggacccuguacgccguggcgaccaccaucaucacgccgaugaugcgccacaccaucgagaacaccaccgccaacaucucccugacggccaucgccaaccaggccgcgauccucauggggcuggacaagggcuggcccaucagcaagauggacaucggcgucccccugcucgcccuggggugcuacucccaggugaacccccugacccucaccgccgccgugcugaugcuggucgcgcacuacgccaucaucggcccggggcuccaggccaaggccacccgggaggcccagaagcgcacggcggccggcaucaugaagaaccccaccguggacgggaucguggccaucgaccuggaccccgucguguacgacgccaaguucgagaagcagcugggccagaucaugcuccugauccugugcaccagccagauccuccugaugcgcaccacgugggcccugugcgaguccaucacccucgcgaccggcccccugaccacgcugugggaggggagcccgggcaaguucuggaacaccaccaucgccguguccauggccaacaucuuccgggggagcuaccucgccggcgccggccuggcguucucccugaugaagucccucgggggcgggcgccggggcaccggggcccagggcgagacgcugggcgagaaguggaagcgccagcugaaccagcucagcaaguccgaguucaacaucuacaagcggagcgggaucauggaggucgaccgcuccgaggccaaggagggccugaagcgcggggagaccacccgccacgccgugagccggggcaccgcgaagcugcgcugguucguggagcggaaccuggucaagcccgaggggaaggugaucgaccucggcugcggccgcgggggcugguccuacuacugcgccgggcugaagaaggugacggaggucaagggcuacaccaagggcgggcccggccacgaggagcccaucccgauggccaccuacggguggaaccuggugaagcuccacagcggcaaggacguguucuucacgccgcccgagaagugcgacacgcugcugugcgacaucggggaguccagccccaacccgaccaucgaggagggccggacccuccgcguccugaagaugguggagcccuggcugcgggggaaccaguucugcaucaagauccucaaccccuacaugcccuccguggucgagacccuggagcagaugcagcgcaaguacggcggcaugcuggugcggaacccgcucagccgcaacuccacccacgagauguacugggugagcugcgggacgggcaacaucgucuccgccgugaacaugaccagccggaugcugcugaaccgcuucaccauggcccaccgcaagcccaccuacgagcgggacguggaccucggggcgggcacgcgccacgucgccguggagcccgagguggccaaccuggacaucaucggccagcggaucgagaacaucaagcacgagcacaaguccaccuggcacuacgacgaggacaaccccuacaagaccugggccuaccacgggagcuacgaggucaagccguccggcagcgccuccagcauggugaacggggucgugaagcugcucaccaagcccugggacgugauccccauggucacgcagaucgcgaugaccgacaccacccccuucggccagcagcgcguguucaaggagaagguggacacgcggaccccgaaggccaagcgcgggaccgcccagaucauggaggucaccgcccgguggcuguggggcuuccugagccgcaacaagaagccccggaucugcacgcgcgaggaguucacccggaaggugcgcuccaacgccgcgaucggcgccguguucgucgacgagaaccaguggaacagcgccaaggaggccguggaggacgagcgguucugggaccucgugcagaaggagcgcgagcugcacaagcaggggaagugcgcgaccugcgucuacaacaugaugggcaagcgggagaagaagcugggggaguucggcaaggccaaggggucccgcgccaucugguacauguggcucggcgcccgguuccuggaguucgaggcccugggcuucaugaacgaggaccacugguucagccgcgagaacucccucagcgggguggagggcgaggggcugcacaagcugggcuacauccuccgggacaucuccaagauccccgggggcaacauguacgcggacgacaccgccggcugggacacgcgcaucaccgaggacgaccugcagaacgaggccaagaucaccgacaucauggagccggagcacgcccugcucgccaccagcaucuucaagcugacguaccagaacaaggugguccgggugcagcgccccgcgaagaacgggaccgugauggacgucaucucccgccgggaccagcgcggcagcggccaggugggcaccuacggccugaacaccuucacgaacauggaggcccagcucauccggcagauggaguccgaggggaucuuccugcccagcgagcuggagacccccaaccucgccgagcgcgugcuggacuggcuggagaaguacggcgucgagcggcucaagcgcauggccaucuccggggacgacugcguggugaagccgaucgacgaccgguucgccaccgcgcugaccgcccugaacgacaugggcaagguccgcaaggacaucccccagugggagcccagcaagggguggaacgacuggcagcagguccccuucugcucccaccacuuccaccagcucaucaugaaggacggccgggagaucguggucccgugccgcaaccaggacgagcuggugggccgggcccgcgugagccagggggccggcuggucccugcgggagacggccugccucggcaagagcuacgcgcagauguggcagcugauguacuuccaccgccgggaccugcgccucgccgccaacgccaucugcagcgcgguccccguggacugggugcccaccucccggaccaccuggagcauccacgcccaccaccaguggaugacgaccgaggacaugcuguccgucuggaaccgcguguggaucgaggagaaccccuggauggaggacaagacccacgugagcuccuggggcgacgucccguaccuggggaagcgggaggaccaguggugcggcagccucaucggccugaccgcccgcgccaccugggccuccaacauccagguggcgaucaaccaggugcgccggcugaucgggaacgagaacuaccucgacuacaugacgagcaugaagcgcuucaagaacgagggcgaccccgagggggcccugugguga

SEQ ID NO: 8307 - RNA, 9879 nt, Artificial Sequence
  derived and/or modified CDS sequence (opt1) from DENV-1__EU726779__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgagaccgagcccgacgacguggacugcuggugcaacgccacggacaccugggugaccuacgggaccugcagccagacgggcgagcaccggcgcgacaagcgguccguggcccucgcgccccacgugggccuggggcuggagacccgcaccgagaccuggaugagcuccgagggcgccuggaagcagauccagcggguggagacgugggcccuccgccaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagguggccgagacccagcacggcaccgugcugguccagaucaaguacgagggcaccgacgcgcccugcaagauccccuucagcacgcaggacgagaagggggugacccagaacggccggcugaucaccgccaacccgaucgugaccgacaaggagaagcccgucaacaucgaggccgagccgcccuucggggaguccuacaucgugaucggcgccggcgagaaggcgcugaagcucagcugguucaagaagggguccagcaucggcaagauguucgaggccacggcccgcggggcccggcgcauggccauccugggcgacaccgcgugggacuucggguccaucggcggcguguucaccagcgucgggaagcuggugcaccagaucuucggcaccgccuacgggguccuguucuccggcgucagcuggacgaugaagaucgggaucggcgugcugcugaccuggcucggccugaacucccgcagcaccuccuucagcaugaccugcaucgccguggggcuggucacgcucuaccugggcgugauggugcaggccgacuccgggugcgucaucaacuggaagggccgggagcugaagugcgggagcggcaucuucgugaccaacgaggugcacaccuggaccgagcaguacaaguuccaggccgacagcccgaagcgccucuccgcggccaucggcaaggccugggaggagggggucugcggcauccggagcgccacccgccuggagaacaucauguggaagcagaucuccaacgagcugaaccacauccuccuggagaacgacaugaaguucacggugguggucggggacguggccggcauccuggcgcaggggaagaagaugauccggccccagcccauggaguacaaguacagcuggaaguccuggggcaaggccaagaucaucggcgccgacgugcagaacaccaccuucaucaucgacgggcccaacaccccggagugccccgacgaccagcgcgccuggaacaucugggaggucgaggacuacggcuucgggaucuucacgaccaacaucuggcucaagcugcgggacagcuacacccaggugugcgaccaccgccugauguccgcggccaucaaggacagcaaggccgugcacgccgacaugggcuacuggaucgaguccgagaagaacgagaccuggaagcucgcccgggcgagcuucaucgaggucaagacgugcaucuggcccaagucccacacccuguggagcaacggcgugcuggaguccgagaugaucauccccaagaucuacgggggcccgaucagccagcacaacuaccgccccggguacuucacccagaccgccggccccuggcaccucgggaagcuggagcuggacuucgaccucugcgagggcacgaccguggucguggacgagcacugcggcaaccgggggccgucccugcgcaccaccacggugaccggcaagaucauccacgaguggugcugccggagcugcacccugccgccccugcgcuuccgcggggaggacggcugcugguacgggauggagauccgccccgucaaggagaaggaggagaaccuggugaaguccauggugagcgccggcagcggcgaggucgacuccuucagccuggggcuccugugcaucuccaucaugaucgaggaggugaugcggagccgcuggucccggaagaugcugaugaccggcacgcucgccguguucuuccugcugaucauggggcagcucaccuggaacgaccugauccgccugugcaucauggucggcgccaacgcgagcgaccgcauggggaugggcaccaccuaccucgcccugauggccacguucaagaugcggccgauguucgccguggggcuccucuuccgccggcugaccucccgcgaggugcugcuccugaccaucgggcugagccucgucgccuccguggagcugcccaacagccuggaggagcucggcgacgggcuggcgaugggcaucaugauccugaagcuccugaccgacuuccagucccaccagcugugggccacgcuccugagccugaccuucaucaagaccaccuucucccuccacuacgccuggaagacgauggccaugguccugagcaucgugucccuguucccccucugccugagcaccaccucccagaagaccacguggcugcccgugcuccugggcagccuggggugcaagccgcucaccauguuccugaucgcggagaacaagaucuggggccggcgcuccuggccccugaacgaggggaucauggccgucggcaucgugagcauccuccugagcucccugcucaagaacgacgugccccuggccgggccccugaucgccggcggcaugcucaucgccugcuacgucaucagcggguccagcgcggaccugucccuggagaaggccgccgaggugagcugggaggaggaggccgagcacuccggcgccagccacaacauccucguggagguccaggacgacgggaccaugaagaucaaggacgaggagcgggacgacacccugaccauccugcucaaggcgacgcugcuggccguguccggcguguacccgcucagcauccccgccacccuguucgucugguacuucuggcagaagaagaagcagcgcuccggggugcugugggacacccccagcccgcccgaggugggccgggccguccucgacgacggcaucuaccgcaucaugcagcgggggcugcugggccgcucccaggugggggugggcgucuuccaggagaacguguuccacaccauguggcacgugacgcgcggggccguccugauguaccagggcaagcgccucgagcccagcugggcguccgugaagaaggaccugaucagcuacggcgggggcuggcggcugcagggguccuggaacaccggcgaggaggugcaggucaucgccguggagcccgggaagaaccccaagaacgugcagaccgcccccggcaccuucaagacgcccgagggcgaggucggggccaucgcccucgacuucaagcccggcaccagcgggucccccaucgugaaccgcgagggcaagaucgugggccuguacgggaacggcgucgugaccaccagcgggacguacgugagcgcgaucgcccaggccaaggccucccaggagggcccgcugcccgagaucgaggacgaggucuuccggaagcgcaaccucaccaucauggaccugcaccccgggagcggcaagacccggcgcuaccugccggcgaucgugcgggaggccaucaagcgcaagcuccgcacccugauccuggcccccacgcggguggucgccuccgagauggccgaggcgcucaagggcaugcccauccgcuaccagaccaccgccgucaagagcgagcacaccgggaaggagaucguggaccugaugugccacgccacguucaccaugcggcugcucucccccguccgcgugccgaacuacaacaugaucaucauggacgaggcccacuucaccgaccccagcuccaucgccgcgcggggcuacaucagcacccgcguggggaugggcgaggccgccgccaucuucaugacggccacgccgcccggguccgucgaggcguucccgcagagcaacgccgugauccaggacgaggagcgggacauccccgagcgcuccuggaacagcggcuacgaguggaucaccgacuuccccggcaagaccgugugguucguccccuccaucaagagcgggaacgacaucgccaacugccugcggaagaacggcaagcgcgugauccagcugucccggaagacguucgacaccgaguaccagaagaccaagaacaacgacugggacuacguggucaccacggacaucagcgagaugggggccaacuuccgcgcggaccgggugaucgacccgcgccggugccucaagcccgugauccugaaggacggccccgagcgcgucauccuggccgggcccaugccggugaccgucgccuccgccgcccagcggcgcggccggaucggccgcaaccacaacaaggagggggaccaguacaucuacaugggccagccccucaacaacgacgaggaccacgcgcacuggaccgaggccaagaugcugcuggacaacaucaacacccccgaggggaucauccccgcccucuucgagccggagcgcgagaaguccgccgccaucgacggcgaguaccggcugcgcggggaggcgcggaagacguucguggagcugaugcgccggggcgaccuccccguguggcuguccuacaaggucgccagcgagggcuuccaguacagcgaccgccgguggugcuucgacggggagcgcaacaaccaggugcuggaggagaacauggacguggagaucuggaccaaggagggcgagcggaagaagcuccgcccccgguggcuggacgcccgcaccuacuccgacccccuggcccuccgggaguucaaggaguucgccgcggggcgccggagcgucuccggcgaccugauccuggagaucggcaagcucccgcagcaccugacccagcgcgcccagaacgcccuggacaaccucgugaugcugcacaacagcgagcagggcgggcgggccuaccgccacgcgauggaggagcugcccgacacgaucgagacccucaugcugcuggcccucaucgccgugcugaccgggggcgucacccuguucuuccucuccgggcggggccugggcaagaccagcaucgggcugcucugcgugauggccuccagcgugcugcuguggauggccuccgucgagccccacuggaucgcggccagcaucauccucgaguucuuccugauggugcugcucauccccgagccggaccgccagcggacgccccaggacaaccagcuggccuacguggucaucggccuccucuucaugauccugaccguggccgccaacgagauggggcugcucgagaccaccaagaaggaccugggcaucgggcacguggcggucgagaaccaccaccacgccgccaugcuggacguggaccuccaccccgccuccgccuggacgcuguacgcgguggccaccaccaucaucaccccgaugaugcgccacacgaucgagaacaccaccgccaacaucagccugaccgccaucgccaaccaggcggccauccucaugggccuggacaagggcuggcccaucuccaagauggacaucggggucccccugcucgcccugggcugcuacagccaggugaacccccugacgcucaccgccgcggugcugaugcuggucgcccacuacgccaucaucgggccgggccuccaggccaaggccacccgcgaggcgcagaagcggaccgccgccgggaucaugaagaaccccacgguggacggcaucguggccaucgaccuggaccccgucguguacgacgccaaguucgagaagcagcugggccagaucaugcuccugauccugugcaccucccagauccuccugaugcgcaccaccugggcgcugugcgagagcaucacgcucgccaccgggccccugaccacccugugggagggcuccccggggaaguucuggaacacgaccaucgccgugagcauggccaacaucuuccggggcuccuaccucgccggcgcggggcuggccuucagccugaugaagucccucggcgggggccgccgggggaccggcgcccagggcgagacccugggggagaaguggaagcgccagcugaaccagcucuccaagagcgaguucaacacguacaagcgguccggcaucauggaggucgaccgcagcgaggccaaggaggggcugaagcggggcgagaccaccaagcacgcggugucccgcgggaccgccaagcugcggugguucguggagcgcaaccucgucaagcccgagggcaaggugaucgaccugggcugcgggcggggcggguggagcuacuacugcgccggccugaagaaggugacggaggucaagggguacaccaagggcggccccgggcacgaggagcccaucccgauggccaccuacggcuggaaccuggugaagcuccacuccgggaaggacguguucuucaucccgcccgagaagugcgacacccugcugugcgacaucggcgagagcucccccaacccgacgaucgaggaggggcgcacccuccggguccugaagaugguggagcccuggcugcgcggcaaccaguucugcaucaagauccucaaccccuacaugcccagcguggucgagacccuggagcagaugcagcggaagcacggcgggaugcuggugcgcaacccgcucucccggaacagcacccacgagauguacuggguguccugcggcaccgggaacaucgucagcgccgugaacaugacgucccgcaugcugcugaaccgcuucaccauggcgcaccggaagcccaccuacgagcgcgacguggaccucggcgccggcacccggcacgucgccguggagcccgagguggccaaccuggacaucaucgggcagcgcaucgagaacaucaagcacgagcacaagagcacguggcacuacgacgaggacaaccccuacaagaccugggccuaccacggcuccuacgaggucaagccgagcggguccgcgagcagcauggugaacggcgucgugaagcugcucaccaagcccugggacgugauccccauggucacccagaucgccaugacggacaccacccccuucgggcagcagcggguguucaaggagaagguggacacccgcacgccgaaggccaagcggggcaccgcccagaucauggaggucaccgccaaguggcuguggggcuuccugucccgcaacaagaagccccggaucugcacccgcgaggaguucacgcggaaggugcgcagcaacgcggccaucggggccguguucgucgacgagaaccaguggaacuccgccaaggaggcgguggaggacgagcgguucugggaccucgugcaccgcgagcgggagcugcacaagcagggcaagugcgcgaccugcgucuacaacaugauggggaagcgcgagaagaagcugggcgaguucgggaaggccaagggcagccgggccaucugguacauguggcucggcgcccgcuuccuggaguucgaggcgcugggguucaugaacgaggaccacugguucucccgggagaacagccucuccggcguggagggggagggccugcacaagcugggguacauccuccgcgacaucagcaacauccccggcggcaacauguacgccgacgacaccgccgggugggacacccggaucacggaggacgaccugcagaacgaggcccgcaucaccgacaucauggagccggagcacgcccugcucgcgaaguccaucuucaagcugaccuaccagaacaaggugguccgcgugcagcggcccgccaagaacggcaccgugauggacgucaucagccgccgggaccagcgcggguccggccaggugggcacguacgggcugaacaccuucaccaacauggaggcccagcucauccggcagauggagagcgagggcaucuucucccccagcgagcuggagacccccaaccuggccgagcgcgugcucgacuggcuggagaaguacggggucgagcggcugaagcgcauggccaucuccggcgacgacugcguggugaagccgaucgacgaccgguucgcgacggcccucaccgcccugaacgacauggggaagguccgcaaggacaucccccagugggagcccagcaagggcuggaacgacuggcagcagguccccuucugcucccaccacuuccaccagcugaucaugaaggacggccgggagaucguggucccgugccgcaaccaggacgagcucguggggcgggcccgcgugagccagggcgccggguggagccugcgggagaccgcgugccugggcaaguccuacgcccagauguggcagcucauguacuuccaccgccgggaccugcgccuggccgccaacgcgaucugcagcgccguccccguggacuggauccccaccucccggacgaccuggagcauccacgcccaccaccaguggaugaccaccgaggacaugcucuccguguggaaccgcgucuggaucgaggagaaccccuggauggaggacaagacgcacaucagcuccuggggcgacgugccguaccugggcaagcgcgaggaccaguggugcggcagccugaucgggcucaccgcccgggccaccugggcgaccaacauccagguggccaucaaccagguccgccggcugaucggcaacgagaacuaccuggacuacaugaccuccaugaagcgcuucaagaacgagagcgaccccgagggggcccucugguga

SEQ ID NO: 8308 - RNA, 9879 nt, Artificial Sequence
  derived and/or modified CDS sequence (opt1) from DENV-1__EU677176__SS-prME
uccgugaccaugcugcucaugcugaugcccaccgcccuggccuuccaccucaccacccggggcggggagccccacaugaucguguccaagcaggagcggggcaagagccugcuguucaagaccuccgccggggugaacaugugcacccucaucgccauggaccugggcgagcugugcgaggacaccaugaccuacaagugcccccggaucaccgagguggagcccgacgacguggacugcuggugcaacaccaccgacaccugggugaccuacgggaccugcagccagacgggcgagcaccggcgcgacaagcgguccguggcccucgcgccccacgucggccuggggcuggagacccgcgccgagaccuggaugagcuccgagggcgcguggaagcagauccagaagguggagaccugggcccuccggcaccccggguucacggugaucgcccuguuccuggcccacgcgaucggcaccagcaucacccagaaggggaucaucuucauccuccugaugcuggucacccccuccauggccaugcgcugcgugggcaucggcagccgggacuucguggaggggcucuccggcgccacgugggucgacguggugcuggagcacgggagcugcgucaccaccauggccaaggacaagcccacccuggacaucgagcuccugaagacggaggugaccaaccccgccgugcugcgcaagcucugcaucgaggcgaagaucuccaacaccaccacggacagccggugcccgacccagggcgaggccacccuggucgaggagcaggacgccaacuucgugugccgccggaccuucguggaccgcggcugggggaacggcugcgggcuguucggcaaggggucccucaucacgugcgccaaguucaagugcgucaccaagcuggagggcaagaucgugcaguacgagaaccugaaguacagcgugaucgucaccgugcacaccggcgaccagcaccaggucgggaacgaguccacggagcacggcaccaccgccaccaucacgccccaggcgcccacgagcgagauccagcucaccgacuacggggcccugacccuggacugcagcccccggaccggccucgacuucaacgagauggugcugcugacgaugaaggagaaguccuggcucgugcacaagcagugguuccuggaccugccccuccccuggaccagcggggccuccaccagccaggagaccuggaaccgccaggaccugcuggucacguucaagaccgcccacgccaagaagcaggagguggugguccucggcucccaggagggcgcgaugcacaccgcccugaccggggccacggagauccagaccagcggcaccaccacgaucuucgccgggcaccugaagugccggcucaagauggacaagcugacccugaagggcauguccuacgugaugugcaccgggcuguucaagcuggagaaggagguggccgagacccagcacggcacgguccuggugcagaucaaguacgagggcaccgacgcgcccugcaagauccccuucagcacccaggacgagaagggggugacccagaacggccgccugaucacggccaacccgaucgucaccgacaaggagaagcccgugaacaucgaggccgagccgcccuucggggaguccuacaucgugaucggcgccggcgagaaggcgcucaagcugagcugguucaagaagggguccagcaucggcaagauguucgaggccaccgcccgcggggcccgccggauggccauccugggcgacaccgcgugggacuucggguccaucggcggcgucuucacgagcguggggaagcucgugcaccagaucuucggcaccgccuacgggguccuguucuccggcgugagcuggaccaugaagaucgggaucggcgugcugcucaccuggcugggccugaacucccgcagcacgucccucagcaugaccugcaucgccgucgggcuggugacccuguaccucggcgugaugguccaggccgacuccgggugcgugaucaacuggaagggccgcgagcugaagugcgggagcggcaucuucgugaccaacgagguccacacguggaccgagcaguacaaguuccaggccgacagcccgaagcggcuguccgcggccaucggcaaggccugggaggagggggugugcggcauccgcagcgccacccggcucgagaacaucauguggcgccagaucuccaacgagcugaaccacauccugcucgagaacgacaugaaguucaccguggucgugggggacguggucggcauccuggcccaggggaagaagaugauccggccccagcccauggagcacaaguacagcuggaaguccuggggcaaggcgaagaucaucggcgccgacgugcagaacaccacguucaucaucgacgggcccaacaccccggagugccccgacgaccagcgcgccuggaacaucugggagguggaggacuacggcuucgggaucuucaccaccaacaucuggcugaagcuccgggacagcuacacgcaggucugcgaccaccgccugauguccgccgcgaucaaggacagcaaggccgugcacgccgacaugggcuacuggaucgaguccgagaagaacgagaccuggaagcuggcccgggccagcuucaucgaggugaagaccugcaucuggcccaagucccacacccucuggagcaacggcguccuggaguccgagaugaucauccccaagaucuacgggggcccgaucagccagcacaacuaccgccccggguacuucacgcagaccgcgggccccuggcaccuggggaagcucgagcuggacuucgaccugugcgagggcaccaccgugguggucgacgagcacugcggcaaccgggggccgucccuccgcacgaccaccgugaccggcaagaucauccacgaguggugcugccggagcugcacgcugccgccccugcgcuucaagggggaggacggcugcugguacgggauggagauccggcccgugaaggagaaggaggagaaccucgucaaguccauggugagcgccggcagcggcgagguggacuccuucagccuggggcugcucugcaucuccaucaugaucgaggaggucaugcgcagccgguggucccgcaagaugcugaugaccggcacccuggccguguucuuccuccugaucauggggcagcugaccuggaacgaccucauccggagcugcaucauggugggcgccaacgccuccgaccgcauggggaugggcacgaccuaccuggcgcugauggccaccuucaagaugcgcccgauguucgccgucgggcuccuguuccggcgccugaccagccgggaggugcuccugcugacgaucgggcucucccuggucgccagcguggagcugcccaacucccucgaggagcugggcgacgggcuggccaugggcaucaugauccucaagcugcugaccgacuuccagagcuaccagcucugggcgacccugcugucccucaccuucaucaagacgaccuucagccugcacuacgccuggaagaccauggccauggugcuguccaucgucagccuccugccccugugccucuccaccacgagccagaagaccaccuggcugcccgugcugcucggcucccuggggugcaagccgcugaccauguuccucaucgccgagaacaagaucuggggccgcaagagcuggccccugaacgaggggaucauggcggugggcaucgucagcauccugcucuccagccugcugaagaacgacgugccccucgccgggccccugaucgccggcggcaugcugaucgccugcuacgugaucuccgggagcuccgccgaccucagccuggagaaggcggccgaggucuccugggaggaggaggccgagcacagcggcgccucccacaacauccugguggaggugcaggacgacgggacgaugaagaucaaggacgaggagcgggacgacacccucaccauccugcugaaggccacccuccuggcggucagcggcguguacccgcuguccauccccgccacccucuucgugugguacuucuggcagaagaagaagcagcgcagcgggguccugugggacacgcccagcccgcccgagguggagcgggccgugcuggacgacggcaucuaccgcaucaugcagcggggccugcucgggcgcagccaggucggcguggggguguuccaggagaacgucuuccacaccauguggcacgugacccggggcgccgugcugauguaccaggggaagcgccuggagcccuccugggccagcgucaagaaggaccucaucuccuacggcggcggguggcggcugcagggcagcuggaacaccggggaggagguccaggugaucgcggucgagcccggcaagaaccccaagaacgugcagacggcccccgggaccuucaagacccccgagggcgaggugggcgccaucgcccuggacuucaagcccgggaccuccggcagccccaucgucaaccgcgaggggaagaucgugggccucuacggcaacgggguggucacgaccagcggcaccuacguguccgccaucgcgcaggccaaggccagccaggaggggccgcugcccgagaucgaggacgagguguuccggaagcgcaaccugaccaucauggaccuccaccccggcuccgggaagacgaagcgguaccugccggccaucguccgcgaggcgaucaagcggaagcugcgcacccucauccuggcccccacccgggugguggccagcgagauggccgaggcccugaagggcaugcccauccgcuaccagaccacggcggucaaguccgagcacaccggccgcgagaucguggaccucaugugccacgccaccuucaccaugcggcugcugagccccgugcgcgucccgaacuacaacaugaucaucauggacgaggcccacuucacggaccccuccagcaucgccgcccggggguacaucuccacccgcgugggcaugggggaggcggccgccaucuucaugaccgccacgccgcccggcagcguggaggccuucccgcaguccaacgcggucauccaggacgaggagcgggacauccccgagcgcagcuggaacuccggguacgaguggaucacggacuuccccggcaagaccgugugguucgugcccagcaucaaguccggcaacgacaucgccaacugccuccggaagaacgggaagcgcgucauccagcugagccggaagaccuucgacaccgaguaccagaagacgaagaacaacgacugggacuacguggugaccaccgacaucuccgagaugggcgccaacuuccgcgccgaccgggucaucgacccgcgccggugccugaagcccgugauccucaaggacgggcccgagcgcgucauccuggcgggccccaugccggugaccguggccagcgccgcccagcggcgcgggcggaucggccgcaaccacaacaaggagggcgaccaguacaucuacauggggcagccccugaacaacgacgaggaccacgcccacuggacggaggcgaagaugcuccuggacaacaucaacacccccgagggcaucauccccgcccuguucgagccggagcgggagaaguccgccgccaucgacggggaguaccgccuccgcggcgaggcccggaagaccuucgucgagcugaugcgccgcggggaccugcccguguggcucagcuacaagguggcgagcgagggcuuccaguacuccgaccgccgguggugcuucgacggcgagcgcaacaaccagguccuggaggagaacauggacguggagaucuggaccaaggagggggagcggaagaagcugcgcccccgguggcucgacgcccgcacguacagcgacccccuggcccugcgggaguucaaggaguucgccgccggccgccgguccgugagcggggaccucauccuggagaucggcaagcugccgcagcaccucacccagcgcgcgcagaacgcccuggacaaccuggucaugcuccacaacuccgagcagggcgggcgggccuaccgccacgccauggaggagcugcccgacaccaucgagacccugaugcuccuggcgcugaucgccgugcucacgggcggggugacccuguucuuccugagcggccgggggcucggcaagaccuccaucggccugcugugcgucauggccagcuccgcccuccuguggauggccagcguggagccccacuggaucgcggccuccaucauccuggaguucuuccucauggugcugcugauccccgagccggaccgccagcggacgccccaggacaaccagcucgccuacgucgugaucgggcugcuguucaugauccucaccguggccgccaacgagaugggccugcuggagacgaccaagaaggaccucgggaucggccacgucgcgguggagaaccaccaccacgccaccaugcuggacguggaccugcaccccgccagcgccuggacccucuacgccgucgcgacgaccaucaucaccccgaugaugcgccacaccaucgagaacacgaccgccaacaucucccugaccgccaucgccaaccaggccgcgauccugauggggcucgacaagggcuggcccaucagcaagauggacaucggcgugccccugcuggcccucgggugcuacucccaggugaacccccugacccugacggccgccguccucaugcugguggcgcacuacgccaucaucggcccggggcugcaggccaaggccacccgggaggcccagaagcgcaccgcggccggcaucaugaagaaccccaccguggacgggaucgucgccaucgaccucgaccccgugguguacgacgccaaguucgagaagcagcugggccagaucaugcugcucauccugugcacgagccagauccugcucaugcgcaccaccugggcccugugcgaguccaucacccuggcgacgggcccccucaccacccugugggaggggagcccgggcaaguucuggaacaccacgaucgccgucuccauggccaacaucuuccgggggagcuaccuggccggcgccggccucgcguucagccugaugaagucccucgggggcgggcgccgggggaccggggcccagggcgagacccucggcgagaaguggaagcgccagcugaaccagcugagcaaguccgaguucaacaccuacaagcggagcgggaucauggagguggaccgcuccgaggccaaggagggccuccggcgcggggagacgaccaagcacgccgugagccggggcaccgcgaagcugcgcugguucgucgagcggaaccuggugaagcccgaggggaaggugaucgaccugggcugcggccgcgggggcugguccuacuacugcgccgggcucaagaaggucaccgaggugaagggcuacacgaagggcgggcccggccacgaggagcccaucccgauggccaccuacggguggaaccuggugaagcugcacagcggcaaggacgucuucuucaucccgcccgagaagugcgacacccuccugugcgacaucggggaguccagccccaacccgaccaucgaggagggccggacgcugcgcgugcucaagaugguggagcccuggcugcgggggaaccaguucugcaucaagauccugaaccccuacaugcccuccgucguggagacccucgagcagaugcagcgcaagcacggcggcaugcuggugcggaacccgcugagccgcaacuccacccacgagauguacugggucagcugcgggaccggcaacaucguguccgccgugaacaugaccagccggaugcuccugaaccgcuucacgauggcccaccgcaagcccaccuacgagcgggacgucgaccugggggcgggcacccgccacguggccguggagcccgaggucgccaaccucgacaucaucggccagcggaucgagaacaucaagcacgagcacaaguccaccuggcacuacgacgaggacaaccccuacaagacgugggccuaccacgggagcuacgaggugaagccguccggcagcgccagcuccauggucaacgggguggugaagcugcugaccaagcccugggacgucauccccauggugacccagaucgcgaugaccgacacgacccccuucggccagcagcgcguguucaaggagaaggucgacacccggaccccgaaggccaagcgcgggacggcccagaucauggaggugaccgcccgguggcucuggggcuuccugagccgcaacaagaagccccggaucugcacccgcgaggaguucacccggaaggugcgcuccaacgccgcgaucggcgccgucuucguggacgagaaccaguggaacagcgccaaggaggccguggaggacgagcgguucugggaccugguccaccgcgagcgggagcuccacaagcaggggaagugcgcgacgugcguguacaacaugaugggcaagcgcgagaagaagcugggggaguucggcaaggccaaggggucccgggccaucugguacauguggcugggcgcccgcuuccucgaguucgaggcccugggcuucaugaacgaggaccacugguucagccgggagaacucccugagcgggguggagggcgaggggcuccacaagcugggcuacauccugcgcgacaucuccaagauccccgggggcaacauguacgcggacgacaccgccggcugggacacccggaucaccgaggacgaccuccagaacgaggccaagaucacggacaucauggagccggagcacgcccugcuggccaccagcaucuucaagcucaccuaccagaacaaggucgugcgcgugcagcgccccgcgcggaacgggaccgucauggacgugaucucccgccgggaccagcgcggcagcggccaggugggcacguacggccugaacaccuucaccaacauggaggcccagcugauccggcagauggaguccgagcgcaucuucagccccuccgagcucgagacccccaaccuggccgagcggguccuggacuggcucgagaagcacgggguggagcgccugaagcggauggccaucagcggcgacgacugcguggucaagccgaucgacgaccgcuucgccacggcgcuguccgcccucaacgacauggggaaggugcggaaggacaucccccagugggagcccagcaagggcuggaacgacuggcagcagguccccuucugcagccaccacuuccaccagcugaucaugaaggacgggcgcgagaucgucgugccgugccggaaccaggacgagcuggugggccgcgcccgggucucccagggcgccggguggagccuccgcgagaccgccugccugggcaaguccuacgcgcagauguggcagcugauguacuuccaccggcgcgaccuccggcuggccgccaacgccaucugcagcgcggugcccguggacuggguccccaccucccgcaccacguggagcauccacgcccaccaccaguggaugaccaccgaggacaugcuguccguguggaaccgcguguggaucgaggagaaccccuggauggaggacaagacccacaucagcuccuggggcgacgucccguaccucggcaagcgggaggaccaguggugcgggagccugaucggccugacggcccgcgccaccugggccaccaacauccagguggcgaucaaccaggugcggcgccucaucggcaacgagaacuaccuggacuacaugaccuccaugaagcgguucaagaacgacagcgaccccgagggggcccugugguga

SEQ ID NO: 8309 - RNA, 9879 nt, Artificial Sequence
  derived and/or modified CDS sequence (opt1) from DENV-1__EU726780__SS-prME
agcgugaccaugcugcucaugcugaugcccaccgcccuggccuuccaccucaccacccggggcggggagccccacaugaucgugagcaagcaggagcggggcaagagccugcuguucaagaccuccgccggggugaacaugugcacccucaucgccauggaccugggcgagcugugcgaggacaccaugaccuacaagugcccccggaucaccgagaccgagcccgacgacguggacugcuggugcaacgccaccgacaccugggugaccuacgggaccugcagccagacgggcgagcaccggcgggacaagcgguccguggcccucgcgccccacgugggccuggggcuggagacccgcaccgagaccuggaugagcuccgagggcgccuggaagcagauccagcggguggagacgugggcccuccggcaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagguggccgagacccagcacggcaccgugcugguccagaucaaguacgagggcaccgacgcgcccugcaagauccccuucagcacgcaggacgagaagggggugacccagaacggccggcugaucaccgccaacccgaucgugaccgacaaggagaagcccgucaacaucgaggccgagccgcccuucggggaguccuacaucgugaucggcgccggcgagaagacgcugaagcucagcugguucaagaagggguccagcaucggcaagauguucgaggcgaccgcccgcggggcccggcgcauggccauccugggcgacaccgccugggacuucggguccaucggcggcguguucaccagcgucgggaagcuggugcaccagaucuucggcacggcguacgggguccuguucuccggcgucagcuggaccaugaagaucgggaucggcgugcugcugaccuggcucggccugaacucccgcagcaccucccugagcaugacgugcaucgccguggggcucgucacccuguaccugggcgugauggugcaggccgacuccgggugcgucaucaacuggaagggccgggagcucaagugcgggagcggcaucuucgugaccaacgaggugcacaccuggaccgagcaguacaaguuccaggccgacagcccgaagcgccuguccgccgcgaucggcaaggccugggaggagggggucugcggcauccggagcgccacgcgccuggagaacaucauguggaagcagaucuccaacgagcucaaccacauccugcuggagaacgacaugaaguucaccgugguggucggggacguggccggcauccucgcccaggggaagaagaugauccggccccagcccauggaguacaaguacagcuggaaguccuggggcaaggcgaagaucaucggcgccgacgugcagaacaccaccuucaucaucgacgggcccaacacgccggagugccccgacgaccagcgcgccuggaacaucugggaggucgaggacuacggcuucgggaucuucaccaccaacaucuggcugaagcugcgggacagcuacacccaggugugcgaccaccgccucauguccgccgcgaucaaggacagcaaggccgugcacgccgacaugggcuacuggaucgaguccgagaagaacgagacguggaagcuggcccgggccagcuucaucgaggucaagaccugcaucuggcccaagucccacacccuguggagcaacggcgugcucgaguccgagaugaucauccccaagaucuacgggggcccgaucagccagcacaacuaccgccccggguacuucacccagacggcgggccccuggcaccuggggaagcuggagcucgacuucgaccugugcgagggcaccaccguggucguggacgagcacugcggcaaccgggggccgucccugcgcaccacgaccgugaccggcaagaucauccacgaguggugcugccggagcugcacccugccgccccuccgcuuccgcggggaggacggcugcugguacgggauggagauccgccccgucaaggagaaggaggagaaccuggugaaguccauggugagcgccggcagcggcgaggucgacuccuucagccucgggcugcugugcaucuccaucaugaucgaggaggugaugcggagccgcuggucccggaagaugcucaugacgggcacccuggccguguucuuccugcucaucauggggcagcugaccuggaacgaccugauccgccucugcaucauggucggcgccaacgccagcgaccgcauggggaugggcaccacguaccuggcgcugauggccaccuucaagaugcggccgauguucgccgugggccuccuguuccgccggcugaccucccgcgaggugcuccugcugaccaucgggcucagccuggucgccuccguggagcugcccaacagccucgaggagcugggcgacgggcuggccaugggcaucaugauccucaagcugcugacggacuuccagucccaccagcucugggucacccugcugagccucaccuucaucaagaccacguucucccugcacuacgcguggaagaccauggccauggugcugagcaucgugucccucuucccccugugccugagcaccaccucccagaagacgaccuggcuccccguccugcugggcagccucgggugcaagccgcugaccauguuccugaucgccgagaacaagaucuggggccggcgcuccuggccccucaacgaggggaucauggccgugggcaucgugagcauccugcugagcucccuccugaagaacgacgucccccuggcggggccccucaucgccggcggcaugcugaucgccugcuacgugaucagcggguccagcgccgaccugucccucgagaaggccgcggaggugagcugggaggaggaggccgagcacuccggcgccagccacaacauccuggucgaggugcaggacgacgggaccaugaagaucaaggacgaggagcgggacgacacccugacgauccuccugaaggccacccugcucgccguguccggcgucuacccgcugagcauccccgcgacccuguucgugugguacuucuggcagaagaagaagcagcgcuccggggugcucugggacacccccagcccgcccgaggucgagcgggccgugcuggacgacggcaucuaccgcaucaugcagcggggccugcuggggcgcucccaggugggcgucgggguguuccaggagaacguguuccacacgauguggcacgucacccggggcgccgugcucauguaccaggggaagcgccuggagcccagcugggccuccgugaagaaggaccugaucagcuacggcggcggguggcggcuccagggcuccuggaacaccggggaggagguccaggugaucgccguggagcccggcaagaaccccaagaacguccagaccgcgcccgggacguucaagacccccgagggcgaggugggcgccaucgcccuggacuucaagcccgggaccagcggcucccccaucgugaaccgcgaggggaagaucgucggccuguacggcaacgggguggugaccacgagcggcaccuacgucagcgccaucgcccaggcgaaggccucccaggaggggccgcuccccgagaucgaggacgagguguuccggaagcgcaaccugaccaucauggaccugcaccccggcagcgggaagacccggcgcuaccucccggccaucgugcgggaggccaucaagcgcaagcugcgcacgcugauccucgcgcccacccgggucguggccuccgagauggccgaggcccugaagggcaugcccauccgcuaccagaccaccgccgucaagagcgagcacacgggcaaggagaucgucgaccugaugugccacgcgaccuucaccaugcggcuccugucccccgugcgcgugccgaacuacaacaugaucaucauggacgaggcccacuucaccgaccccagcuccaucgccgcccggggguacaucagcacgcgcgucggcaugggggaggccgcggccaucuucaugaccgccacgccgcccggcuccguggaggccuucccgcagagcaacgccgugauccaggacgaggagcgggacauccccgagcgcuccuggaacagcggguacgaguggaucaccgacuuccccggcaagacggucugguucgugcccuccaucaagagcggcaacgacaucgcgaacugccugcggaagaacgggaagcgcgugauccagcucucccggaagaccuucgacaccgaguaccagaagaccaagaacaacgacugggacuacgucgugacgaccgacaucagcgagaugggcgccaacuuccgcgccgaccgggugaucgacccgcgccggugccugaagcccgucauccugaaggacgggcccgagcgcgugauccucgccggccccaugccggucaccguggcguccgccgcccagcggcgcgggcggaucggccgcaaccacaacaaggagggcgaccaguacaucuacauggggcagccccugaacaacgacgaggaccacgcccacuggaccgaggccaagaugcugcucgacaacaucaacacgcccgagggcaucauccccgcgcuguucgagccggagcgcgagaaguccgccgccaucgacggggaguaccggcugcgcggcgaggcccggaagaccuucguggagcucaugcgccgcggggaccugcccgucuggcuguccuacaagguggccagcgagggcuuccaguacagcgaccgccgguggugcuucgacggcgagcgcaacaaccaggugcucgaggagaacauggacgucgagaucuggaccaaggagggggagcggaagaagcugcgcccccgguggcuggacgcgcgcaccuacuccgacccccucgcccugcgggaguucaaggaguucgccgccggccgccggagcguguccggggaccugaucagcgagaucggcaagcucccgcagcaccugacgcagcgcgcccagaacgcgcuggacaaccucgugaugcugcacaacuccgagcagggcgggcgggccuaccgccacgccauggaggagcugcccgacaccaucgagacccucaugcugcuggcccucaucgcgguccugaccggcggggugacccuguucuuccucagcggccgggggcugggcaagacguccaucggccugcucugcgugauggccagcuccguccugcuguggauggccagcguggagccccacuggaucgccgccuccaucauccucgaguucuuccugauggugcugcucauccccgagccggaccgccagcggacgccccaggacaaccagcuggcguacgucgugaucgggcuccucuucaugauccugaccguggccgccaacgagaugggccugcucgagaccacgaagaaggaccuggggaucggccacgucgccguggagaaccaccaccacgccgcgaugcuggacguggaccuccaccccgccagcgccuggacccuguacgccgucgccaccaccaucaucacgccgaugaugcgccacaccaucgagaacaccaccgcgaacaucucccugacggccaucgccaaccaggccgccauccucauggggcuggacaagggcuggcccaucagcaagauggacaucggcgugccccugcucgcgcuggggugcuacucccaggugaacccccugacccucaccgccgccguccugaugcugguggcccacuacgcgaucaucggcccggggcuccaggccaaggccacccgcgaggcccagaagcggacggccgcgggcaucaugaagaaccccaccguggacgggaucgucgccaucgaccuggaccccgugguguacgacgccaaguucgagaagcagcugggccagaucaugcuccugauccugugcaccagccagauccuccugaugcgcaccacgugggcccugugcgaguccaucacccucgccaccggcccccugaccacgcugugggaggggagcccgggcaaguucuggaacaccaccaucgcggucuccauggccaacaucuuccgggggagcuaccucgccggcgccggccuggccuucagccugaugaagucccucgggggcgggcgccggggcaccggggcgcagggcgagacgcugggcgagaaguggaagcgccagcugaaccagcucagcaaguccgaguucaacaccuacaagcggagcgggaucauggagguggaccgcuccgaggccaaggagggccugaagcgcggggagaccaccaagcacgccgugagccgcggcacggccaagcugcggugguucgucgagcgcaaccucgugaagcccgaggggaaggugaucgaccugggcugcggccgcggcgggugguccuacuacugcgcggggcugaagaaggucaccgaggugaagggguacaccaagggcgggcccggccacgaggagcccaucccgauggccaccuacggguggaaccuggugaagcuccacagcggcaaggacgucuucuucaucccgcccgagaagugcgacacgcugcugugcgacaucggggaguccagccccaacccgaccaucgaggagggccgcacccuccgggugcugaagaugguggagcccuggcugcgcgggaaccaguucugcaucaagauccucaaccccuacaugcccuccgucguggagacccuggagcagaugcagcggaagcacggcggcaugcuggugcgcaacccgcucagccggaacuccacccacgagauguacugggucagcugcgggacgggcaacaucguguccgccgugaacaugaccagccgcaugcugcugaaccgcuucaccauggcccaccggaagcccaccuacgagcgcgacgucgaccucggggccggcacgcggcacguggcgguggagcccgaggucgccaaccuggacaucaucggccagcgcaucgagaacaucaagcacgagcacaaguccaccuggcacuacgacgaggacaaccccuacaagaccugggccuaccacgggagcuacgaggugaagccguccggcagcgccagcuccauggucaacgggguggugaagcugcucaccaagcccugggacgucauccccauggugacgcagaucgccaugaccgacaccacccccuucggccagcagcggguguucaaggagaaggucgacacgcgcaccccgaaggcgaagcgggggaccgcccagaucauggaggugaccgccaaguggcuguggggcuuccugagccgcaacaagaagccccggaucugcacgcgcgaggaguucacccggaaggugcgcuccaacgccgccaucggcgcggucuucguggacgagaaccaguggaacagcgccaaggaggccguggaggacgagcgguucugggaccucguccaccgcgagcgggagcugcacaagcaggggaagugcgcgaccugcguguacaacaugaugggcaagcgcgagaagaagcugggggaguucggcaaggcgaaggggucccgggccaucugguacauguggcucggcgcccgcuuccuggaguucgaggcccugggcuucaugaacgaggaccacugguucagccgggagaacucccucagcgggguggagggcgaggggcugcacaagcugggcuacauccuccgcgacaucuccaagauccccgggggcaacauguacgccgacgacaccgcgggcugggacacgcggaucaccgaggacgaccugcagaacgaggcccgcaucaccgacaucauggagccggagcacgcccugcucgccaagagcaucuucaagcugaccuaccagaacaaggucgugcgcgugcagcggcccgccaagaacgggacggucauggacgugaucucccgccgggaccagcgcggcagcggccagguggggaccuacggccugaacaccuucaccaacauggaggcgcagcucauccggcagauggaguccgaggggaucuucagccccuccgagcuggagacgcccaaccuggccgagcgcguccucgacuggcuggagaaguacggcaucgagcggcugaagcgcauggccaucagcggggacgacugcguggugaagccgaucgacgaccgguucgccaccgcccucaccgcgcugaacgacaugggcaagguccgcaaggacaucccccagugggagcccuccaagggguggaacgacuggcagcagguccccuucugcagccaccacuuccaccagcugaucaugaaggacggccgggagaucguggucccgugccgcaaccaggacgagcucgugggccgggcccgcgugagccagggggccggcuggucccugcgggagaccgccugccugggcaagagcuacgcccagauguggcagcucauguacuuccaccgccgggaccugcgccuggcggccaacgccaucugcuccgccguccccguggacuggauccccacgagccggaccaccugguccauccacgcgcaccaccaguggaugaccacggaggacaugcucagcguguggaaccgcgucuggaucgaggagaaccccuggauggaggacaagacccacaucuccagcuggggcgacgugccguaccuggggaagcgcgaggaccaguggugcggcucccugaucggccucaccgcccgggccaccugggccaccaacauccagguggccaucaaccagguccgccggcugaucgggaacgagaacuaccuggacuacaugacgagcaugaagcgcuucaagaacgaguccgaccccgagggcgcgcucugguga

SEQ ID NO: 8310 - RNA, 9879 nt, Artificial Sequence
  derived and/or modified CDS sequence (opt1) from DENV-1__EU726781__SS-prME
agcgugaccaugcugcucaugcugaugcccaccgcccuggccuuccaccucacgacccggggcggggagccccacaugaucgugagcaagcaggagcggggcaagagccugcuguucaagaccagcgcgggggugaacaugugcacccucaucgccauggaccugggcgaguucugcgaggacacgaugaccuacaagugcccccgcaucaccgaggccgagcccgacgacguggacugcuggugcaacgccaccgacacgugggugaccuacgggaccugcagccagaccggcgagcaccggcgggacaagcgguccguggcccuggcgccccacgugggccucgggcuggagacgcgcaccgagaccuggaugagcuccgagggcgccuggaagcagauccagcggguggagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugcccgacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaagaccguccaguacgagaaccugaaguacagcgugaucgugaccguccacacgggcgaccagcaccagguggggaacgaguccaccgagcacggcaccaccgcgaccaucacgccccaggcccccagcaccgagauccagcugaccgacuacggggcccucacccuggacugcagcccccggacgggccuggacuucaacgagaugguccuccugaccaugaaggagaaguccuggcuggugcacaagcagugguuccucgaccugccgcugcccuggaccagcggggccuccaccagccaggagacguggaaccggaaggaccuccuggugaccuucaagaccgcccacgcgaagaagcaggaggucguggugcugggcucccaggagggcgccaugcacaccgcccucacgggggccaccgagauccagaccagcggcaccacgaccaucuucgccgggcaccugaagugccgccugaagauggacaagcucacccugaagggcauguccuacgucaugugcaccgggagcuucaagcuggagaaggagguggcggagacgcagcacggcaccgugcucguccagaucaaguacgagggcaccgacgcccccugcaagauccccuucuccacccaggacgagaagggggugacgcagaacggccggcugaucaccgccaacccgaucgugaccgacaaggagaagcccgucaacaucgaggccgagccgcccuucggggagagcuacaucgugaucggcgcgggcgagaaggcccugaagcuguccugguucaagaaggggagcuccaucggcaagauguucgaggccaccgcccgcggggcccggcgcauggcgauccucggcgacacggccugggacuucgggagcaucggcggcguguucaccuccgucgggaagcuggugcaccagaucuucggcaccgccuacggggugcuguucagcggcgucuccuggaccaugaagaucgggaucggcgugcuccugacguggcugggccucaacagccgcuccaccagccuguccaugaccugcaucguggucgggcuggugacccucuaccugggcgugaugguccaggccgacagcgggugcgugaucaacuggaagggccgggagcugaagugcgggagcggcaucuucgugacgaacgagguccacaccuggaccgagcaguacaaguuccaggccgacuccccgaagcgccucagcgcggccaucggcaaggccugggaggagggggugugcggcauccgguccgccacccgccuggagaacaucauguggaagcagaucagcaacgagcugaaccacauccuccuggagaacgacaugaaguucaccguggucgugggggacguggccggcauccuggcgcaggggaagaagaugauccggccccagcccauggaguacaaguacuccuggaaguccuggggcaaggccaagaucaucggcgccgacguccagaacacgaccuucaucaucgacgggcccaacaccccggagugccccgacgaccagcgcgccuggaacaucugggagguggaggacuacggcuucgggaucuucaccacgaacaucuggcucaagcugcgggacuccuacacccaggugugcgaccaccgccugaugagcgcggccaucaaggacuccaaggccguccacgccgacaugggcuacuggaucgagagcgagaagaacgagaccuggaagcucgcccgggcguccuucaucgaggugaagaccugcaucuggcccaagagccacacgcugugguccaacggcgugcuggagagcgagaugaucauccccaagaacuacgggggcccgaucucccagcacaacuaccgccccggguacuucacccagaccgccggccccuggcaccucgggaagcuggagcuggacuucgaccucugcgagggcaccacggucgugguggacgagcacugcggcaaccgggggccgagccugcgcaccaccaccgucacgggcaagaucauccacgaguggugcugccgguccugcacccugccgccccugcgcuucaagggggaggacggcugcugguacgggauggagauccggcccgugaaggagaaggaggagaaccuggucaagagcauggucagcgccggcuccggcgagguggacagcuucucccuggggcuccugugcaucagcaucaugaucgaggaggugaugcgcucccgguggagccgcaagaugcugaugaccggcacccucgccguccuguuccugcucaucauggggcagcugacguggaacgaccugauccggcucugcaucauggugggcgccaacgcguccgaccgcauggggaugggcaccaccuaccuggcccugauggccaccuucaagaugcgcccgauguucgccgugggccuccuguuccggcgccugacgagccgggagguccuccugcugaccaucgggcucucccugguggccagcgucgagcugcccaacucccucgaggagcugggcgacgggcuggcgaugggcaucaugauccucaagcugcugaccgacuuccagagccaccagcucugggccacccugcugucccucacguucaucaagaccaccuucagccugcacuacgccuggaagaccauggccauggugcuguccaucgugagccucuucccccugugccuguccacgaccagccagaagaccaccuggcuccccguccugcugggcucccucgggugcaagccgcugacgauguuccugaucgcggagaacaagaucuggggccgcaagagcuggccccucaacgaggggaucauggccgugggcaucgugagcauccugcuguccagccuccugaagaacgacgucccccuggccgggccccucaucgccggcggcaugcugaucgccugcuacgugaucuccgggagcuccgcggaccugagccucgagaaggccgccgagguguccugggaggaggaggccgagcacagcggcgccucccacaacauccuggucgaggugcaggacgacgggaccaugaagaucaaggacgaggagcgggacgacacccugaccauccuccugaaggcgacccugcucgccgugagcggcgucuacccgcuguccauccccgccacgcuguucgugugguacuucuggcagaagaagaagcagcgcagcggggugcucugggacacccccagcccgcccgaggucgagcgggccgugcuggacgacggcaucuaccgcaucaugcagcggggccugcuggggcgcagccaggugggcgucgggguguuccaggagaacguguuccacaccauguggcacgucacccggggcgccgugcucauguaccaggggaagcgccuggagcccuccugggcgagcgugaagaaggaccugaucuccuacggcggcggguggcggcuccagggcagcuggaacacgggggaggagguccaggugaucgccguggagcccggcaagaaccccaagaacguccagaccgcccccgggaccuucaagaccuccgagggcgaggugggcgccaucgcccuggacuucaagcccgggacgagcggcagccccaucgugaaccgcgaggggaagaucgucggccuguacggcaacgggguggugaccaccuccggcaccuacgucagcgcgaucgcccaggccaaggccucccaggaggggccccucccggagaucgaggacgagguguuccggaagcgcaaccugacgaucauggaccugcaccccggcagcgggaagacccggcgcuaccuccccgcgaucgugcgggaggccaucaagcgcaagcugcggacccugauccucgccccgacccgcgucguggccuccgagauggccgaggcgcugaagggcaugcccauccgcuaccagacgaccgccgucaagagcgagcacaccggcaaggagaucgucgaccugaugugccacgccaccuucacgaugcggcuccugucccccgugcgcgugcccaacuacaacaugaucaucauggacgaggcccacuucaccgacccgagcuccaucgccgcgcggggguacaucagcacccgcgucggcaugggggaggccgccgccaucuucaugaccgccacgccgcccggcuccguggaggcguucccccagagcaacgccgugauccaggacgaggagcgggacaucccggagcgcuccuggaacagcggguacgaguggaucaccgacuuccccggcaagaccgucugguucgugcccuccaucaagagcggcaacgacaucgccaacugccugcggaagaacgggaagcgcgugauccagcucucccggaagaccuucgacacggaguaccagaagaccaagaacaacgacugggacuacgucgugaccaccgacaucagcgagaugggcgccaacuuccgcgcggaccgggugaucgacccccgccggugccugaagccggucauccugaaggacgggcccgagcgcgugauccucgccggccccaugcccgucacgguggccuccgccgcccagcggcgcgggcggaucggccgcaaccacaacaaggagggcgaccaguacaucuacauggggcagccgcugaacaacgacgaggaccacgcgcacuggaccgaggccaagaugcugcucgacaacaucaacacccccgagggcaucauccccgcccuguucgagcccgagcgggagaaguccgccgccaucgacggggaguaccgccugcgcggcgaggcgcggaagaccuucguggagcucaugcgccgcggggaccugccggucuggcugagcuacaagguggccuccgagggcuuccaguacagcgaccgccgguggugcuucgacggcgagcgcaacaaccaggugcucgaggagaacauggacgucgagaucuggacgaaggagggggagcggaagaagcugcgcccccgguggcuggacgcccgcaccuacuccgacccccucgcccugcgggaguucaaggaguucgccgcgggccgccggagcguguccggggaccugauccucgagaucggcaagcugccccagcaccugacccagcgcgcccagaacgcccucgacaaccuggugaugcugcacaacagcgagcagggcgggcgggccuaccgccacgcgauggaggagcucccggacaccaucgagacgcugaugcugcucgcccugaucgccguccugaccggcggggugacccucuucuuccuguccggccgggggcugggcaagaccagcaucggccuccugugcgugauggccuccagcguccugcucuggauggccuccguggagccccacuggaucgcggccagcaucauccuggaguucuuccugauggugcuccugauccccgagcccgaccgccagcggaccccgcaggacaaccagcuggccuacgucgugaucgggcuccuguucaugauccugacgguggccgccaacgagaugggccuccuggagaccaccaagaaggaccuggggaucggccacgucgcgguggagaaccaccaccacgccgccaugcucgacguggaccugcaccccgccuccgccuggacccuguacgcggucgccacgaccaucaucacccccaugaugcgccacaccaucgagaacacgaccgccaacaucagccucaccgccaucgccaaccaggcggccauccugauggggcuggacaagggcuggccgaucuccaagauggacaucggcgugccccuccuggcccuggggugcuacagccaggugaacccccucacccugacggccgcgguccugaugcucguggcccacuacgccaucaucggccccgggcugcaggccaaggccacccgggaggcgcagaagcgcaccgccgccggcaucaugaagaacccgaccguggacgggaucgucgccaucgaccuggaccccgugguguacgacgccaaguucgagaagcagcucggccagaucaugcugcugauccucugcacgucccagauccugcugaugcgcaccaccugggcgcucugcgagagcaucacccuggccacgggcccccugaccacccucugggaggggucccccggcaaguucuggaacaccacgaucgccgucagcauggccaacaucuuccgggggagcuaccuggccggcgcgggccuggccuucucccucaugaagucccucgggggcgggcgccgggggaccggggcccagggcgagacccugggcgagaaguggaagcgccagcucaaccagcuguccaagagcgaguucaacaccuacaagcgguccgggaucauggagguggaccgcagcgaggccaaggagggccugaagcgcggggagacgaccaagcacgcggugucccgcggcaccgccaagcuccggugguucgucgagcgcaaccuggugaagccggaggggaaggugaucgaccugggcugcggccgcggcggguggagcuacuacugcgccgggcugaagaaggucaccgaggugaagggguacacgaagggcgggcccggccacgaggagcccauccccauggccaccuacggguggaaccucgugaagcugcacuccggcaaggacgucuucuucaucccgcccgagaagugcgacacccugcucugcgacaucggggagagcucccccaaccccaccaucgaggagggccgcacgcugcgggugcugaagaugguggagccguggcuccgcgggaaccaguucugcaucaagauccugaaccccuacaugcccagcgucguggagacccuggagcagaugcagcggaagcacggcggcaugcucgugcgcaacccccugucccggaacagcacccacgagauguacugggucuccugcgggaccggcaacaucgugagcgccgugaacaugaccucccgcaugcugcucaaccgguucacgauggcgcaccgcaagccgaccuacgagcgcgacgucgaccugggggccggcacccggcacguggccguggagcccgaggucgccaaccuggacaucaucggccagcgcaucgagaacaucaagcacgagcacaagagcaccuggcacuacgacgaggacaaccccuacaagacgugggccuaccacggguccuacgaggugaagcccagcggcagcgcguccagcauggucaacgggguggugaagcuccugaccaagccgugggacgucauccccauggugacccagaucgccaugaccgacacgacccccuucggccagcagcggguguucaaggagaaggucgacacccgcacccccaaggccaagcgggggacggcccagaucauggaggugaccgccaaguggcuguggggcuuccucucccgcaacaagaagccgcggaucugcacccgcgaggaguucacccggaaggugcgcagcaacgcggccaucggcgccgucuucguggacgagaaccaguggaacuccgccaaggaggcgguggaggacgagcgguucugggaccugguccaccgcgagcgggagcugcacaagcaggggaagugcgccacgugcguguacaacaugaugggcaagcgcgagaagaagcucggggaguucggcaaggccaaggggagccgggccaucugguacauguggcugggcgcccgcuuccuggaguucgaggcgcucggcuucaugaacgaggaccacugguucucccgggagaacagccuguccgggguggagggcgaggggcugcacaagcucggcuacauccugcgcgacaucagcaagauccccgggggcaacauguacgccgacgacaccgccggcugggacacccggaucaccgaggacgaccugcagaacgaggccaagaucacggacaucauggagcccgagcacgcccuccuggcgaaguccaucuucaagcugaccuaccagaacaaggucgugcgcgugcagcggccggccaagaacgggaccgucauggacgugaucagccgccgcgaccagcggggcuccggccaggugggcaccuacggccucaacacguucaccaacauggaggcccagcugauccgccagauggagagcgaggggaucuucucccccagcgagcuggagacccccaaccucgccggccggguccuggacuggcuggagaagcacgggguggagcgccucaagcggauggccaucuccggcgacgacugcguggucaagcccaucgacgaccgcuucgcgaccgcccugacggcccugaacgacauggggaaggugcggaaggacaucccgcagugggagcccagcaagggcuggaacgacuggcagcagguccccuucugcagccaccacuuccaccagcucaucaugaaggacggccgcgagaucgucgugcccugccggaaccaggacgagcugguggggcgcgcccgggucucccagggcgccggguggagccugcgcgagaccgcgugccucggcaaguccuacgcccagauguggcagcugauguacuuccaccggcgcgaccugcggcucgccgccaacgcgaucugcagcgccgugccgguggacuggguccccaccucccgcaccacguggagcauccacgcccaccaccaguggaugaccaccgaggacaugcuguccguguggaaccggguguggaucgaggagaaccccuggauggaggacaagacccacaucagcuccuggggcgacguccccuaccugggcaagcgcgaggaccaguggugcggcagccucaucgggcugacggcccgggccaccugggcgaccaacauccagguggccaucaaccaggugcgccgccugaucggcaacgagaacuaccucgacuacaugaccuccaugaagcgguucaagaacgagagcgacccggagggggcccugugguga

SEQ ID NO: 8311 - RNA, 9879 nt, Artificial Sequence
  derived and/or modified CDS sequence (opt1) from DENV-1__EU726782__SS-prME
agcgugaccaugcugcugaugcugaugcccaccgcccuggccuuccaccucaccacccggggcggggagccccacaugaucgugagcaagcaggagcggggcaagagccugcuguucaagaccuccgccggggugaacaugugcacccucaucgccauggaccugggcgagcugugcgaggacaccaugaccuacaagugcccccggaucaccgagaccgagcccgacgacguggacugcuggugcaacgccacggacaccugggucaccuacgggaccugcagccagacgggcgagcaccggcgggacaagcgguccguggcccucgcgccccacgugggccuggggcuggagacccgcaccgagaccuggaugagcuccgagggcgcguggaagcagauccagcgggucgagacgugggcccuccggcaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagguggccgagacccagcacggcaccgugcugguccagaucaaguacgagggcaccgacgcgcccugcaagauccccuuccugacgcaggacgagaagggggugacccagaacggccggcugaucaccgccaacccgaucgugaccgacaaggagaagcccgucaacaucgaggccgagccgcccuucggggagagcuacaucaucaucggcgccggcgagaaggcgcucaagcuguccugguucaagaaggggagcuccaucggcaagauguucgaggccacggcccgcggggcccggcgcauggccauccugggcgacaccgcgugggacuucgggagcaucggcggcguguucaccuccguggggaagcucguccaccagaucuucggcaccgccuacggggugcuguucagcggcguguccuggacgaugaagaucgggaucggcguccugcucaccuggcugggccugaacagccgcuccaccagccucuccaugaccugcaucgccguggggcuggugacgcuguaccucggcgucauggugcaggccgacagcgggugcgugaucaacuggaagggccgggagcugaagugcggguccggcaucuucgucaccaacgaggugcacaccuggaccgagcaguacaaguuccaggccgacagcccgaagcgccugagcgcggccaucggcaaggccugggaggagggggugugcggcauccgguccgccacccgccucgagaacaucauguggaagcagaucagcaacgagcugaaccacauccugcucgagaacgacaugaaguucacggucguggugggggacgucgccggcauccuggcgcaggggaagaagaugauccggccccagcccauggaguacaaguacuccuggaaguccuggggcaaggccaagaucaucggcgccgacgugcagaacaccaccuucaucaucgacgggcccaacaccccggagugccccgacgaccagcgcgccuggaacaucugggagguggaggacuacggcuucgggaucuucacgaccaacaucuggcugaagcuccgggacuccuacacccaggucugcgaccaccgccugaugagcgcggccaucaaggacuccaaggccgugcacgccgacaugggcuacuggaucgagagcgagaagaacgagaccuggaagcuggcccgggcguccuucaucgaggugaagacgugcaucuggcccaagagccacacccucugguccaacggcguccuggagagcgagaugaucauccccaagaucuacgggggcccgaucucccagcacaacuaccgccccggguacuucacccagaccgccggccccuggcaccuggggaagcucgagcuggacuucgaccugugcgagggcacgaccgugguggucgacgagcacugcggcaaccgggggccgagccuccgcaccaccacggugaccggcaagaucauccacgaguggugcugccgguccugcacccugccgccccugcgcuuccgcggggaggacggcugcugguacgggauggagauccgccccgugaaggagaaggaggagaaccucgucaagagcaugguguccgccggcagcggcgagguggacagcuucucccuggggcugcucugcaucagcaucaucaucgaggaggucaugcggucccgcuggagccggaagaugcugaugaccggcacgcuggccguguucuuccuccugaucauggggcagcugaccuggaacgaccucauccgccugugcaucauggugggcgccaacgcguccgaccgcauggggaugggcaccaccuaccuggcccucauggccacguucaagaugcggccgauguucgccgucggccugcuguuccgccggcucaccagccgcgaggugcugcugcucaccaucgggcugucccugguggccagcgucgagcuccccaacucccuggaggagcugggcgacgggcucgcgaugggcaucaugauccugaagcugcucaccgacuuccagagccaccagcugugggccacgcugcucucccugaccuucaucaagaccaccuucagccugcacuacgccuggaagacgauggccauggugcucuccaucgucagccuguucccccugugccucuccaccaccagccagaagaccacguggcugcccgugcugcucggcucccuggggugcaagccgcugaccauguuccucaucgcggagaacaagaucuggggccggcgcagcuggccccugaacgaggggaucauggccgugggcaucgucuccauccugcucagcagccugcugaagaacgacgugccccucgccgggccccugaucgccggcggcaugcugaucgccugcuacgugaucuccgggagcuccgcggaccucagccuggagaaggccgccgaggucuccugggaggaggaggccgagcacagcggcgccucccacaacauccugguggaggugcaggacgacgggaccaugaagaucaaggacgaggagcgggacgacacccucaccauccugcugaaggcgacgcuccuggccgucagcggcguguacccgcuguccauccccgccacccucuucgugugguacuucuggcagaagaagaagcagcgcagcgggguccugugggacacccccagcccgcccgagguggagcgggccgugcuggacgacggcaucuaccgcaucaugcagcggggccugcucgggcgcagccaggucggcguggggguguuccaggagaacgucuuccacaccauguggcacgugacgcggggcgccgugcugauguaccaggggaagcgccuggagcccuccugggcgagcgucaagaaggaccucaucuccuacggcggcggguggcggcugcagggcagcuggaacaccggggaggagguccaggugaucgccgucgagcccggcaagaaccccaagaacgugcagaccgcccccgggaccuucaagacgcccgagggcgaggugggcgccaucgcccuggacuucaagcccgggaccuccggcagccccaucgucaaccgcgaggggaagaucgugggccucuacggcaacgggguggucaccaccuccggcacguacgugagcgcgaucgcccaggccaaggccagccaggaggggccgcugcccgagaucgaggacgagguguuccggaagcgcaaccugaccaucauggaccuccaccccggcuccgggaagacccggcgcuaccugccggcgaucguccgggaggccaucaagcgcaagcugcgcacccucauccuggcccccacgcgggugguggccagcgagauggccgaggcgcugaagggcaugcccauccgcuaccagaccaccgccgucaaguccgagcacaccggcaaggagaucguggaccucaugugccacgccacguucaccaugcggcugcugagccccgugcgcgucccgaacuacaacaugaucaucauggacgaggcccacuucaccgaccccuccagcaucgccgcgcggggguacaucuccacccgcgugggcaugggggaggccgccgccaucuucaugacggccacgccgcccggcagcguggaggcguucccgcaguccaacgccgucauccaggacgaggagcgggacauccccgagcgcagcuggaacuccggguacgaguggaucaccgacuuccccggcaagaccgugugguucgugcccagcaucaaguccggcaacgacaucgccaacugccuccggaagaacgggaagcgcgucauccagcugagccggaagacguucgacaccgaguaccagaagaccaagaacaacgacugggacuacguggugaccacggacaucuccgagaugggcgccaacuuccgcgcggaccgggucaucgacccgcgccggugccugaagcccgugauccucaaggacgggcccgagcgcgugauccuggccggccccaugccggucaccguggccagcgccgcccagcggcgcgggcggaucggccgcaaccacaacaaggagggcgaccaguacaucuacauggggcagccccugaacaacgacgaggaccacgcgcacuggaccgaggccaagaugcuccuggacaacaucaacacccccgagggcaucauccccgcccuguucgagccggagcgcgagaaguccgccgccaucgacggggaguaccggcuccgcggcgaggcgcggaagacguucgucgagcugaugcgccgcggggaccugcccguguggcucagcuacaagguggccuccgagggcuuccaguacagcgaccgccgguggugcuucgacggcgagcgcaacaaccagguccuggaggagaacauggacguggagaucuggaccaaggagggggagcggaagaagcugcgcccccgguggcucgacgcccgcaccuacagcgacccccuggcccugcgggaguucaaggaguucgccgcgggccgccgguccgugagcggggaccucauccuggagaucggcaagcugccgcagcaccucacccagcgcgcccagaacgcccuggacaaccuggucaugcuccacaacuccgagcagggcgggcgggccuaccgccacgcgauggaggagcugcccgacacgaucgagacccugaugcuccuggcccugaucgccgugcucaccggcggggugacccuguucuuccugagcggccgggggcucggcaagaccuccaucggccugcugugcgucauggccagcuccgugcuccuguggauggccagcguggagccccacuggaucgcggccuccaucauccuggaguucuuccucaugguccugcugauccccgagccggaccgccagcggacgccccaggacaaccagcucgccuacguggugaucgggcugcuguucaugauccucaccgucgccgccaacgagaugggccugcuggagaccaccaagaaggaccucgggaucggccacguggcgguggagaaccaccaccacgccgccaugcuggacgucgaccugcaccccgccagcgccuggacgcucuacgcgguggccaccaccaucaucaccccgaugaugcgccacacgaucgagaacaccaccgccaacaucucccugaccgccaucgccaaccaggcggccauccugauggggcucgacaagggcuggcccaucagcaagauggacaucggcgugccccugcuggcccucgggugcuacucccaggucaacccccugacgcugaccgccgcggugcucaugcugguggcccacuacgccaucaucggcccggggcugcaggccaaggccacccgcgaggcgcagaagcggaccgccgccggcaucaugaagaaccccacggucgacgggaucguggccaucgaccucgaccccguggucuacgacgccaaguucgagaagcagcugggccagaucaugcugcucauccugugcaccagccagauccugcucaugcgcaccaccugggcgcugugcgaguccaucacgcuggccaccggcccccucaccacccugugggaggggagcccgggcaaguucuggaacacgaccaucgccguguccauggccaacaucuuccgggggagcuaccuggccggcgcgggccucgccuucucccugaugaagucccucgggggcgggcgccgggggaccggggcccagggcgagacccucggcgagaaguggaagcgccagcugaaccagcugagcaaguccgaguucaacacguacaagcggagcgggaucauggagguggaccgcuccgaggccaaggagggccucaagcgcggggagaccaccaagcacgcggucagccgcggcaccgccaagcugcggugguucguggagcgcaaccuggugaagcccgaggggaaggucaucgaccugggcugcggccgcggcgggugguccuacuacugcgccgggcucaagaaggugacggaggugaagggguacaccaagggcggccccggccacgaggagcccaucccgauggccaccuacggguggaaccuggucaagcugcacagcggcaaggacguguucuucaucccgcccgagaagugcgacacccuccugugcgacaucggggaguccagccccaacccgacgaucgaggagggccgcacccugcgggugcucaagauggucgagcccuggcugcgcgggaaccaguucugcaucaagauccugaaccccuacaugcccuccgugguggagacccucgagcagaugcagcggaagcacggcggcaugcugguccgcaacccgcugagccggaacuccacccacgagauguacugggugagcugcgggaccggcaacaucguguccgccgucaacaugacgagccgcaugcuccugaaccgcuucaccauggcgcaccggaagcccaccuacgagcgcgacguggaccugggggccggcacccggcacguggccgucgagcccgagguggccaaccucgacaucaucggccagcgcaucgagaacaucaagcacgagcacaaguccacguggcacuacgacgaggacaaccccuacaagaccugggccuaccacgggagcuacgaggugaagccguccggcagcgcguccagcauggucaacgggguggucaagcugcugaccaagcccugggacgugauccccauggugacccagaucgccaugacggacaccacccccuucggccagcagcgggucuucaaggagaagguggacacccgcacgccgaaggccaagcgggggaccgcccagaucauggaggugaccgccaaguggcucuggggcuuccugagccgcaacaagaagccccggaucugcacccgcgaggaguucacgcggaagguccgcuccaacgcggccaucggcgccguguucguggacgagaaccaguggaacagcgccaaggaggcggucgaggacgagcgguucugggaccuggugcaccgcgagcgggagcuccacaagcaggggaagugcgcgaccugcguguacaacaugaugggcaagcgcgagaagaagcugggggaguucggcaaggccaaggggucccgggccaucugguacauguggcugggcgcccgcuuccucgaguucgaggcgcugggcuucaugaacgaggaccacugguucagccgggagaacucccugagcggggucgagggcgaggggcuccacaagcugggcuacauccugcgcgacaucuccaagauccccgggggcaacauguacgccgacgacaccgccggcugggacacccggaucacggaggacgaccuccagaacgaggcccgcaucaccgacaucauggagccggagcacgcccugcuggccaagagcaucuucaagcucaccuaccagaacaagguggugcgcguccagcggcccgccaagaacgggaccgugauggacgugaucucccgccgggaccagcgcggcagcgggcaggucggcacguacggccugaacaccuucaccaacauggaggcccagcugauccggcagauggaguccgaggggaucuucagccccuccgagcucgagauccccaaccuggccgagcgcgugcuggacuggcucgagaaguacggcguggagcggcugaagcgcauggccaucagcggggacgacugcgucgugaagccgaucgacgaccgguucgcgaccgcccugacggcccucaacgacaugggcaaggugcgcaaggacaucccccagugggagcccuccaagggguggaacgacuggcagcagguccccuucugcagccaccacuuccaccagcugaucaugaaggacggccgggagaucguggugccgugccgcaaccaggacgagcuggucggccgggcccgcgugucccagggggccggcuggagccuccgggagaccgcgugccugggcaagagcuacgcccagauguggcagcugauguacuuccaccgccgggaccuccgccuggccgccaacgcgaucugcuccgccgugcccgucgacuggauccccaccagccggaccacgugguccauccacgcccaccaccaguggaugaccaccgaggacaugcugagcguguggaaccgcguguggaucgaggagaaccccuggauggaggacaagacccacaucuccagcuggggcgacgucccguaccucgggaagcgcgaggaccaguggugcggcucccugaucggccugacggcccgggccaccugggcgaccaacauccagguggccaucaaccaggugcgccggcucaucgggaacgagaacuaccuggacuacaugaccagcaugaagcgcuucaagaacgagggcgaccccgagggggcccugugguga

SEQ ID NO: 8312 - RNA, 9879 nt, Artificial Sequence
  derived and/or modified CDS sequence (opt1) from DENV-1__EU677178__SS-prME
agcgugaccaugcugcugaugcugaugcccaccgcccuggccuuccaccucaccacccggggcggggagccccacaugaucgugagcaagcaggagcggggcaagagccugcuguucaagaccuccgccggggugaacaugugcacccucaucgccauggaccugggcgagcugugcgaggacaccaugaccuacaagugcccccggaucaccgagaccgagcccgacgacguggacugcuggugcaacgccaccgacaccugggugaccuacgggaccugcagccagacgggcgagcaccggcgggacaagcgguccguggcccucgcgccccacgugggccuggggcuggagacccgcaccgagaccuggaugagcuccgagggcgcguggaagcagauccagcgggucgagacgugggcccuccggcaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagguggccgagacccagcacggcaccgugcugguccagaucaaguacgagggcaccgacgcgcccugcaagauccccuuccugacgcaggacgagaagggggugacccagaacggccggcugaucaccgccaacccgaucgugaccgacaaggagaagcccgucaacaucgaggccgagccgcccuucggggagagcuacaucaucaucggcgccggcgagaaggcgcucaagcuguccugguucaagaaggggagcuccaucggcaagauguucgaggccacggcccgcggggcccggcgcauggccauccugggcgacaccgcgugggacuucgggagcaucggcggcguguucaccuccguggggaagcucguccaccagaucuucggcaccgccuacggggugcuguucagcggcguguccuggacgaugaagaucgggaucggcguccugcucaccuggcugggccugaacagccgcuccaccagccucuccaugaccugcaucgccguggggcuggugacgcuguaccucggcgucauggugcaggccgacagcgggugcgugaucaacuggaagggccgggagcugaagugcggguccggcaucuucgucaccaacgaggugcacaccuggaccgagcaguacaaguuccaggccgacagcccgaagcgccugagcgcggccaucggcaaggccugggaggagggggugugcggcauccgguccgccacccgccucgagaacaucauguggaagcagaucagcaacgagcugaaccacauccugcucgagaacgacaugaaguucacggucguggugggggacgucgccggcauccuggcgcaggggaagaagaugauccggccccagcccauggaguacaaguacuccuggaaguccuggggcaaggccaagaucaucggcgccgacgugcagaacaccaccuucaucaucgacgggcccaacaccccggagugccccgacgaccagcgcgccuggaacaucugggagguggaggacuacggcuucgggaucuucacgaccaacaucuggcugaagcuccgggacucccacacccaggucugcgaccaccgccugaugagcgcggccaucaaggacuccaaggccgugcacgccgacaugggcuacuggaucgagagcgagaagaacgagaccuggaagcuggcccgggcguccuucaucgaggugaagacgugcaucuggcccaagagccacacccucugguccaacggcguccuggagagcgagaugaucauccccaagaucuacgggggcccgaucucccagcacaacuaccgccccggguacuucacccagaccgccggccccuggcaccuggggaagcucgagcuggacuucgaccugugcgagggcacgaccgugguggucgacgagcacugcggcaaccgggggccgagccuccgcaccaccacggugaccggcaagaucauccacgaguggugcugccgguccugcacccugccgccccugcgcuuccgcggggaggacggcugcugguacgggauggagauccgccccgugaaggagaaggaggagaaccucgucaagagcaugguguccgccggcagcggcgagguggacagcuucucccuggggcugcucugcaucagcaucaugaucgaggaggucaugcggucccgcuggagccggaagaugcugaugaccggcacgcuggccguguucuuccuccugaucauggggcagcugaccuggaacgaccucauccgccugugcaucauggugggcgccaacaccuccgaccgcauggggaugggcaccacguaccuggcgcucauggccaccuucaagaugcggccgauguucgccgucggccugcuguuccgccggcucaccagccgcgaggugcugcugcucaccaucgggcugucccugguggccagcgucgagcuccccaacucccuggaggagcugggcgacgggcucgccaugggcaucaugauccugaagcugcucacggacuuccagagccaccagcugugggcgacccugcucucccugaccuucaucaagaccacguucagccugcacuacgccuggaagaccauggccauggugcucuccaucgucagccuguucccccugugccucuccaccaccagccagaagacgaccuggcugcccgugcugcucggcucccuggggugcaagccgcugaccauguuccucaucgccgagaacaagaucuggggccggcgcagcuggccccugaacgaggggaucauggcggugggcaucgucuccauccugcucagcagccugcugaagaacgacgugccccucgccgggccccugaucgccggcggcaugcugaucgccugcuacgugaucuccgggagcuccgccgaccucagccuggagaaggcggccgaggucuccugggaggaggaggccgagcacagcggcgccucccacaacauccugguggaggugcaggacgacgggaccaugaagaucaaggacgaggagcgggacgacacccucacgauccugcugaaggccacccuccuggcggucagcggcguguacccgcuguccauccccgccacccucuucgugugguacuucuggcagaagaagaagcagcgcagcgggguccugugggacacccccagcccgcccgagguggagcgggccgugcuggacgacggcaucuaccgcaucaugcagcggggccugcucgggcgcagccaggucggcguggggguguuccaggagaacgucuuccacacgauguggcacgugacccggggcgccgugcugauguaccaggggaagcgccuggagcccuccugggccagcgucaagaaggaccucaucuccuacggcggcggguggcggcugcagggcagcuggaacaccggggaggagguccaggugaucgcggucgagcccggcaagaaccccaagaacgugcagaccgcccccgggacguucaagacccccgagggcgaggugggcgccaucgcccuggacuucaagcccgggaccuccggcagccccaucgucaaccgcgaggggaagaucgugggccucuacggcaacgggguggucaccacguccggcaccuacgugagcgccaucgcgcaggccaaggccagccaggaggggccgcugcccgagaucgaggacgagguguuccggaagcgcaaccugaccaucauggaccuccaccccggcuccgggaagacccggcgcuaccugccggccaucguccgggaggcgaucaagcgcaagcugcgcacgcucauccuggcccccacccgggugguggccagcgagauggccgaggcccugaagggcaugcccauccgcuaccagaccaccgcggucaaguccgagcacacgggcaaggagaucguggaccucaugugccacgccaccuucaccaugcggcugcugagccccgugcgcgucccgaacuacaacaugaucaucauggacgaggcccacuucaccgaccccuccagcaucgccgcccggggguacaucuccacgcgcgugggcaugggggaggcggccgccaucuucaugaccgccacgccgcccggcagcguggaggccuucccgcaguccaacgcggucauccaggacgaggagcgggacauccccgagcgcagcuggaacuccggguacgaguggaucaccgacuuccccggcaagacggugugguucgugcccagcaucaaguccggcaacgacaucgccaacugccuccggaagaacgggaagcgcgucauccagcugagccggaagaccuucgacaccgaguaccagaagaccaagaacaacgacugggacuacguggugacgaccgacaucuccgagaugggcgccaacuuccgcgccgaccgggucaucgacccgcgccggugccugaagcccgugauccucaaggacgggcccgagcgcgugauccuggcgggccccaugccggucaccguggccagcgccgcccagcggcgcgggcggaucggccgcaaccacaacaaggagggcgaccaguacaucuacauggggcagccccugaacaacgacgaggaccacgcccacuggaccgaggcgaagaugcuccuggacaacaucaacacgcccgagggcaucauccccgcccuguucgagccggagcgcgagaaguccgccgccaucgacggggaguaccggcuccgcggcgaggcccggaagaccuucgucgagcugaugcgccgcggggaccugcccguguggcucagcuacaagguggcguccgagggcuuccaguacagcgaccgccgguggugcuucgacggcgagcgcaacaaccagguccuggaggagaacauggacguggagaucuggaccaaggagggggagcggaagaagcugcgcccccgguggcucgacgcccgcaccuacagcgacccccuggcccugcgggaguucaaggaguucgccgccggccgccgguccgugagcggggaccucauccuggagaucggcaagcugccgcagcaccucacgcagcgcgcgcagaacgcccuggacaaccuggucaugcuccacaacuccgagcagggcgggcgggccuaccgccacgccauggaggagcugcccgacaccaucgagacccugaugcuccuggcgcugaucgccgugcucaccggcggggugacccuguucuuccugagcggccgggggcucggcaagacguccaucggccugcugugcgucauggccagcuccgugcuccuguggauggccagcguggagccccacuggaucgccgcguccaucauccuggaguucuuccucaugguccugcugauccccgagccggaccgccagcggacgccccaggacaaccagcucgccuacguggugaucgggcugcuguucaugauccucaccgucgccgccaacgagaugggccugcuggagaccacgaagaaggaccucgggaucggccacguggccguggagaaccaccaccacgcggccaugcuggacgucgaccugcaccccgccagcgccuggacccucuacgccguggcgaccaccaucaucacgccgaugaugcgccacaccaucgagaacaccaccgccaacaucucccugacggccaucgccaaccaggccgcgauccugauggggcucgacaagggcuggcccaucagcaagauggacaucggcgugccccugcuggcccucgggugcuacucccaggucaacccccugacccugaccgccgccgugcucaugcugguggcgcacuacgccaucaucggcccggggcugcaggccaaggccacccgcgaggcccagaagcggacggcggccggcaucaugaagaaccccaccgucgacgggaucguggccaucgaccucgaccccguggucuacgacgccaaguucgagaagcagcugggccagaucaugcugcucauccugugcaccagccagauccugcucaugcgcaccacgugggcccugugcgaguccaucacccuggcgaccggcccccucaccacgcugugggaggggagcccgggcaaguucuggaacaccaccaucgccguguccauggccaacaucuuccgggggagcuaccuggccggcgccggccucgcguucucccugaugaagucccucgggggcgggcgccgggggaccggggcccagggcgagacgcucggcgagaaguggaagcgccagcugaaccagcugagcaaguccgaguucaacaccuacaagcggagcgggaucauggagguggaccgcuccgaggccaaggagggccucaagcgcggggagaccaccaagcacgccgucagccgcggcacggcgaagcugcggugguucguggagcgcaaccuggugaagcccgaggggaaggucaucgaccugggcugcggccgcggcgggugguccuacuacugcgccgggcucaagaaggugaccgaggugaagggguacaccaagggcggccccggccacgaggagcccaucccgauggccaccuacggguggaaccuggucaagcugcacagcggcaaggacguguucuucaucccgcccgagaagugcgacacgcuccugugcgacaucggggaguccagccccaacccgaccaucgaggagggccgcacccugcgggugcucaagauggucgagcccuggcugcgcgggaaccaguucugcaucaagauccugaaccccuacaugcccuccgugguggagacccucgagcagaugcagcggaagcacggcggcaugcugguccgcaacccgcugagccggaacuccacccacgagauguacugggugagcugcgggacgggcaacaucguguccgccgucaacaugaccagccgcaugcuccugaaccgcuucaccauggcccaccggaagcccaccuacgagcgcgacguggaccugggggcgggcacgcggcacguggccgucgagcccgagaucgccaaccucgacaucaucggccagcgcaucgagaacaucaagcacgagcacaaguccaccuggcacuacgacgaggacaaccccuacaagaccugggccuaccacgggagcuacgaggugaagccguccggcagcgccuccagcauggugaacggggucgugaagcugcugaccaagcccugggacgucauccccauggugacgcagaucgcgaugaccgacaccacccccuucggccagcagcggguguucaaggagaaggucgacacgcgcaccccgaaggccaagcgggggaccgcccagaucauggaggugaccgccaaguggcucuggggcuuccugagccgcaacaagaagccccggaucugcacgcgcgaggaguucacccggaaggugcgcuccaacgccgcgaucggcgccgucuucguggacgagaaccaguggaacagcgccaaggaggccguggaggacgagcgguucugggaccugguccaccgcgagcgggagcuccacaagcaggggaagugcgcgaccugcguguacaacaugaugggcaagcgcgagaagaagcugggggaguucggcaaggccaaggggucccgggccaucugguacauguggcugggcgcccgcuuccucgaguucgaggcccugggcuucaugaacgaggaccacugguucagccgggagaacucccugagcgggguggagggcgaggggcuccacaagcugggcuacauccugcgcgacaucuccaagauccccgggggcaacauguacgcggacgacaccgccggcugggacacgcggaucaccgaggacgaccuccagaacgaggcccgcaucaccgacaucauggagccggagcacgcccugcuggccaagagcaucuucaagcucaccuaccagaacaaggucgugcgcgugcagcggcccgcgaagaacgggacggucauggacgugaucucccgccgggaccagcgcggcagcggccagguggggaccuacggccugaacaccuucaccaacauggaggcccagcugauccggcagauggaguccgaggggaucuucagccccuccgagcucgagacgcccaaccuggccgagcgcguccuggacuggcucgagaaguacggcguggagcggcugaagcgcauggccaucagcggggacgacugcguggucaagccgaucgacgaccgguucgccaccgcgcugaccgcccucaacgacaugggcaaggugcgcaaggacaucccccagugggagcccuccaagggguggaacgacuggcagcagguccccuucugcagccaccacuuccaccagcugaucaugaaggacggccgggagaucgucgugccgugccgcaaccaggacgagcuggugggccgggcccgcgucucccagggggccggcuggagccuccgggagaccgccugccugggcaagagcuacgcgcagauguggcagcugauguacuuccaccgccgggaccuccgccuggccgccaacgccaucugcuccgcggugcccguggacuggauccccacgagccggaccaccugguccauccacgcccaccaccaguggaugaccacggaggacaugcugagcgucuggaaccgcguguggaucgaggagaaccccuggauggaggacaagacccacaucuccagcuggggcgacgugccguaccucgggaagcgcgaggaccaguggugcggcucccugaucggccugaccgcccgggccaccugggccaccaacauccaggucgcgaucaaccaggugcgccggcucaucgggaacgagaacuaccuggacuacaugacgagcaugaagcgcuucaagaacgagggcgaccccgagggggcccugugguga

SEQ ID NO: 8313 - RNA, 9879 nt, Artificial Sequence
  derived and/or modified CDS sequence (opt1) from DENV-1__EU687251__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgagaccgagcccgacgacguggacugcuggugcaacgccacggacaccugggucaccuacgggaccugcagccagacgggcgagcaccggcgggacaagcgguccguggcccucgcgccccacgugggccuggggcuggagacccgcaccgagaccuggaugagcuccgagggcgccuggaagcagauccagcgggucgagacgugggcccuccggcaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagguggccgagacccagcacggcaccgugcugguccagaucaaguacgagggcaccgacgcgcccugcaagauccccuucagcacgcaggacgagaagggggugacccagaacggccggcugaucaccgccaacccgaucgugaccgacaaggagaagcccgucaacaucgaggccgagccgcccuucggggaguccuacaucaucaucggcgccggcgagaaggcgcugaagcucagcugguucaagaagggguccagcaucggcaagauguucgaggccacggcccgcggggcccggcgcauggccauccugggcgacaccgcgugggacuucggguccaucggcggcguguucaccagcguggggaagcugguccaccagaucuucggcaccgccuacggggugcuguucuccggcgugagcuggacgaugaagaucgggaucggcguccugcugaccuggcucggccugaacucccgcagcaccucccugagcaugaccugcaucgccguggggcucgugacgcuguaccugggcgucauggugcaggccgacuccgggugcgugaucaacuggaagggccgggagcucaagugcgggagcggcaucuucgucaccaacgaggugcacaccuggaccgagcaguacaaguuccaggccgacagcccgaagcgccuguccgcggccaucggcaaggccugggaggagggggugugcggcauccggagcgccacccgccuggagaacaucauguggaagcagaucuccaacgagcucaaccacauccugcuggagaacgacaugaaguucacggucguggugggggacgucgccggcauccucgcgcaggggaagaagaugauccggccccagcccauggaguacaaguacagcuggaaguccuggggcaaggccaagaucaucggcgccgacgugcagaacaccaccuucaucaucgacgggcccaacaccccggagugccccgacgaccagcgcgccuggaacaucugggagguggaggacuacggcuucgggaucuucacgaccaacaucuggcugaagcugcgggacagccacacccaggucugcgaccaccgccucauguccgcggccaucaaggacagcaaggccgugcacgccgacaugggcuacuggaucgaguccgagaagaacgagaccuggaagcuggcccgggcgagcuucaucgaggugaagacgugcaucuggcccaagucccacacccuguggagcaacggcguccucgaguccgagaugaucauccccaagaucuacgggggcccgaucagccagcacaacuaccgccccggguacuucacccagaccgccggccccuggcaccuggggaagcuggagcucgacuucgaccugugcgagggcacgaccgugguggucgacgagcacugcggcaaccgggggccgucccugcgcaccaccacggugaccggcaagaucauccacgaguggugcugccggagcugcacccugccgccccuccgcuuccgcggggaggacggcugcugguacgggauggagauccgccccgugaaggagaaggaggagaaccuggucaaguccauggugagcgccggcagcggcgagguggacuccuucagccucgggcugcugugcaucuccaucaugaucgaggaggucaugcggagccgcuggucccggaagaugcucaugaccggcacgcuggccguguucuuccugcucaucauggggcagcugaccuggaacgaccugauccgccucugcaucauggugggcgccaacgcgagcgaccgcauggggaugggcaccaccuaccuggcccugauggccacguucaagaugcggccgauguucgccgucggccuccuguuccgccggcugaccucccgcgaggugcuccugcugaccaucgggcucagccugguggccuccgucgagcugcccaacagccucgaggagcugggcgacgggcuggcgaugggcaucaugauccucaagcugcugaccgacuuccagucccaccagcucugggccacgcugcugagccucaccuucaucaagaccaccuucucccugcacuacgccuggaagacgauggccauggugcugagcaucgucucccucuucccccugugccugagcaccaccucccagaagaccacguggcuccccgugcugcugggcagccucgggugcaagccgcugaccauguuccugaucgcggagaacaagaucuggggccggcgcuccuggccccucaacgaggggaucauggccgugggcaucgucagcauccugcugagcucccuccugaagaacgacgugccccuggccgggccccucaucgccggcggcaugcugaucgccugcuacgugaucagcggguccagcgcggaccugucccucgagaaggccgccgaggucagcugggaggaggaggccgagcacuccggcgccagccacaacauccugguggaggugcaggacgacgggaccaugaagaucaaggacgaggagcgggacgacacccugaccauccuccugaaggcgacgcugcucgccgucuccggcguguacccgcugagcauccccgccacccuguucgugugguacuucuggcagaagaagaagcagcgcuccgggguccucugggacacccccagcccgcccgagguggagcgggccgugcuggacgacggcaucuaccgcaucaugcagcggggccugcuggggcgcucccaggucggcguggggguguuccaggagaacgucuuccacaccauguggcacgugacgcggggcgccgugcucauguaccaggggaagcgccuggagcccagcugggcguccgucaagaaggaccugaucagcuacggcggcggguggcggcuccagggcuccuggaacaccggggaggagguccaggugaucgccgucgagcccggcaagaaccccaagaacgugcagaccgcccccgggaccuucaagacgcccgagggcgaggugggcgccaucgcccuggacuucaagcccgggaccagcggcucccccaucgucaaccgcgaggggaagaucgugggccuguacggcaacgggguggucaccaccagcggcacguacgugagcgcgaucgcccaggccaaggccucccaggaggggccgcuccccgagaucgaggacgagguguuccggaagcgcaaccugaccaucauggaccugcaccccggcagcgggaagacccggcgcuaccucccggcgaucguccgggaggccaucaagcgcaagcugcgcacccugauccucgcccccacgcgggugguggccuccgagauggccgaggcgcugaagggcaugcccauccgcuaccagaccaccgccgucaagagcgagcacaccggcaaggagaucguggaccugaugugccacgccacguucaccaugcggcuccugucccccgugcgcgucccgaacuacaacaugaucaucauggacgaggcccacuucaccgaccccagcuccaucgccgcgcggggguacaucagcacccgcgugggcaugggggaggccgccgccaucuucaugacggccacgccgcccggcuccguggaggcguucccgcagagcaacgccgucauccaggacgaggagcgggacauccccgagcgcuccuggaacagcggguacgaguggaucaccgacuuccccggcaagaccgugugguucgugcccuccaucaagagcggcaacgacaucgccaacugccugcggaagaacgggaagcgcgucauccagcucucccggaagacguucgacaccgaguaccagaagaccaagaacaacgacugggacuacguggugaccacggacaucagcgagaugggcgccaacuuccgcgcggaccgggucaucgacccgcgccggugccugaagcccgugauccugaaggacgggcccgagcgcgugauccucgccggccccaugccggucaccguggccuccgccgcccagcggcgcgggcggaucggccgcaaccacaacaaggagggcgaccaguacaucuacauggggcagccccugaacaacgacgaggaccacgcgcacuggaccgaggccaagaugcugcucgacaacaucaacacccccgagggcaucauccccgcccuguucgagccggagcgcgagaaguccgccgccaucgacggggaguaccggcugcgcggcgaggcgcggaagacguucgucgagcucaugcgccgcggggaccugcccguguggcuguccuacaagguggccagcgagggcuuccaguacagcgaccgccgguggugcuucgacggcgagcgcaacaaccagguccucgaggagaacauggacguggagaucuggaccaaggagggggagcggaagaagcugcgcccccgguggcuggacgcccgcaccuacuccgacccccucgcccugcgggaguucaaggaguucgccgcgggccgccggagcguguccggggaccugauccucgagaucggcaagcugccgcagcaccugacccagcgcgcccagaacgcccucgacaaccuggucaugcugcacaacagcgagcagggcgggcgggccuaccgccacgcgauggaggagcuccccgacacgaucgagacccugaugcugcucgcccugaucgccgugcugaccggcggggugacccucuucuuccuguccggccgggggcugggcaagaccagcaucggccuccugugcgucauggccuccagcgugcugcucuggauggccuccguggagccccacuggaucgcggccagcaucauccuggaguucuuccugaugguccuccugauccccgagccggaccgccagcggacgccccaggacaaccagcuggccuacguggugaucgggcuccuguucaugauccugaccgucgccgccaacgagaugggccuccuggagaccaccaagaaggaccuggggaucggccacguggcgguggagaaccaccaccacgccgccaugcucgacgucgaccugcaccccgccuccgccuggacgcuguacgcgguggccaccaccaucaucaccccgaugaugcgccacacgaucgagaacaccaccgccaacaucagccucaccgccaucgccaaccaggcggccauccugauggggcuggacaagggcuggcccaucuccaagauggacaucggcgugccccuccuggcccuggggugcuacagccaggucaacccccucacgcugaccgccgcggugcugaugcucguggcccacuacgccaucaucggcccggggcugcaggccaaggccacccgcgaggcgcagaagcggaccgccgccggcaucaugaagaaccccacggucgacgggaucguggccaucgaccuggaccccguggucuacgacgccaaguucgagaagcagcucggccagaucaugcugcugauccucugcaccucccagauccugcugaugcgcaccaccugggcgcucugcgagagcaucacgcuggccaccggcccccugaccacccucugggagggguccccgggcaaguucuggaacacgaccaucgccgugagcauggccaacaucuuccggggguccuaccuggccggcgcgggccuggccuucagccucaugaagucccucgggggcgggcgccgggggaccggggcccagggcgagacccugggcgagaaguggaagcgccagcucaaccagcuguccaagagcgaguucaacacguacaagcgguccgggaucauggagguggaccgcagcgaggccaaggagggccugaagcgcggggagaccaccaagcacgcggucucccgcggcaccgccaagcuccggugguucguggagcgcaaccuggugaagcccgaggggaaggucaucgaccugggcugcggccgcgggggcuggagcuacuacugcgccgggcugaagaaggugacggaggugaagggcuacaccaagggcggccccggccacgaggagcccaucccgauggccaccuacggguggaaccucgucaagcugcacuccggcaaggacguguucuucaucccgcccgagaagugcgacacccugcucugcgacaucggggagagcucccccaacccgacgaucgaggagggccgcacccugcgggugcugaagauggucgagcccuggcuccgcgggaaccaguucugcaucaagauccugaaccccuacaugcccagcgugguggagacccuggagcagaugcagcggaagcacggcggcaugcucguccgcaacccgcugucccggaacagcacccacgagauguacuggguguccugcgggaccggcaacaucgugagcgccgucaacaugacgucccgcaugcugcucaaccgcuucaccauggcgcaccggaagcccaccuacgagcgcgacguggaccugggggccggcacccggcacguggccgucgagcccgagguggccaaccuggacaucaucggccagcgcaucgagaacaucaagcacgagcacaagagcacguggcacuacgacgaggacaaccccuacaagaccugggccuaccacggguccuacgaggugaagccgagcggcuccgcgagcagcauggucaacgggguggucaagcuccugaccaagcccugggacgugauccccauggugacccagaucgccaugacggacaccacccccuucggccagcagcgggucuucaaggagaagguggacacccgcacgccgaaggccaagcgggggaccgcccagaucauggaggugaccgccaaguggcuguggggcuuccucucccgcaacaagaagccccggaucugcacccgcgaggaguucacgcggaagguccgcagcaacgcggccaucggcgccguguucguggacgagaaccaguggaacuccgccaaggaggcggucgaggacgagcgguucugggaccuggugcaccgcgagcgggagcugcacaagcaggggaagugcgcgaccugcguguacaacaugaugggcaagcgcgagaagaagcucggggaguucggcaaggccaaggggagccgggccaucugguacauguggcugggcgcccgcuuccuggaguucgaggcgcucggcuucaugaacgaggaccacugguucucccgggagaacagccuguccggggucgagggcgaggggcugcacaagcucggcuacauccugcgcgacaucagcaagauccccgggggcaacauguacgccgacgacaccgccggcugggacacccggaucacggaggacgaccugcagaacgaggcccgcaucaccgacaucauggagccggagcacgcccuccuggcgaaguccaucuucaagcugaccuaccagaacaagguggugcgcguccagcggcccgccaagaacgggaccgugauggacgugaucagccgccgggaccagcgcggcuccgggcaggucggcacguacggccucaacaccuucaccaacauggaggcccagcugauccggcagauggagagcgaggggaucuucucccccagcgagcuggagacccccaaccucgccgagcgcgugcuggacuggcugaagaaguacggcguggagcggcucaagcgcauggccaucuccggggacgacugcgucgugaagccgaucgacgaccgguucgcgacggcccugaccgcccugaacgacaugggcaaggugcgcaaggacaucccccagugggagcccagcaagggguggaacgacuggcagcagguccccuucugcucccaccacuuccaccagcucaucaugaaggacggccgggagaucguggugccgugccgcaaccaggacgagcuggucggccgggcccgcgugagccagggggccggcuggagccugcgggagaccgcgugccucgggaaguccuacgcccagauguggcagcugauguacuuccaccgccgggaccugcgccucgccgccaacgcgaucugcagcgccgugcccgucgacuggauccccaccucccggacgaccuggagcauccacgcccaccaccaguggaugaccaccgaggacaugcuguccguguggaaccgcguguggaucgaggagaaccccuggauggaggacaagacgcacaucagcuccuggggcgacgucccguaccuggggaagcgcgaggaccaguggugcggcagccucaucggccugaccgcccgggccaccugggcgaccaacauccagguggccaucaaccaggugcgccggcugaucgggaacgagaacuaccucgacuacaugaccuccaugaagcgcuucaagaacgagagcgaccccgagggcgcccugugguga

SEQ ID NO: 8314 - RNA, 9879 nt, Artificial Sequence
  derived and/or modified CDS sequence (opt1) from DENV-1__FJ024427__SS-prME
agcgugaccaugcugcucaugcugaugcccaccgcccuggccuuccaccucaccacccgcggcggggagccccacaugaucgugagcaagcaggagcggggcaagagccugcuguucaagaccagcgcgggggugaacaugugcacccucaucgccauggaccugggcgagcugugcgaggacaccaugaccuacaagugcccccgcaucaccgagaccgagcccgacgacguggacugcuggugcaacgccacggacaccugggugaccuacgggaccugcagccagacgggcgagcaccggcgcgacaagcgguccguggcccucgcgccccacgugggccuggggcuggagacccgcaccgagaccuggaugagcuccgagggcgcguggaagcagauccagcgggucgagacgugggcccuccgccaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccggguacggcgcccugacgcuggacugcagcccccgcaccgggcucgacuucaacgagaugguccugcugaccaugaaggagaaguccuggcucgugcacaagcagugguuccuggaccugccccuccccuggaccagcggcgccagcacgucccaggagaccuggaaccggcaggaccugcuggugaccuucaagaccgcccacgccaagaagcaggaggucguggugcucggcagccaggagggggcgaugcacacggcccugaccggcgccaccgagauccagaccuccgggacgaccaccaucuucgccggccaccugaagugccgccucaagauggacaagcugacccugaaggggaugagcuacgucaugugcacgggcuccuucaagcucgagaaggagguggccgagacccagcacggcaccgugcugguccagaucaaguacgagggggcggacgcccccugcaagauccccuucagcacccaggacgagaagggcaucacgcagaacgggcggcugaucaccgccaacccgaucgugaccgacaaggagaagcccgugaacaucgaggccgagccgcccuucggcgaguccuacaucgucaucggcgcgggggagaaggcccugaagcucagcugguucaagaagggcuccagcaucgggaagauguucgaggccaccgcccgcggcgcccggcgcauggcgauccugggggacacggccugggacuucggcuccaucggcgggguguucaccagcgugggcaagcugguccaccagaucuucgggaccgccuacggcguccucuucuccggggugagcuggaccaugaagaucggcaucggcguccugcugacguggcucgggcugaacucccgcagcaccucccugagcaugaccugcaucgccgugggccucgugacccuguaccugggggucauggugcaggccgacuccggcugcgugaucaacuggaaggggcgggagcucaagugcggcagcggcaucuucgucacgaacgaggugcacaccuggaccgagcaguacaaguuccaggcggacagcccgaagcgccuguccgccgccaucgggaaggccugggaggagggcgugugcgggauccggagcgccacccgccuggagaacaucauguggaagcagaucuccaacgagcucaaccacauccugcuggagaacgacaugaaguucaccgucguggugggcgacgucgcggggauccucgcccagggcaagaagaugauccggccccagcccauggaguacaaguacagcuggaaguccuggggcaaggccaagaucaucggggccgacgugcagaacacgaccuucaucaucgacggccccaacaccccggagugccccgacgaccagcgcgcguggaacaucugggagguggaggacuacggguucggcaucuucaccacgaacaucuggcugaagcugcgggacagcuacacccaggucugcgaccaccgccucauguccgccgccaucaaggacagcaaggccgugcacgccgacaugggcuacuggaucgaguccgagaagaacgagaccuggaagcuggcgcgggccagcuucaucgaggugaagaccugcaucuggcccaagucccacacgcuguggagcaacgggguccucgaguccgagaugaucauccccaagaucuacggcgggccgaucagccagcacaacuaccgccccggcuacuucacccagaccgccgggcccuggcaccugggcaagcuggagcucgacuucgaccugugcgagggcaccacggugguggucgacgagcacugcgggaaccggggcccgucccugcgcaccaccaccgugacggggaagaucauccacgaguggugcugccggagcugcacccugccgccccuccgcuuccggggcgaggacgggugcugguacggcauggagauccgccccgugaaggagaaggaggagaaccuggucaaguccauggugagcgccggcagcggggagguggacuccuucagccucggccugcugugcaucuccaucaugaucgaggaggucaugcggagccgcuggucccggaagaugcucaugaccgggacccuggccguguucuuccugcucaucaugggccagcugacguggaacgaccugauccgccucugcaucauggugggggcgaacgccagcgaccgcaugggcaugggcaccaccuaccuggcccugauggccaccuucaagaugcggccgauguucgccgucgggcuccuguuccgccggcugacgucccgcgaggugcuccugcugaccaucgggcucagccugguggcguccgucgagcugcccaacagccucgaggagcugggggacggccuggccaugggcaucaugauccucaagcugcugaccgacuuccagucccaccagcucugggccacccugcugagccucacguucaucaagaccaccuucucccugcacuacgccuggaagaccauggcgauggugcugagcaucgucucccucuucccccugugccugagcacgaccucccagaagaccaccuggcuccccgugcugcuggggagccucggcugcaagccgcugacgauguuccugaucgccgagaacaagaucugggggcggcgcuccuggccccucaacgagggcaucauggccguggggaucgucagcauccugcugagcucccuccugaagaacgacgugccccuggccggcccccucaucgccggcgggaugcugaucgcgugcuacgugaucagcggcuccagcgccgaccugucccucgagaaggccgccgaggucagcugggaggaggaggccgagcacuccggggcgagccacaacauccugguggaggugcaggacgacggcaccaugaagaucaaggacgaggagcgggacgacacccugaccauccuccugaaggccacccugcucgccgucuccgggguguacccgcugagcauccccgccacgcuguucgugugguacuucuggcagaagaagaagcagcgcuccggcguccucugggacacccccagcccgcccgagguggagcgggccgugcuggacgacggcaucuaccgcaucaugcagcgggggcugcugggccgcucccaggucggggugggcguguuccaggagaacgucuuccacaccauguggcacgugacccgcggggccgugcucauguaccagggcaagcggcuggagcccagcugggccuccgucaagaaggaccugaucagcuacggcgggggcuggcggcuccagggguccuggaacacgggcgaggagguccaggugaucgccgucgagcccgggaagaaccccaagaacgugcagaccgcccccggcaccuucaagacccccgagggcgaggugggggccaucgcgcuggacuucaagcccggcacgagcgggucccccaucgucaaccgcgagggcaagaucgugggccuguacgggaacggcguggucaccaccagcgggaccuacgugagcgccaucgcccaggccaaggcgucccaggagggcccgcuccccgagaucgaggacgagguguuccggaagcgcaaccugacgaucauggaccugcaccccgggagcggcaagacccggcgcuaccucccggccaucguccgggaggccaucaagcgcaagcugcgcacccugauccucgcccccacccgggugguggccuccgagauggcggaggcccugaagggcaugcccauccgcuaccagacgaccgccgucaagagcgagcacaccgggaaggagaucguggaccugaugugccacgccaccuucacgaugcggcuccugucccccgugcgcgucccgaacuacaacaugaucaucauggacgaggcccacuucaccgaccccagcuccaucgcggcccggggcuacaucagcacccgcguggggaugggcgaggccgccgccaucuucaugaccgcgacgccgcccggguccguggaggccuucccgcagagcaacgccgucauccaggacgaggagcgggacauccccgagcgcuccuggaacagcggcuacgaguggaucaccgacuuccccggcaagaccgugugguucgugcccuccaucaagagcgggaacgacaucgccaacugccugcggaagaacggcaagcgcgucauccagcucucccggaagaccuucgacacggaguaccagaagaccaagaacaacgacugggacuacguggugaccaccgacaucagcgagaugggggcgaacuuccgcgccgaccgggucaucgacccgcgccggugccugaagcccgugauccugaaggacggccccgagcgcgugauccucgccgggcccaugccggucacgguggccuccgccgcgcagcggcgcggccggaucggccgcaaccacaacaaggagggggaccaguacaucuacaugggccagccccugaacaacgacgaggaccacgcccacuggaccgaggccaagaugcugcucgacaacaucaacacccccgaggggaucauccccgcccuguucgagccggagcgcgagaaguccgccgcgaucgacggcgaguaccggcugcgcggggaggcccggaagaccuucgucgagcucaugcgccggggcgaccugcccguguggcuguccuacaagguggccagcgagggcuuccaguacagcgaccgccgguggugcuucgacggggagcgcaacaaccagguccucgaggagaacauggacguggagaucuggacgaaggagggcgagcggaagaagcugcgcccccgguggcuggacgcccgcaccuacuccgacccccucgcccugcgggaguucaaggaguucgcggccgggcgccggagcguguccggcgaccugauccucgagaucggcaagcugccgcagcaccugacccagcgcgcccagaacgcccucgacaaccuggucaugcugcacaacagcgagcagggcgggcgggcguaccgccacgccauggaggagcuccccgacaccaucgagacgcugaugcugcucgcccugaucgccgugcugaccgggggcgugacccucuucuuccuguccgggcggggccugggcaagaccagcaucgggcuccugugcgucauggccuccagcgugcugcucuggauggcguccguggagccccacuggaucgccgccagcaucauccuggaguucuuccugaugguccuccugauccccgagccggaccgccagcggacgccccaggacaaccagcuggccuacguggugaucggccuccuguucaugauccugacggucgccgcgaacgagauggggcuccuggagaccaccaagaaggaccugggcaucgggcacguggccguggagaaccaccaccacgccgccaugcucgacgucgaccugcaccccgccuccgcguggacccuguacgccguggccacgaccaucaucaccccgaugaugcgccacaccaucgagaacacgaccgccaacaucagccucaccgccaucgcgaaccaggccgccauccugaugggccuggacaagggcuggcccaucuccaagauggacaucggggugccccuccuggcccugggcugcuacagccaggucaacccccucacccugacggcggccgugcugaugcucguggcccacuacgccaucaucgggccgggccugcaggccaaggcgacccgcgaggcccagaagcggaccgccgccgggaucaugaagaaccccaccgucgacggcaucguggccaucgaccuggaccccguggucuacgacgcgaaguucgagaagcagcucggccagaucaugcugcugauccucugcacgucccagauccugcugaugcgcaccaccugggcccucugcgagagcaucacccuggccacggggccccugaccacccucugggagggcuccccggggaaguucuggaacaccacgaucgccgugagcauggccaacaucuuccggggcuccuaccuggcgggcgccgggcuggccuucagccucaugaagucccugggcgggggccgccgggggaccggcgcccagggcgagacccugggggagaaguggaagcgccagcucaaccagcuguccaagagcgaguucaacaccuacaagcgguccggcaucauggagguggaccgcagcgaggcgaaggaggggcugaagcggggcgagacgaccaagcacgccgucucccgcgggaccgccaagcuccggugguucguggagcgcaaccuggugaagcccgagggcaaggucaucgaccugggcugcgggcggggcggguggagcuacuacugcgccggccugaagaaggugaccgaggugaagggguacacgaagggcggccccgggcacgaggagcccaucccgauggccaccuacggcuggaaccucgucaagcugcacuccgggaaggacguguucuucaucccgcccgagaagugcgacacccugcucugcgacaucggcgagagcucccccaacccgaccaucgaggaggggcgcacgcugcgggugcugaagauggucgagcccuggcuccgcggcaaccaguucugcaucaagauccugaaccccuacaugcccagcgugguggagacccuggagcagaugcagcggaagcacggcgggaugcucguccgcaacccgcugucccggaacagcacccacgagauguacuggguguccugcggcaccgggaacaucgugagcgcggucaacaugaccucccgcaugcugcucaaccgcuucacgauggcccaccggaagcccaccuacgagcgcgacguggaccugggcgccggcacccggcacguggccgucgagcccgagguggccaaccuggacaucaucgggcagcgcaucgagaacaucaagcacgagcacaagagcaccuggcacuacgacgaggacaaccccuacaagacgugggcguaccacggcuccuacgaggugaagccgagcggguccgccagcagcauggucaacggcguggucaagcuccugaccaagcccugggacgugauccccauggugacccagaucgccaugaccgacacgacccccuucgggcagcagcgggucuucaaggagaagguggacacccgcaccccgaaggccaagcggggcacggcccagaucauggaggugaccgcgaaguggcuguggggcuuccucucccgcaacaagaagccccggaucugcacccgcgaggaguucacccggaagguccgcagcaacgccgccaucggggccguguucguggacgagaaccaguggaacuccgcgaaggaggccgucgaggacgagcgguucugggaccuggugcaccgcgagcgggagcugcacaagcagggcaagugcgccacgugcguguacaacaugauggggaagcgcgagaagaagcucggcgaguucgggaaggccaagggcagccgggccaucugguacauguggcugggcgcgcgcuuccuggaguucgaggcccucggguucaugaacgaggaccacugguucaaccgggagaacucccugagcggcgucgagggggagggccugcacaagcucggguacauccugcgcgacaucuccaagauccccggcggcaacauguacgccgacgacaccgccgggugggacacccggaucaccgaggacgaccugcagaacgaggcccgcaucacggacaucauggagccggagcacgcgcuccuggcccgcagcaucuucaagcugaccuaccagaacaagguggugcggguccagcgccccgccaagaacggcaccgugauggacgugaucucccggcgcgaccagcgggggagcggccaggucggcaccuacgggcucaacacguucaccaacauggaggcccagcugauccgccagauggaguccgagggcaucuucagccccuccgagcuggagacccccaaccucgccgagcgggugcuggacuggcuggagaaguacgggguggagcgccucaagcggauggcgaucagcggcgacgacugcgucgugaagccgaucgacgaccgcuucgccaccgcccugacggcccugaacgacauggggaaggugcggaaggacaucccccagugggagcccuccaagggcuggaacgacuggcagcagguccccuucugcagccaccacuuccaccagcucaucaugaaggacggccgcgagaucguggugccgugccggaaccaggacgagcuggucgggcgcgcccgggugucccagggcgcgggguggagccugcgcgagaccgccugccucggcaagagcuacgcccagauguggcagcugauguacuuccaccggcgcgaccugcggcucgccgcgaacgccaucugcuccgccgugcccgucgacuggauccccaccagccgcaccacgugguccauccacgcccaccaccaguggaugaccaccgaggacaugcugagcguguggaaccgcguguggaucgaggagaaccccuggauggaggacaagacccacaucuccagcuggggcgacgucccguaccugggcaagcgggaggaccaguggugcggcucccucaucgggcugacggcccgcgcgaccugggccaccaacauccagguggccaucaaccaggugcggcgccugaucggcaacgagaacuaccucgacuacaugaccagcaugaagcgguucaagaacgaguccgaccccgagggggcccugugguga

SEQ ID NO: 8315 - RNA, 9879 nt, Artificial Sequence
  derived and/or modified CDS sequence (opt1) from DENV-1__FJ024428__SS-prME
agcgugaccaugcugcugaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgagaccgagcccgacgacguggacugcuggugcaacgccaccgacaccugggugaccuacgggaccugcagccagaccggcgagcaccggcgggacaagcgguccguggcccucgcgccccacgugggccuggggcuggagacccgcaccgagaccuggaugagcuccgagggcgccuggaagcagauccagcgggucgagacgugggcccuccggcaccccggguucaccgugaccgcccuguuccuggcccacgcgaucggcaccagcaucacgcagaaggggaucaucuucauccuccugaugcuggugacccccuccauggccaugcggugcgucggcaucggcagccgcgacuucguggaggggcucuccggcgccaccuggguggacgucgugcuggagcacgggagcugcgugaccacgauggccaaggacaagcccacccuggacaucgagcuccugaagaccgaggucaccaaccccgccgugcugcggaagcucugcaucgaggcgaagaucuccaacacgaccaccgacagccgcugcccgacccagggcgaggccacgcugguggaggagcaggacgccaacuucgucugccggcgcaccuucguggaccggggcugggggaacggcugcgggcuguucggcaaggggucccucaucacgugcgccaaguucaagugcgugaccaagcuggagggcaagaucguccaguacgagaaccugaaguacagcgugaucgugacgguccacaccggcgaccagcaccagguggggaacgaguccaccgagcacggcaccaccgccacgaucacgccccaggcgcccaccaccgagauccagcucacggacuacggggcccugacccuggacugcagcccccgcaccggccucgacuucaacgagaugguccugcugaccaugaaggagaaguccuggcucgugcacaagcagugguuccuggaccugccccuccccuggacgagcggggccagcaccucccaggagaccuggaaccggcaggaccugcuggugaccuucaagacggcccacgccaagaagcaggaggucguggugcucggcagccaggagggcgcgaugcacaccgcccugaccggggccaccgagauccagacguccggcaccaccaccaucuucgccgggcaccugaagugccgccucaagauggacaagcugacgcugaagggcaugagcuacgucaugugcaccggguccuucaagcucgagaaggagcuggccgagacccagcacggcaccgugcuggugcagaucaaguacgagggcacggacgcgcccugcaagauccccuucagcacccaggacgagaagggggucacccagaacggccggcugaucaccgccaacccgaucgugacggacaaggagaagcccgugaacaucgaggccgagccgcccuucggggaguccuacaucgucaucggcgccggcgagaaggcgcucaagcugagcugguucaagaagggguccagcaucggcaagauguucgaggccaccgcccgcggggcccggcgcauggccauccugggcgacaccgcgugggacuucggguccaucggcggcguguucaccagcguggggaagcucguccaccagaucuucggcacggccuacggggugcuguucuccggcgugagcuggaccaugaagaucgggaucggcguccugcucaccuggcugggccugaacucccgcagcaccucccucagcaugacgugcaucgccguggggcuggugacccuguaccucggcgucauggugcaggccgacuccgggugcgugaucaacuggaagggccgggagcugaagugcgggagcggcaucuucgucaccaacgaggugcacaccuggaccgagcaguacaaguuccaggccgacagcccgaagcgccuguccgcggccaucggcaaggccugggaggagggggugugcggcauccggagcgccacgcgccucgagaacaucauguggaagcagaucuccaacgagcugaaccacauccugcucgagaacgacaugaaguucaccgucguggugggggacgucgccggcauccuggcgcaggggaagaagaugauccggccccagcccauggagcacaaguacagcuggaaguccuggggcaaggccaagaucaucggcgccgacgugcagaacaccaccuucaucaucgacgggcccaacacgccggagugccccgacgaccagcgcgccuggaacaucugggagguggaggacuacggcuucgggaucuucaccaccaacaucuggcugaagcuccgggacagcuacacccaggucugcgaccaccgccugauguccgcggccaucaaggacagcaaggccgugcacgccgacaugggcuacuggaucgaguccgagaagaacgagacguggaagcuggcccgggcgagcuucaucgaggugaagaccugcaucuggcccaagucccacacccucuggagcaacggcguccuggaguccgagaugaucauccccaagaucuacgggggcccgaucagccagcacaacuaccgccccggguacuucacccagacggccggccccuggcaccuggggaagcucgagcuggacuucgaccugugcgagggcaccaccgugguggucgacgagcacugcggcaaccgggggccgucccuccgcaccacgaccgugaccggcaagaucauccacgaguggugcugccggagcugcacccugccgccccugcgcuuccgcggggaggacggcugcugguacgggauggagauccgccccgugaaggagaaggaggagaaccucgucaaguccauggugagcgccggcagcggcgagguggacuccuucagccuggggcugcucugcaucuccaucaugaucgaggaggucaugcggagccgcuggucccggaagaugcugaugacgggcacccuggccguguucuuccuccugaucguggggcagcugaccuggaacgaccucauccgccugugcaucauggucggcgccaacgcgagcgaccgcauggggaugggcaccacguaccuggcccucauggccaccuucaagaugcggccgauguucgccgugggccugcuguuccgccggcucaccucccgcgaggugcugcugcucaccaucgggcugagccuggucgccuccguggagcuccccaacagccuggaggagcugggcgacgggcucgcgaugggcaucaugauccugaagcugcucacggacuuccagucccaccagcugugggccacccugcucagccugaccuucaucaagaccacguucucccugcacuacgccuggaagaccauggccaugguccucagcguggugucccuguucccccugugccucagcaccaccucccagaagacgaccuggcugcccguccugcucggcagccuggggugcaagccgcugaccauguuccucaucgcggagaacaagaucuggggccggcgcuccuggccccugaacgaggggaucauggccgugggcaucgugagcauccugcucagcucccugcugaagaacgacgucccccucgccgggccccugaucgccggcggcaugcugaucgccugcuacgugaucagcggguccagcgcggaccucucccuggagaaggccgccgaggugagcugggaggaggaggccgagcacuccggcgccagccacaacauccuggucgaggugcaggacgacgggaccaugaagaucaaggacgaggagcgggacgacacccucacgauccugcugaaggcgacccuccuggccguguccggcgucuacccgcugagcauccccgccacccucuucgugugguacuucuggcagaagaagaagcagcgcuccggggugcugugggacacccccagcccgcccgaggucgagcgggccgugcuggacgacggcaucuaccgcaucaugcagcggggccugcucgggcgcucccaggugggcgucgggguguuccaggagaacguguuccacacgauguggcacgucacccggggcgccgugcugauguaccaggggaagcgccuggagcccagcugggcguccgugaagaaggaccucaucagcuacggcggcggguggcggcugcagggcuccuggaacaccggggaggagguccaggugaucgccguggagcccggcaagaaccccaagaacguccagaccgcccccgggacguucaagacccccgagggcgaggugggcgccaucgcccuggacuucaagcccgggaccagcggcucccccaucgugaaccgcgaggggaagaucgucggccucuacggcaacgggguggugaccacgagcggcaccuacgucagcgcgaucgcccaggccaaggccucccaggaggggccgcugcccgagaucgaggacgagguguuccggaagcgcaaccugaccaucauggaccuccaccccggcagcgggaagacccggcgcuaccugccggcgaucgugcgggaggccaucaagcgcaagcugcgcacgcucauccuggcccccacccgggucguggccuccgagauggccgaggcgcugaagggcaugcccauccgcuaccagaccaccgccgucaagagcgagcacacgggcaaggagaucgucgaccucaugugccacgccaccuucaccaugcggcugcugucccccgugcgcgugccgaacuacaacaugaucaucauggacgaggcccacuucaccgaccccagcuccaucgccgcgcggggguacaucagcacgcgcgucggcaugggggaggccgccgccaucuucaugaccgccacgccgcccggcuccguggaggcguucccgcagagcaacgccgugauccaggacgaggagcgggacauccccgagcgcuccuggaacagcggguacgaguggaucaccgacuuccccggcaagacggucugguucgugcccuccaucaagagcggcaacgacaucgccaacugccuccggaagaacgggaagcgcgugauccagcugucccggaagaccuucgacaccgaguaccagaagaccaagaacaacgacugggacuacgucgugacgaccgacaucagcgagaugggcgccaacuuccgcgcggaccgggugaucgacccgcgccggugccugaagcccgucauccucaaggacgggcccgagcgcgugauccuggccggccccaugccggucaccguggccuccgccgcccagcggcgcgggcggaucggccgcaaccacaacaaggagggcgaccaguacaucuacauggggcagccccugaacaacgacgaggaccacgcgcacuggaccgaggccaagaugcuccuggacaacaucaacacgcccgagggcaucauccccgcccuguucgagccggagcgcgagaaguccgccgccaucgacggggaguaccggcuccgcggcgaggcgcggaagaccuucguggagcugaugcgccgcggggaccugcccgucuggcucuccuacaagguggccagcgagggcuuccaguacagcgaccgccgguggugcuucgacggcgagcgcaacaaccaggugcuggaggagaacauggacgucgagaucuggaccaaggagggggagcggaagaagcugcgcccccgguggcucgacgcccgcaccuacuccgacccccuggcccugcgggaguucaaggaguucgccgcgggccgccggagcguguccggggaccucauccuggagaucggcaagcugccgcagcaccucacgcagcgcgcccagaacgcccuggacaaccuggugaugcuccacaacagcgagcagggcgggcgggccuaccgccacgcgauggaggagcugcccgacaccaucgagacccugaugcuccuggcccugaucgccguccucaccggcggggugacccuguucuuccuguccggccgggggcucggcaagacgagcaucggccugcugugcgugauggccuccagcguccuccuguggauggccuccguggagccccacuggaucgcggccagcaucauccuggaguucuuccucauggugcugcugauccccgagccggaccgccagcggacgccccaggacaaccagcucgccuacgucgugaucgggcugcuguucaugauccucaccguggccgccaacgagaugggccugcuggagaccacgaagaaggaccucgggaucggccacgucgcgguggagaaccaccaccacgccgccaugcuggacguggaccugcaccccgccuccgccuggacccucuacgcggucgccaccaccaucaucacgccgaugaugcgccacaccaucgagaacaccaccgccaacaucagccugacggccaucgccaaccaggcggccauccugauggggcucgacaagggcuggcccaucuccaagauggacaucggcgugccccugcuggcccucgggugcuacagccaggugaacccccugacccugaccgccgcgguccucaugcugguggcccacuacgccaucaucggcccggggcugcaggccaaggccacccgcgaggcgcagaagcggacggccgccggcaucaugaagaaccccaccguggacgggaucgucgccaucgaccucgaccccgugguguacgacgccaaguucgagaagcagcugggccagaucaugcugcucauccugugcaccucccagauccugcucaugcgcaccacgugggcgcugugcgagagcaucacccuggccaccggcccccucaccacgcugugggagggguccccgggcaaguucuggaacaccaccaucgccgucagcauggccaacaucuuccggggguccuaccuggccggcgcgggccucgccuucagccugaugaagucccucgggggcgggcgccgggggaccggggcccagggcgagacgcucggcgagaaguggaagcgccagcugaaccagcuguccaagagcgaguucaacaccuacaagcgguccgggaucauggagguggaccgcagcgaggccaaggagggccucaagcgcggggagaccaccaagcacgcggugucccgcggcacggccaagcugcggugguucgucgagcgcaaccuggugaagcccgaggggaaggugaucgaccugggcugcggccgcgggggcuggagcuacuacugcgccgggcucaagaaggucaccgaggugaagggcuacaccaagggcggccccggccacgaggagcccaucccgauggccaccuacggguggaaccuggugaagcugcacuccggcaaggacgucuucuucaucccgcccgagaagugcgacacgcuccugugcgacaucggggagagcucccccaacccgaccaucgaggagggccgcacccugcgggugcucaagaugguggagcccuggcugcgcgggaaccaguucugcaucaagauccugaaccccuacaugcccagcgucguggagacccucgagcagaugcagcggaagcacggcggcaugcuggugcgcaacccgcugucccggaacagcacccacgagauguacugggucuccugcgggacgggcaacaucgugagcgccgugaacaugaccucccgcaugcuccugaaccgcuucaccauggcgcaccggaagcccaccuacgagcgcgacgucgaccugggggccggcacgcggcacguggccguggagcccgaggucgccaaccucgacaucaucggccagcgcaucgagaacaucaagcacgagcacaagagcaccuggcacuacgacgaggacaaccccuacaagaccugggccuaccacggguccuacgaggugaagccgagcggcuccgcgagcagcauggucaacgggguggugaagcugcugaccaagcccugggacgucauccccauggugacgcagaucgccaugaccgacaccacccccuucggccagcagcggguguucaaggagaaggucgacacgcgcaccccgaaggccaagcgggggaccgcccagaucauggaggugaccgccaaguggcucuggggcuuccugucccgcaacaagaagccccggaucugcacgcgcgaggaguucacccggaaggugcgcagcaacgcggccaucggcgccgucuucguggacgagaaccaguggaacuccgccaaggaggcgguggaggacgagcgguucugggaccugguccaccgcgagcgggagcuccacaagcaggggaagugcgcgaccugcguguacaacaugaugggcaagcgcgagaagaagcugggggaguucggcaaggccaaggggagccgggccaucugguacauguggcugggcgcccgcuuccucgaguucgaggcgcugggcuucaugaacgaggaccacugguucucccgggagaacagccuguccgggguggagggcgaggggcuccacaagcugggcuacauccugcgcgacaucagcaagauccccgggggcaacauguacgccgacgacaccgccggcugggacacgcggaucaccgaggacgaccuccagaacgaggcccgcaucaccgacaucauggagccggagcacgcccugcuggcgaaguccaucuucaagcucaccuaccagaacaaggucgugcgcgugcagcggcccgccaagaacgggacggucauggacgugaucagccgccgggaccagcgcggcuccggccagguggggaccuacggccugaacaccuucaccaacauggaggcccagcugauccggcagauggagagcgaggggaucuucucccccagcgagcucgagacgcccaaccuggccgagcgcguccuggacuggcucgagaaguacggcguggagcggcugaagcgcauggccaucuccggggacgacugcguggucaagccgaucgacgaccgguucgcgaccgcccugaccgcccucaacgacaugggcaaggugcgcaaggacaucccccagugggagcccagcaagggguggaacgacuggcagcagguccccuucugcucccaccacuuccaccagcugaucaugaaggacggccgggagaucgucgugccgugccgcaaccaggacgagcuggugggccgggcccgcgucagccagggggccggcuggagccuccgggagaccgcgugccuggggaaguccuacgcccagauguggcagcugauguacuuccaccgccgggaccuccgccuggccgccaacgcgaucugcagcgccgugcccguggacuggauccccacgucccggaccaccuggagcauccacgcccaccaccaguggaugaccacggaggacaugcuguccgucuggaaccgcguguggaucgaggagaaccccuggauggaggacaagacccacaucagcuccuggggcgacgugccguaccucgggaagcgcgaggaccaguggugcggcagccugaucggccugaccgcccgggccaccugggcgaccaacauccaggucgccaucaaccaggugcgccggcucaucgggaacgagaacuaccuggacuacaugacguccaugaagcgcuucaagaacgagagcgaccccgagggcgcccugugguga

SEQ ID NO: 8316 - RNA, 9879 nt, Artificial Sequence
  derived and/or modified CDS sequence (opt1) from DENV-1__FJ024429__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgagaccgagcccgacgacguggacugcuggugcaacgccacggacaccugggugaccuacgggaccugcagccagacgggcgagcaccggcgcgacaagcgguccguggcccucgcgccccacgugggccuggggcuggagacccgcaccgagaccuggaugagcuccgagggcgcguggaagcagauccagcgggucgagacgugggcccuccgccaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagcuggccgagacccagcacggcaccgugcuggugcagaucaaguacgagggcaccgacgcgcccugcaagauccccuucagcacgcaggacgagaagggggucacccagaacggccggcugaucaccgccaacccgaucgugaccgacaaggagaagcccgugaacaucgaggccgagccgcccuucggggaguccuacaucgucaucggcgccggcgagaaggcgcucaagcugagcugguucaagaagggguccagcaucggcaagauguucgaggccacggcccgcggggcccggcgcauggccauccugggcgacaccgcgugggacuucggguccaucggcggcguguucaccagcguggggaagcucguccaccagaucuucggcaccgccuacggggugcuguucuccggcgugagcuggacgaugaagaucgggaucggcguccugaugaccuggcucggccugaacucccgcagcaccucccugagcaugaccugcaucgccguggggcucgugacgcuguaccugggcgucauggugcaggccgacuccgggugcgugaucaacuggaagggccgggagcucaagugcgggagcggcaucuucgucaccaacgaggugcacaccuggaccgagcaguacaaguuccaggccgacagcccgaagcgccuguccgcggccaucggcaaggccugggaggagggggugugcggcauccggagcgccacccgccuggagaacaucauguggaagcagaucuccaacgagcucaaccacauccugcuggagaacgacaugaaguucacggucguggugggggacgucgccggcauccucgcgcaggggaagaagaugauccggccccagcccauggagcacaaguacagcuggaaguccuggggcaaggccaagaucaucggcgccgacgugcagaacaccaccuucaucaucgacgggcccaacaccccggagugccccgacgaccagcgcgccuggaacaucugggagguggaggacuacggcuucgggaucuucacgaccaacaucuggcugaagcugcgggacagcuacacccaggucugcgaccaccgccucauguccgcggccaucaaggacagcaaggccgugcacgccgacaugggcuacuggaucgaguccgagaagaacgagaccuggaagcuggcccgggcgagcuucaucgaggugaagacgugcaucuggcccaagucccacacccuguggagcaacggcguccucgaguccgagaugaucauccccaagaucuacgggggcccgaucagccagcacaacuaccgccccggguacuucacccagaucgccggccccuggcaccuggggaagcuggagcucgacuucgaccugugcgagggcaccacggugguggucgacgagcacugcggcaaccgggggccgucccugcgcaccaccaccgugacgggcaagaucauccacgaguggugcugccggagcugcacccugccgccccuccgcuuccgcggggaggacggcugcugguacgggauggagauccgccccgugaaggagaaggaggagaaccuggucaaguccauggugagcgccggcagcggcgagguggacuccuucagccucgggcugcugugcaucuccaucaugaucgaggaggucaugcggagccgcuggucccggaagaugcucaugaccggcacccuggccguguucuuccugcucaucguggggcagcugacguggaacgaccugauccgccucugcaucauggucggcgccaacgcgagcgaccgcauggggaugggcaccaccuaccuggcccugauggccaccuucaagaugcggccgauguucgccguggggcuccuguuccgccggcugacgucccgcgaggugcuccugcugaccaucgggcucagccuggucgccuccguggagcugcccaacagccucgaggagcugggcgacgggcuggcgaugggcaucaugauccucaagcugcugaccgacuuccagucccaccagcucugggccacccugcugagccucacguucaucaagaccaccuucucccugcacuacgccuggaagaccauggccaugguccugagcguggugucccucuucccccugugccugagcacgaccucccagaagaccaccuggcuccccguccugcugggcagccucgggugcaagccgcugacgauguuccugaucgcggagaacaagaucuggggccggcgcuccuggccccucaacgaggggaucauggccgugggcaucgugagcauccugcugagcucccuccugaagaacgacgucccccuggccgggccccucaucgccggcggcaugcugaucgccugcuacgugaucagcggguccagcgcggaccugucccucgagaaggccgccgaggugagcugggaggaggaggccgagcacuccggcgccagccacaacauccuggucgaggugcaggacgacgggaccaugaagaucaaggacgaggagcgggacgacacccugaccauccuccugaaggcgacccugcucgccguguccggcgucuacccgcugagcauccccgccacgcuguucgugugguacuucuggcagaagaagaagcagcgcuccggggugcucugggacacccccagcccgcccgaggucgagcgggccgugcuggacgacggcaucuaccgcaucaugcagcggggccugcuggggcgcucccaggugggcgucgggguguuccaggagaacguguuccacaccauguggcacgucacccggggcgccgugcucauguaccaggggaagcgccuggagcccagcugggcguccgugaagaaggaccugaucagcuacggcggcggguggcggcuccagggcuccuggaacacgggggaggagguccaggugaucgccguggagcccggcaagaaccccaagaacguccagaccgcccccgggaccuucaagacccccgagggcgaggugggcgccaucgcccuggacuucaagcccgggacgagcggcucccccaucgugaaccgcgagcggaagaucgucgggcuguacggcaacggcguggugaccaccagcgggaccuacgucagcgcgaucgcccaggccaaggccucccaggagggcccgcuccccgagaucgaggacgagguguuccgcaagcggaaccugacgaucauggaccugcaccccgggagcggcaagacccgccgguaccucccggcgaucgugcgcgaggccaucaagcgcaagcugcggacccugauccucgcccccacccgcgucguggccuccgagauggccgaggcgcugaaggggaugcccauccgguaccagacgaccgccgucaagagcgagcacaccggcaaggagaucgucgaccugaugugccacgccaccuucacgaugcgccuccugucccccgugcgggugccgaacuacaacaugaucaucauggacgaggcccacuucaccgaccccagcuccaucgccgcgcgcggcuacaucagcacccgggucgggaugggcgaggccgccgccaucuucaugaccgccacgccgcccggguccguggaggcguucccgcagagcaacgccgugauccaggacgaggagcgcgacauccccgagcgguccuggaacagcggcuacgaguggaucaccgacuuccccgggaagaccgucugguucgugcccuccaucaagagcggcaacgacaucgccaacugccugcgcaagaacggcaagcgggugauccagcucucccgcaagaccuucgacacggaguaccagaagaccaagaacaacgacugggacuacgucgugaccaccgacaucagcgagaugggggccaacuuccgggcggaccgcgugaucgacccgcggcgcugccugaagcccgucauccugaaggacggccccgagcgggugauccucgccgggcccaugccggucacgguggccuccgccgcccagcgccggggccgcaucgggcgcaaccacaacaaggagggcgaccaguacaucuacaugggccagccccugaacaacgacgaggaccacgcgcacuggaccgaggccaagaugcugcucgacaacaucaacacccccgaggggaucauccccgcccuguucgagccggagcgggagaaguccgccgccaucgacggcgaguaccgccugcgcggggaggcgcgcaagaccuucguggagcucaugcggcgcggcgaccugcccgucuggcuguccuacaagguggccagcgagggguuccaguacagcgaccggcgcuggugcuucgacggcgagcggaacaaccaggugcucgaggagaacauggacgucgagaucuggacgaaggagggcgagcgcaagaagcugcggccccgcuggcuggacgcccggaccuacuccgacccccucgcccugcgcgaguucaaggaguucgccgcggggcggcgcagcguguccggcgaccugauccucgagaucgggaagcugccgcagcaccugacccagcgggcccagaacgcccucgacaaccuggugaugcugcacaacagcgagcagggcggccgcgccuaccggcacgcgauggaggagcuccccgacaccaucgagacgcugaugcugcucgcccugaucgccguccugaccgggggcgugacccucuucuuccuguccgggcgcggccuggggaagaccagcaucggccuccugugcgugauggccuccagcguccugcucuggauggccuccguggagccccacuggaucgcggccagcaucauccuggaguucuuccugauggugcuccugauccccgagccggaccggcagcgcacgccccaggacaaccagcuggccuacgucgugaucggccuccuguucaugauccugacgguggccgccaacgagauggggcuccuggagaccaccaagaaggaccugggcaucgggcacgucgcgguggagaaccaccaccacgccgccaugcucgacguggaccugcaccccgccuccgccuggacccuguacgcggucgccacgaccaucaucaccccgaugaugcgccacaccaucgagaacacgaccgccaacaucagccucaccgccaucgccaaccaggcggccauccugaugggccuggacaagggguggcccaucuccaagauggacaucggcgugccccuccuggcccugggcugcuacagccaggugaacccccucacccugacggccgcgguccugaugcucguggcccacuacgccaucaucgggccgggccugcaggccaaggccacccgggaggcgcagaagcgcaccgccgccgggaucaugaagaaccccaccguggacggcaucgucgccaucgaccuggaccccgugguguacgacgccaaguucgagaagcagcucgggcagaucaugcugcugauccucugcacgucccagauccugcugaugcggaccaccugggcgcucugcgagagcaucacccuggccacgggcccccugaccacccucugggagggcuccccggggaaguucuggaacaccacgaucgccgucagcauggccaacaucuuccgcggcuccuaccuggccggggcgggccuggccuucagccucaugaagucccugggcgggggccggcgcgggaccggcgcccagggggagacccugggcgagaaguggaagcggcagcucaaccagcuguccaagagcgaguucaacaccuacaagcgcuccggcaucauggagguggaccggagcgaggccaaggaggggcugaagcgcggcgagacgaccaagcacgcggugucccgggggaccgccaagcuccgcugguucgucgagcggaaccuggugaagcccgagggcaaggugaucgaccuggggugcggccgcggcggguggagcuacuacugcgccggccugaagaaggucaccgaggugaagggguacacgaagggcgggcccggccacgaggagcccaucccgauggccaccuacggcuggaaccucgugaagcugcacuccgggaaggacgucuucuucaucccgcccgagaagugcgacacccugcucugcgacaucggcgagagcucccccaacccgaccaucgaggaggggcggacgcugcgcgugcugaagaugguggagcccuggcuccggggcaaccaguucugcaucaagauccugaaccccuacaugcccagcgucguggagacccuggagcagaugcagcgcaagcacgggggcaugcucgugcggaacccgcugucccgcaacagcacccacgagauguacugggucuccugcggcaccgggaacaucgugagcgccgugaacaugaccucccgcaugcugcucaaccgguucacgauggcgcaccgcaagcccaccuacgagcgggacgucgaccugggcgccgggacccgccacguggccguggagcccgaggucgccaaccuggacaucaucggccagcggaucgagaacaucaagcacgagcacaagagcaccuggcacuacgacgaggacaaccccuacaagacgugggccuaccacggcuccuacgaggugaagccgagcggguccgcgagcagcauggucaacggcguggugaagcuccugaccaagcccugggacgucauccccauggugacccagaucgccaugaccgacacgacccccuucgggcagcagcgcguguucaaggagaaggucgacacccggaccccgaaggccaagcgcggcacggcccagaucauggaggugaccgccaaguggcuguggggguuccucucccggaacaagaagccccgcaucugcacccgggaggaguucacccgcaaggugcggagcaacgcggccaucggcgccgucuucguggacgagaaccaguggaacuccgccaaggaggcgguggaggacgagcgcuucugggaccugguccaccgggagcgcgagcugcacaagcagggcaagugcgccacgugcguguacaacaugauggggaagcgggagaagaagcucggcgaguucgggaaggccaagggcagccgcgccaucugguacauguggcugggggcccgguuccuggaguucgaggcgcucggcuucaugaacgaggaccacugguucucccgcgagaacagccuguccggcguggagggggagggccugcacaagcucggguacauccugcgggacaucagcaagauccccggcgggaacauguacgccgacgacaccgccggcugggacacccgcaucaccgaggacgaccugcagaacgaggcccgcaucacggacaucauggagccggagcacgcccuccuggcgaaguccaucuucaagcugaccuaccagaacaaggucgugcgggugcagcgccccgccaagaacggcaccgucauggacgugaucagccggcgcgaccagcggggguccggccagguggggaccuacggccucaacacguucaccaacauggaggcccagcugauccgccagauggagagcgagggcaucuucucccccagcgagcuggagacccccaaccucgccgagcggguccuggacuggcuggagaaguacgggguggagcgccucaagcggauggccaucuccggcgacgacugcguggucaagccgaucgacgaccgcuucgcgaccgcccugacggcccugaacgacauggggaaggugcggaaggacaucccccagugggagcccagcaagggcuggaacgacuggcagcagguccccuucugcucccaccacuuccaccagcucaucaugaaggacgggcgcgagaucgucgugccgugccggaaccaggacgagcuggugggccgcgcccgggucagccagggcgccggguggagccugcgcgagaccgcgugccucggcaaguccuacgcccagauguggcagcugauguacuuccaccggcgcgaccugcggcucgccgccaacgcgaucugcagcgccgugcccguggacuggauccccaccucccgcaccacguggagcauccacgcccaccaccaguggaugaccaccgaggacaugcuguccgucuggaaccgcguguggaucgaggagaaccccuggauggaggacaagacccacaucagcuccuggggcgacgugccguaccugggcaagcgggaggaccaguggugcgggagccucaucggccugacggcccgcgccaccugggcgaccaacauccaggucgccaucaaccaggugcggcgccugaucggcaacgagaacuaccucgacuacaugaccuccaugaagcgguucaagaacgagagcgaccccgagggggcccugugguga

SEQ ID NO: 8317 - RNA, 9879 nt, Artificial Sequence
  derived and/or modified CDS sequence (opt1) from DENV-1__FJ024430__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccgcaucaccgagaccgagcccgacgacguggacugcuggugcaacgccacggacaccugggugaccuacgggaccugcagccagacgggcgagcaccggcgcgacaagcgguccguggcccucgcgccccacgugggccuggggcuggagacccgcaccgagaccuggaugagcuccgagggcgcguggaagcagauccagcggguggagacgugggcccuccgccaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagguggccgagacccagcacggcaccgugcugguccagaucaaguacgagggcaccgacgcgcccugcaagauccccuucagcacgcaggacgagaagggggugacccagaacggccggcugaucaccgccaacccgaucgugaccgacaaggagaagcccgucaacaucgaggccgagccgcccuucggggaguccuacaucgugaucggcgccggcgagaaggcgcugaagcucagcugguucaagaagggguccagcaucggcaagauguucgaggccacggcccgcggggcccggcgcauggccauccugggcgacaccgcgugggacuucggguccaucggcggcguguucaccagcgucgggaagcuggugcaccagaucuucggcaccgccuacgggguccucuucuccggcgucagcuggacgaugaagaucgggaucggcgugcugcugaccuggcucggccugaacucccgcagcaccucccugagcaugaccugcaucgccguggggcucgucacgcuguaccugggcgugauggugcaggccgacuccgggugcgucaucaacuggaagggccgggagcucaagugcgggagcggcaucuucgugaccaacgaggugcacaccuggaccgagcaguacaaguuccaggccgacagcccgaagcgccuguccgcggccaucggcaaggccugggaggagggggucugcggcauccggagcgccacccgccuggagaacaucauguggaagcagaucuccaacgagcucaaccacauccugcuggagaacgacaugaaguucacggugguggucggggacguggccggcauccucgcgcaggggaagaagaugauccggccccagcccauggaguacaaguacagcuggaaguccuggggcaaggccaagaucaucggcgccgacgugcagaacaccaccuucaucaucgacgggcccaacaccccggagugccccgacgaccagcgcgccuggaacaucugggaggucgaggacuacggcuucgggaucuucacgaccaacaucuggcugaagcugcgggacagcuacacccaggugugcgaccaccgccucauguccgcggccaucaaggacagcaaggccgugcacgccgacaugggcuacuggaucgaguccgagaagaacgagaccuggaagcuggcccgggcgagcuucaucgaggucaagacgugcaucuggcccaagucccacacccuguggagcaacggcgugcucgaguccgagaugaucauccccaagaucuacgggggcccgaucagccagcacaacuaccgccccggguacuucacccagaccgccggccccuggcaccuggggaagcuggagcucgacuucgaccugugcgagggcacgaccguggucguggacgagcacugcggcaaccgggggccgucccugcgcaccaccacggugaccggcaagaucauccacgaguggugcugccggagcugcacccugccgccccuccgcuuccgcggggaggacggcugcugguacgggauggagauccgccccgucaaggagaaggaggagaaccuggugaaguccauggugagcgccggcagcggcgaggucgacuccuucagccucgggcugcugugcaucuccaucaugaucgaggaggugaugcggagccgcuggucccggaagaugcucaugaccggcacgcuggccguguucuuccugcucaucauggggcagcugaccuggaacgaccugauccgccucugcaucauggucggcgccaacgcgagcgaccgcauggggaugggcaccaccuaccuggcccugauggccacguucaagaugcggccgauguucgccguggggcuccuguuccgccggcugaccucccgcgaggugcuccugcugaccaucgggcucagccuggucgccuccguggagcugcccaacagccucgaggagcugggcgacgggcuggcgaugggcaucaugauccucaagcugcugaccgacuuccagucccaccagcucugggccacgcugcugagccucaccuucaucaagaccaccuucucccugcacuacgccuggaagacgauggccaugguccugagcaucgugucccucuucccccugugccugagcaccaccucccagaagaccacguggcuccccgugcugcugggcagccucgggugcaagccgcugaccaugcugcucaucgcggagaacaagaucuggggccggcgcuccuggccccugaacgaggggaucauggccgucggcaucgugagcauccugcucagcucccugcugaagaacgacgugccccucgccgggccccugaucgccggcggcaugcugaucgccugcuacgucaucagcggguccagcgcggcccucucccuggagaaggccgccgaggugagcugggaggaggaggccgagcacuccggcgcgagccacaacauccugguggagguccaggacgacgggaccaugaagaucaaggacgaggagcgggacgacacccucaccauccugcugaaggccacgcuccuggccguguccggcguguacccgcugagcauccccgccacccucuucgucugguacuucuggcagaagaagaagcagcgcuccggggugcugugggacacccccagcccgcccgaggugggccgggccguccuggacgacggcaucuaccgcaucaugcagcgggggcugcucggccgcucccaggugggggugggcgucuuccaggagaacguguuccacaccauguggcacgugacgcgcggggccguccugauguaccagggcaagcggcuggagcccagcugggccuccgugaagaaggaccucaucagcuacggcgggggcuggcggcugcagggguccuggaacaccggcgaggaggugcaggucaucgccguggagcccgggaagaaccccaagaacgugcagaccgcccccggcaccuucaagacgcccgagggcgaggucggggccaucgcgcuggacuucaagcccggcaccagcgggucccccaucgugaaccgcgagggcaagaucgugggccucuacgggaacggcgucgugaccaccagcgggacguacgugagcgccaucgcccaggccaaggcgucccaggagggcccgcugcccgagaucgaggacgaggucuuccggaagcgcaaccugaccaucauggaccuccaccccgggagcggcaagacccggcgcuaccugccggccaucgugcgggaggccaucaagcgcaagcugcgcacccucauccuggcccccacgcggguggucgccuccgagauggcggaggcccugaagggcaugcccauccgcuaccagaccaccgccgucaagagcgagcacaccgggaaggagaucguggaccucaugugccacgccacguucaccaugcggcugcugucccccguccgcgugccgaacuacaacaugaucaucauggacgaggcccacuucaccgaccccagcuccaucgcggcccggggcuacaucagcacccgcguggggaugggcgaggccgccgccaucuucaugacggcgacgccgcccggguccgucgaggccuucccgcagagcaacgccgugauccaggacgaggagcgggacauccccgagcgcuccuggaacagcggcuacgaguggaucaccgacuuccccggcaagaccgugugguucguccccuccaucaagagcgggaacgacaucgccaacugccuccggaagaacggcaagcgcgugauccagcugucccggaagacguucgacaccgaguaccagaagaccaagaacaacgacugggacuacguggucaccacggacaucagcgagaugggggcgaacuuccgcgccgaccgggugaucgacccgcgccggugccugaagcccgugauccucaaggacggccccgagcgcgucauccuggccgggcccaugccggugaccgucgccuccgccgcgcagcggcgcggccggaucggccgcaaccacaacaaggagggggaccaguacaucuacaugggccagccccugaacaacgacgaggaccacgcccacuggaccgaggccaagaugcuccuggacaacaucaacacccccgaggggaucauccccgcccuguucgagccggagcgcgagaaguccgccgcgaucgacggcgaguaccggcuccgcggggaggcccggaagacguucguggagcugaugcgccggggcgaccugcccguguggcucuccuacaaggucgccagcgagggcuuccaguacagcgaccgccgguggugcuucgacggggagcgcaacaaccaggugcuggaggagaacauggacguggagaucuggaccaaggagggcgagcggaagaagcugcgcccccgguggcucgacgcccgcaccuacuccgacccccuggcccugcgggaguucaaggaguucgcggccgggcgccggagcgucuccggcgaccucauccuggagaucggcaagcugccgcagcaccucacccagcgcgcccagaacgcccuggacaaccuggugaugcuccacaacagcgagcagggcgggcgggcguaccgccacgccauggaggagcugcccgacacgaucgagacccugaugcuccuggcccugaucgccgugcucaccgggggcgucacccuguucuuccuguccgggcggggccucggcaagaccagcaucgggcugcugugcgugauggccuccagcgugcuccuguggauggcguccgucgagccccacuggaucgccgccagcaucauccuggaguucuuccucauggugcugcugauccccgagccggaccgccagcggacgccccaggacaaccagcucgccuacguggucaucggccugcuguucaugauccucaccguggccgcgaacgagauggggcugcuggagaccaccaagaaggaccucggcaucgggcacguggccgucgagaaccaccaccacgccgccaugcuggacguggaccugcaccccgccuccgcguggacgcucuacgccguggccaccaccaucaucaccccgaugaugcgccacacgaucgagaacaccaccgccaacaucagccugaccgccaucgcgaaccaggccgccauccugaugggccucgacaagggcuggcccaucuccaagauggacaucggggucccccugcuggcccucggcugcuacagccaggugaacccccugacgcugaccgcggccgugcucaugcuggucgcccacuacgccaucaucgggccgggccugcaggccaaggcgacccgcgaggcccagaagcggaccgccgccgggaucaugaagaaccccacgguggacggcaucguggccaucgaccucgaccccgucguguacgacgcgaaguucgagaagcagcugggccagaucaugcugcucauccugugcaccucccagauccugcucaugcgcaccaccugggcccugugcgagagcaucacgcuggccaccgggccccucaccacccugugggagggcuccccggggaaguucuggaacacgaccaucgccgugagcauggccaacaucuuccggggcuccuaccuggcgggcgccgggcucgccuucagccugaugaagucccugggcgggggccgccgggggaccggcgcccagggcgagacccucggggagaaguggaagcgccagcugaaccagcuguccaagagcgaguucaacacguacaagcgguccggcaucauggaggucgaccgcagcgaggcgaaggaggggcucaagcggggcgagaccaccaagcacgccgugucccgcgggaccgccaagcugcggugguucguggagcgcaaccuggucaagcccgagggcaaggugaucgaccugggcugcgggcggggcggguggagcuacuacugcgccggccucaagaaggugacggaggucaagggguacaccaagggcggccccgggcacgaggagcccaucccgauggccaccuacggcuggaaccuggugaagcugcacuccgggaaggacguguucuucaucccgcccgagaagugcgacacccuccugugcgacaucggcgagagcucccccaacccgacgaucgaggaggggcgcacccugcggguccucaagaugguggagcccuggcugcgcggcaaccaguucugcaucaagauccugaaccccuacaugcccagcguggucgagacccucgagcagaugcagcggaagcacggcgggaugcuggugcgcaacccgcugucccggaacagcacccacgagauguacuggguguccugcggcaccgggaacaucgucagcgcggugaacaugacgucccgcaugcuccugaaccgcuucaccauggcccaccggaagcccaccuacgagcgcgacguggaccugggcgccggcacccggcacgucgccguggagcccgagguggccaaccucgacaucaucgggcagcgcaucgagaacaucaagcacgagcacaagagcacguggcacuacgacgaggacaaccccuacaagaccugggcguaccacggcuccuacgaggucaagccgagcggguccgccagcagcauggugaacggcgucgugaagcugcugaccaagcccugggacgugauccccauggucacccagaucgccaugacggacaccacccccuucgggcagcagcggguguucaaggagaagguggacacccgcacgccgaaggccaagcggggcaccgcccagaucauggaggucaccgcgaaguggcucuggggcuuccugucccgcaacaagaagccccggaucugcacccgcgaggaguucacgcggaaggugcgcagcaacgccgccaucggggccguguucgucgacgagaaccaguggaacuccgcgaaggaggccguggaggacgagcgguucugggaccuggugcaccgcgagcgggagcuccacaagcagggcaagugcgcgaccugcgucuacaacaugauggggaagcgcgagaagaagcugggcgaguucgggaaggccaagggcagccgggccaucugguacauguggcugggcgcgcgcuuccucgaguucgaggcccugggguucaugaacgaggaccacugguucucccgggagaacagccuguccggcguggagggggagggccuccacaagcugggguacauccugcgcgacaucagcaacauccccggcggcaacauguacgccgacgacaccgccgggugggacacccggaucacggaggacgaccuccagaacgaggcccgcaucaccgacaucauggagccggagcacgcgcugcuggccaaguccaucuucaagcucaccuaccagaacaaggugguccgcgugcagcggcccaccaagaacggcacggugauggacgucaucagccgccgggaccagcgcggguccggccaggugggcaccuacgggcugaacaccuucaccaacauggaggcccagcugauccggcagauggagagcgagggcaucuucucccccagcgagcucgagacgcccaaccuggccgagcgcgugcuggacuggcucgagaaguacggggucgagcggcugaagcgcauggccaucuccggcgacgacugcguggugaagccggucgacgaccgguucgcgaccgcccugaccgcccucaacgacauggggaaggugcgcaaggacaucccccagugggagcccagcaagggcuggaacgacuggcagcagguccccuucugcucccaccacuuccaccagcugaucaugaaggacggccgggagaucgucgugccgugccgcaaccaggacgagcugguggggcgggcccgcgucagccagggcgccggguggagccuccgggagaccgcgugccugggcaaguccuacgcccagauguggcagcugauguacuuccaccgccgggaccuccgccuggccgccaacgcgaucugcagcgccgugcccguggacuggauccccacgucccggaccaccuggagcauccacgcccaccaccaguggaugaccacggaggacaugcuguccgucuggaaccgcguguggaucgaggagaaccccuggauggaggacaagacccacaucagcuccuggggcgacgugccguaccucggcaagcgcgaggaccaguggugcggcagccugaucgggcugaccgcccgggccaccugggcgaccaacauccaggucgccaucaaccaggugcgccggcucaucggcaacgagaacuaccuggacuacaugacguccaugaagcgcuucaagaacgagagcgaccccgagggggcccugugguga

SEQ ID NO: 8318 - RNA, 9879 nt, Artificial Sequence
  derived and/or modified CDS sequence (opt1) from DENV-1__FJ024433__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccgcaucaccgagaccgagcccgacgacguggacugcuggugcaacgccacggacaccugggugaccuacgggaccugcagccagacgggcgagcaccggcgcgacaagcgguccguggcccucgcgccccacgugggccuggggcuggagacccgcaccgagaccuggaugagcuccgagggcgcguggaagcagauccagcgggucgagacgugggcccuccgccaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcaucucccaggagacguggaaccggcaggaccugcuggugaccuucaagaccgcccacgccaagaagcaggaggucguggugcucggcagccaggagggcgcgaugcacaccgcccugacgggggccaccgagauccagaccuccggcaccacgaccaucuucgccgggcaccugaagugccgccucaagauggacaagcugacccugcggggcaugagcuacgucaugugcaccggguccuucaagcucgagaaggagguggccgagacgcagcacggcaccgugcugguccagaucaaguacgagggcaccgacgcgcccugcaagauccccuucagcacccaggacgagaagggggugacgcagaacggccgccugaucaccgccaacccgaucgugaccgacaaggagaagcccgucaacaucgaggccgagccgcccuucggggaguccuacaucgugaucggcgccggcgagaaggcgcugaagcucagcugguucaagaagggguccagcaucggcaagauguucgaggccaccgcccgcggggcccgccgcauggccauccugggcgacacggcgugggacuucggguccaucggcggcguguucaccagcgucgggaagcuggugcaccagaucuucggcaccgccuacggggugcuguucuccggcgucagcuggaccaugaagaucgggaucggcgugcugcugacguggcucggccugaacucccggagcaccucccugagcaugaccugcaucgccguggggcucgucacccuguaccugggcgugauggugcaggccgacuccgggugcgucaucaacuggaagggccgcgagcucaagugcgggagcggcaucuucgugacgaacgaggugcacaccuggaccgagcaguacaaguuccaggccgacagcccgaagcggcuguccgcggccaucggcaaggccugggaggagggggucugcggcauccgcagcgccacccggcuggagaacaucauguggaagcagaucuccaacgagcucaaccacauccugcuggagaacgacaugaaguucaccgugguggucggggacguggccggcauccucgcgcaggggaagaagaugauccgcccccagcccauggagcacaaguacagcuggaaguccuggggcaaggccaagaucaucggcgccgacgugcagaacacgaccuucaucaucgacgggcccaacaccccggagugccccgacgaccagcgggccuggaacaucugggaggucgaggacuacggcuucgggaucuucaccacgaacaucuggcugaagcugcgcgacagcuacacccaggugugcgaccaccggcucauguccgcggccaucaaggacagcaaggccgugcacgccgacaugggcuacuggaucgaguccgagaagaacgagaccuggaagcuggcccgcgcgagcuucaucgaggucaagaccugcaucuggcccaagucccacacgcuguggagcaacggcgugcucgaguccgagaugaucauccccaagaucuacgggggcccgaucagccagcacaacuaccggcccggguacuucacccagaccgccggccccuggcaccuggggaagcuggagcucgacuucgaccugugcgagggcaccacgguggucguggacgagcacugcggcaaccgcgggccgucccugcggaccaccaccgugacgggcaagaucauccacgaguggugcugccgcagcugcacccugccgccccuccgguuccgcggggaggacggcugcugguacgggauggagauccggcccgucaaggagaaggaggagaaccuggugaaguccauggugagcgccggcagcggcgaggucgacuccuucagccucgggcugcugugcaucuccaucaugaucgaggaggugaugcgcagccgguggucccgcaagaugcucaugaccggcacccuggccguguucuuccugcucaucauggggcagcugacguggaacgaccugauccgccucugcaucauggucggcgccaacgcgagcgaccggauggggaugggcaccaccuaccuggcccugauggccaccuucaagaugcgcccgauguucgccguggggcuccuguuccggcgccugacgucccgggaggugcuccugcugaccaucgggcucagccuggucgccuccguggagcugcccaacagccucgaggagcugggcgacgggcuggcgaugggcaucaugauccucaagcugcugaccgacuuccagucccaccagcucugggccacccugcugagccucacguucaucaagaccaccuucucccugcacuacgccuggaagaccauggccaugguccugagcaucgugucccucuucccccugugccugagcacgaccucccagaagaccaccuggcuccccgugcugcugggcagccucgggugcaagccgcugacgauguuccugaucgcggagaacaagaucuggggccgccgguccuggccccucaacgaggggaucauggccgucggcaucgugagcauccugcugagcucccuccugaagaacgacgugccccuggccgggccccucaucgccggcggcaugcugaucgccugcuacgucaucagcggguccagcgcggaccugucccucgagaaggccgccgaggugagcugggaggaggaggccgagcacuccggcgccagccacaacauccugguggagguccaggacgacgggaccaugaagaucaaggacgaggagcgcgacgacacccugaccauccuccugaaggcgacccugcucgccguguccggcguguacccgcugagcauccccgccacgcuguucgucugguacuucuggcagaagaagaagcagcgguccggggugcucugggacacccccagcccgcccgagguggagcgcgccguccuggacgacggcaucuaccggaucaugcagcgcggccugcuggggcggucccaggugggcgugggggucuuccaggagaacguguuccacaccauguggcacgugacccgcggcgccguccucauguaccaggggaagcggcuggagcccagcugggcguccgugaagaaggaccugaucagcuacggcggcggguggcgccuccagggcuccuggaacacgggggaggaggugcaggucaucgccguggagcccggcaagaaccccaagaacgugcagaccgcccccgggaccuucaagacccccgagggcgaggucggcgccaucgcccuggacuucaagcccgggacgagcggcucccccaucgugaaccgggaggggaagaucgugggccuguacggcaacggggucgugaccaccagcggcaccuacgugagcgcgaucgcccaggccaaggccucccaggaggggccgcuccccgagaucgaggacgaggucuuccgcaagcggaaccugacgaucauggaccugcaccccggcagcgggaagacccgccgguaccucccggcgaucgugcgcgaggccaucaagcgcaagcugcggacccugauccucgcccccacccgcguggucgccuccgagauggccgaggcgcugaagggcaugcccauccgguaccagacgaccgccgucaagagcgagcacaccggcaaggagaucguggaccugaugugccacgccaccuucacgaugcgccuccugucccccguccgggugccgaacuacaacaugaucaucauggacgaggcccacuucaccgaccccagcuccaucgccgcgcgcggguacaucagcacccgggugggcaugggggaggccgccgccaucuucaugaccgccacgccgcccggcuccgucgaggcguucccgcagagcaacgccgugauccaggacgaggagcgcgacauccccgagcgguccuggaacagcggguacgaguggaucaccgacuuccccggcaagaccgugugguucguccccuccaucaagagcggcaacgacaucgccaacugccugcgcaagaacgggaagcgggugauccagcucucccgcaagaccuucgacacggaguaccagaagaccaagaacaacgacugggacuacguggucaccaccgacaucagcgagaugggcgccaacuuccgggcggaccgcgugaucgacccgcggcgcugccugaagcccgugauccugaaggacgggcccgagcgggucauccucgccggccccaugccggugacggucgccuccgccgcccagcgccgggggcgcaucggccgcaaccacaacaaggagggcgaccaguacaucuacauggggcagccccugaacaacgacgaggaccacgcgcacuggaccgaggccaagaugcugcucgacaacaucaacacccccgagggcaucauccccgcccuguucgagccggagcgggagaaguccgccgccaucgacggggaguaccgccugcggggcgaggcgcgcaagaccuucguggagcucaugcggcgcggggaccugcccguguggcuguccuacaaggucgccagcgagggcuuccaguacagcgaccggcgcuggugcuucgacggcgagcggaacaaccaggugcucgaggagaacauggacguggagaucuggacgaaggagggggagcgcaagaagcugcggccccgcuggcuggacgcccggaccuacuccgacccccucgcccugcgcgaguucaaggaguucgccgcgggccggcgcagcgucuccggggaccugauccucgagaucggcaagcugccgcagcaccugacccagcgggcccagaacgcccucgacaaccuggugaugcugcacaacagcgagcagggcgggcgcgccuaccggcacgcgauggaggagcuccccgacaccaucgagacgcugaugcugcucgcccugaucgccgugcugaccggcggggucacccucuucuuccuguccggccgcgggcugggcaagaccagcaucggccuccugugcgugauggccuccagcgugcugcucuggauggccuccgucgagccccacuggaucgcggccagcaucauccuggaguucuuccugauggugcuccugauccccgagccggaccggcagcgcacgccccaggacaaccagcuggccuacguggucaucgggcuccuguucaugauccugacgguggccgccaacgagaugggccuccuggagaccaccaagaaggaccuggggaucggccacguggcggucgagaaccaccaccacgccgccaugcucgacguggaccugcaccccgccuccgccuggacccuguacgcgguggccacgaccaucaucaccccgaugaugcgccacaccaucgagaacacgaccgccaacaucagccucaccgccaucgccaaccaggcggccauccugauggggcuggacaagggcuggcccaucuccaagauggacaucggcgucccccuccuggcccuggggugcuacagccaggugaacccccucacccugacggccgcggugcugaugcucgucgcccacuacgccaucaucggcccggggcugcaggccaaggccacccgggaggcgcagaagcgcaccgccgccggcaucaugaagaaccccaccguggacgggaucguggccaucgaccuggaccccgucguguacgacgccaaguucgagaagcagcucggccagaucaugcugcugauccucugcacgucccagauccugcugaugcggaccaccugggcgcucugcgagagcaucacccuggccacgggcccccugaccacccucugggagggguccccgggcaaguucuggaacaccacgaucgccgugagcauggccaacaucuuccgcggguccuaccuggccggcgcgggccuggccuucagccucaugaagucccucgggggcgggcggcgcgggaccggggcccagggcgagacccugggcgagaaguggaagcggcagcucaaccagcuguccaagagcgaguucaacaccuacaagcgcuccgggaucauggaggucgaccggagcgaggccaaggagggccugaagcgcggggagacgaccaagcacgcggugucccggggcaccgccaagcuccgcugguucguggagcggaaccuggucaagcccgaggggaaggugaucgaccugggcugcggccgcgggggcuggagcuacuacugcgccgggcugaagaaggugaccgaggucaagggcuacacgaagggcgggcccggccacgaggagcccaucccgauggccaccuacggguggaaccucgugaagcugcacuccggcaaggacguguucuucaucccgcccgagaagugcgacacccugcucugcgacaucggggagagcucccccaacccgaccaucgaggagggccggacgcugcgcguccugaagaugguggagcccuggcuccgggggaaccaguucugcaucaagauccugaaccccuacaugcccagcguggucgagacccuggagcagaugcagcgcaagcacggcggcaugcucgugcggaacccgcugucccgcaacagcacccacgagauguacuggguguccugcgggaccggcaacaucgucagcgccgugaacaugaccucccgcaugcugcucaaccgguucacgauggcgcaccgcaagcccaccuacgagcgggacguggaccugggggccggcacccgccacgucgccguggagcccgagguggccaaccuggacaucaucggccagcggaucgagaacaucaagcacgagcacaagagcaccuggcacuacgacgaggacaaccccuacaagacgugggccuaccacggguccuacgaggucaagccgagcggcuccgcgagcagcauggugaacggggucgugaagcuccugaccaagcccugggacgugauccccauggucacccagaucgccaugaccgacacgacccccuucggccagcagcgcguguucaaggagaagguggacacccggaccccgaaggccaagcgcgggacggcccagaucauggaggucaccgccaaguggcuguggggcuuccucucccggaacaagaagccccgcaucugcacccgggaggaguucacccgcaaggugcggagcaacgcggccaucggcgccguguucgucgacgagaaccaguggaacuccgccaaggaggcgguggaggacgagcgcuucugggaccuggugcaccgggagcgcgagcugcacaagcaggggaagugcgccacgugcgucuacaacaugaugggcaagcgggagaagaagcucggggaguucggcaaggccaaggggagccgcgccaucugguacauguggcugggcgcccgguuccuggaguucgaggcgcucggcuucaugaacgaggaccacugguucucccgcgagaacagccuguccgggguggagggcgaggggcugcacaagcucggcuacauccugcgggacaucagcaagauccccgggggcaacauguacgccgacgacaccgccggcugggacacccgcaucaccgaggacgaccugcagaacgaggcccgcaucacggacaucauggagccggagcacgcccuccuggcgaaguccaucuucaagcugaccuaccagaacaaggugguccgggugcagcgccccgccaagaacgggaccgugauggacgucaucagccggcgcgaccagcggggcuccggccaggugggcaccuacggccucaacacguucaccaacauggaggcccagcugauccgccagauggagagcgaggggaucuucucccccagcgagcuggagacccccaaccucgccgagcgggugcuggacuggcuggagaaguacggcgucgagcgccucaagcggauggccaucuccggggacgacugcguggugaagccgaucgacgaccgcuucgcgaccgcccugacggcccugaacgacaugggcaagguccggaaggacaucccccagugggagcccagcaagggguggaacgacuggcagcagguccccuucugcucccaccacuuccaccagcucaucaugaaggacggccgcgagaucguggucccgugccggaaccaggacgagcuggugggccgcgcccgggugagccagggggccggcuggaaccugcgcgagaccgcgugccucggcaagagcuacgcccagauguggcagcugauguacuuccaccggcgcgaccugcggcucgccgccaacgcgaucugcuccgccguccccguggacuggauccccaccagccgcaccacgugguccauccacgcccaccaccaguggaugaccaccgaggacaugcugagcguguggaaccgcgucuggaucgaggagaaccccuggauggaggacaagacccacaucuccagcugggaggacgugccguaccugggcaagcgggaggaccaguggugcgggucccucaucggccugacggcccgcgccaccugggcgaccaacauccagguggccaucaaccagguccggcgccugaucggcaacgagaacuaccucgacuacaugaccagcaugaagcgguucaagaacgaguccgaccccgagggggcccugugguga

SEQ ID NO: 8319 - RNA, 9879 nt, Artificial Sequence
  derived and/or modified CDS sequence (opt1) from DENV-1__FJ024434__SS-prME
agcgugaccaugcugcucaugcugaugcccaccgcccuggccuuccaccucaccacccgcggcggggagccccacaugaucgugagcaagcaggagcggggcaagagccugcuguucaagaccagcgccggggugaacaugugcacccucaucgccauggaccugggcgagcugugcgaggacacgaugaccuacaagugcccccgcaucaccgaggccgagcccgacgacguggacugcuggugcaacgccaccgacacgugggugaccuacgggaccugcagccagaccggcgagcaccggcgcgacaagcgguccguggcccucgcgccccacgugggccuggggcuggagacgcgcaccgagaccuggaugagcuccgagggcgccuggaagcagauccagcgggucgagaccugggcccuccgccaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcggugcugcggaagcucugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacaccggcgaccagcaccagguggggaacgaguccacggagcacggcaccaccgcgaccaucacgccccaggcccccacgaccgagauccagcucaccgacuacggggcccugacccuggacugcagcccccgcacgggccucgacuucaacgagaugguccugcugaccaugaaggagaaguccuggcucgugcacaagcagugguuccuggaccugccccuccccuggaccagcggggccagcaccucccaggagacguggaaccggcaggaccugcuggugaccuucaagaccgcccacgcgaagaagcaggaggucguggugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgucaugugcaccggguccuucaagcucgagaaggagguggcggagacgcagcacggcaccgugcugguccagaucaaguacgagggcaccgacgcccccugcaagauccccuucagcacccaggacgagaagggggugacgcagaacggccggcugaucaccgccaacccgaucgugaccgacaaggagaagcccgucaacaucgaggccgagccgcccuucggggaguccuacaucgugaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcgucgggaagcuggugcaccagaucuucggcaccgccuacgggguccucuucuccggcgucagcuggaccaugaagaucgggaucggcgugcugcugacguggcucggccugaacucccgcagcaccucccugagcaugaccugcaucgccguggggcucgucacccuguaccugggcgugauggugcaggccgacuccgggugcgucaucaacuggaagggccgggagcucaagugcgggagcggcaucuucgugacgaacgaggugcacaccuggaccgagcaguacaaguuccaggcggacagcccgaagcgccuguccgccgccaucggcaaggccugggaggagggggucugcggcauccggagcgccacccgccuggagaacaucauguggaagcagaucuccaacgagcucaaccacauccugcuggagaacgacaugaagcucaccgugguggucggggacguggcgggcauccuggggcagggcaagaagaugauccggccccagcccauggaguacaaguacagcuggaaguccuggggcaaggccaagaucaucggggccgacgcccagaacacgaccuucaucaucgacggccccaacaccccggagugccccgacgaccagcgcgcguggaacaucugggagguggaggacuacggguucggcaucuucaccacgaacaucuggcugaagcuccgggacagcuacacccaggucugcgaccaccgccugauguccgccgccaucaaggacagcaaggccgugcacgccgacaugggcuacuggaucgaguccgagaagaacgagaccuggaagcuggcgcgggccagcuucaucgaggugaagaccugcaucuggcccaagucccacacgcucuggagcaacgggguccuggaguccgagaugaucauccccaagaucuacggcgggccgaucagccagcacaacuaccgccccggcuacuucacccagaccgccgggcccuggcaccugggcaagcucgagcuggacuucgaccugugcgagggcaccacggugguggucgacgagcacugcgggaaccggggcccgucccuccgcaccaccaccgugacggggaagaucauccacgaguggugcugccggagcugcacccugccgccccugcgcuuccggggcgaggacgggugcugguacggcauggagauccgccccgugaaggagaaggaggagaaccucgucaaguccauggugagcgccggcagcggggagguggacuccuucagccugggccugcucugcaucuccaucaugaucgaggaggucaugcggagccgcuggucccggaagaugcugaugaccgggacccuggccguguucuuccuccugaucaugggccagcugacguggaacgaccucauccgccugugcaucauggugggggcgaacgccagcgaccgcaugggcaugggcaccaccuaccuggcccucauggccaccuucaagaugcggccgauguucgccgucgggcugcuguuccgccggcucacgucccgcgaggugcugcugcucaccaucggccugagccugguggcguccgucgagcuccccaacagccuggaggagcugggggacggccucgccaugggcaucaugauccugaagcugcucaccgacuuccagucccaccagcugugggccacccugcucagccugacguucaucaagaccaccuucucccugcacuacgccuggaagaccauggcgauggugcucagcaucgucucccuguucccccugugccucagcacgaccucccagaagaccaccuggcugcccgugcugcucgggagccugggcugcaagccgcugacgauguuccucaucgccgagaacaagaucugggggcggaaguccuggccccugaacgagggcaucauggccguggggaucgucagcauccugcucagcucccugcugaagaacgacgugccccucgccggcccccugaucgccggcgggaugcugaucgcgugcuacgugaucagcggcuccagcgccgaccucucccuggagaaggccgccgaggucagcugggaggaggaggccgagcacuccggggcgagccacaacauccugguggaggugcaggacgacggcaccaugaagaucaaggacgaggagcgcgacgacacccucaccauccugcugaaggccacccuccuggccgucuccgggguguacccgcugagcauccccgccacccucuucgugugguacuucuggcagaagaagaagcagcgguccggcguccugugggacacccccagcccgcccgagguggagcgcgccgugcuggacgacggcaucuaccggaucaugcagcgcgggcugcucggccggucccaggucggggugggcguguuccaggagaacgucuuccacaccauguggcacgugacccgcggggcggugcugauguaccagggcaagcggcuggagcccagcugggccuccgucaagaaggaccucaucagcuacggcgggggcuggcgccugcggggguccuggaacacgggcgaggagguccaggugaucgccgucgagcccgggaagaaccccaagaacgugcagaccgcccccggcaccuucaagacccccgagggcgaggugggggccaucgcgcuggacuucaagcccggcacgagcgggucccccaucgucaaccgcgagggcaagaucgugggccucuacgggaacggcguggucaccaccagcgggaccuacgugagcgccaucgcccaggccaaggcgucccaggagggcccgcugcccgagaucgaggacgagguguuccggaagcgcaaccugacgaucauggaccuccaccccgggagcggcaagacccggcgcuaccugccggccaucguccgggaggccaucaagcgcaagcugcgcacccucauccuggcccccacccgggugguggccuccgagauggcggaggcccugaagggcaugcccauccgcuaccagacgaccgccgucaagagcgagcacaccgggaaggagaucguggaccucaugugccacgccaccuucacgaugcggcugcugucccccgugcgcgucccgaacuacaacaugaucaucauggacgaggcccacuucaccgaccccagcuccaucgcggcccggggcuacaucagcacccgcguggggaugggcgaggccgccgccaucuucaugaccgcgacgccgcccggguccguggaggccuucccgcagagcaacgccgucauccaggacgaggagcgggacauccccgagcgcuccuggaacagcggcuacgaguggaucaccgacuuccccggcaagaccgugugguucgugcccuccaucaagagcgggaacgacaucgccaacugccuccggaagaacggcaagcgcgucauccagcugucccggaagaccuucgacacggaguaccagaagaccaagaacaacgacugggacuacguggugaccaccgacaucagcgagaugggggcgaacuuccgcgccgaccgggucaucgacccgcgccggugccugaagcccgugauccucaaggacggccccgagcgcgugauccuggccgggcccaugccggucacgguggccuccgccgcgcagcggcgcggccggaucggccgcaaccacaacaaggagggggaccaguacaucuacaugggccagccccugaacaacgacgaggaccacgcccacuggaccgaggccaagaugcuccuggacaacaucaacacccccgaggggaucauccccgcccuguucgagccggagcgcgagaaguccgccgcggucgacggcgaguaccggcuccgcggggaggcccggaagaccuucguggagcugaugcgccggggcgaccugcccguguggcucuccuacaaggucgccagcgagggcuuccaguacagcgaccgccgguggugcuucgacggggagcgcaacaaccaggugcuggaggagaacauggacguggagaucuggacgaaggagggcgagcggaagaagcugcgcccccgguggcucgacgcccgcaccuacuccgacccccuggcccugcgggaguacaaggaguucgcggccgggcgccggagcgucuccggcgaccucauccuggagaucggcaagcugccgcagcaccucacccagcgcgcccagaacgcccuggacaaccuggugaugcuccacaacagcgagcagggcgggcgggcguaccgccacgccauggaggagcugcccgacaccaucgagacgcugaugcuccuggcccugaucgccgugcucaccgggggcgucacccuguucuuccuguccgggcggggccucggcaagaccagcaucgggcugcugugcgugauggccuccagcgugcuccuguggauggcguccgucgagccccacuggaucgccgccagcaucauccuggaguucuuccucauggugcugcugauccccgagccggaccgccagcggacgccccaggacaaccagcucgccuacguggucaucggccugcuguucaugauccucacgguggccgcgaacgagauggggcugcuggagaccaccaagaaggaccucggcaucgggcacguggccgucgagaaccaccaccacgccgccaugcuggacguggaccugcaccccgccuccgcguggacccucuacgccguggccacgaccaucaucaccccgaugaugcgccacaccaucgagaacacgaccgccaacaucagccugaccgccaucgcgaaccaggccgccauccugaugggccucgacaagggcuggcccaucuccaagauggacaucggggucccccugcuggcccucggcugcuacagccaggugaacccccugacccugacggcggccgugcucaugcuggucgcccacuacgccaucaucgggccgggccugcaggccaaggcgacccgcgaggcccagaagcggaccgccgccgggaucaugaagaaccccaccguggacggcaucguggccaucgaccucgaccccgucguguacgacgcgaaguucgagaagcagcugggccagaucaugcugcucauccugugcacgucccagauccugcucaugcgcaccaccugggcccugugcgagagcaucacccuggccgccgggccccucacgacccugugggagggcuccccggggaaguucuggaacaccaccaucgccgugagcauggcgaacaucuuccggggcuccuaccuggccggcgccgggcucgccuucagccugaugaagucccugggcgggggccgccgggggacgggcgcgcagggcgagacccucggggagaaguggaagcgccagcugaaccagcuguccaagagcgaguucaacaccuacaagcgguccggcaucauggaggucgaccgcagcgaggccaaggaggggcucaagcggggcgagaccacgaagcacgccgugucccgcgggaccgccaagcugcggugguucguggagcgcaaccuggucaagcccgagggcaaggugaucgaccugggcugcgggcggggcggguggagcuacuacugcgccggccucaagaaggugaccgaggucaagggguacaccaagggcggccccgggcacgaggagcccaucccgauggcgacguacggcuggaaccuggugaagcugcacuccgggaaggacguguucuucaucccgcccgagaagugcgacacccuccugugcgacaucggcgagagcucccccaacccgaccaucgaggaggggcgcacccugcggguccucaagaugguggagcccuggcugcgcggcaaccaguucugcaucaagauccugaaccccuacaugcccagcguggucgaggcccucgagcagaugcagcggaagcacggcgggaugcuggugcgcaacccgcugucccggaacagcacgcacgagauguacuggguguccugcggcaccgggaacaucgucagcgccgugaacaugaccucccgcaugcuccugaaccgcuucaccauggcccaccggaagcccaccuacgagcgcgacguggaccugggcacgggcacccggcacgucgccguggagcccgagguggcgaaccucgacaucaucgggcagcgcaucgagaacaucaagcacgagcacaagagcaccuggcacuacgacgaggacaaccccuacaagaccugggccuaccacggcuccuacgaggucaagccgagcggguccgccagcagcauggugaacggcgucgugaagcugcugacgaagcccugggacgugauccccauggucacccagaucgccaugaccgacaccacgcccuucgggcagcagcggguguucaaggagaagguggacacccgcaccccgaaggccaagcggggcaccgcgcagaucauggaggucacggcccgcuggcucuggggcuuccugucccggaacaagaagccccgcaucugcacccgggaggaguucacccgcaaggugcggagcaacgccgccaucggggcgguguucgucgacgagaaccaguggaacuccgccaaggaggccguggaggacgagcgcuucugggaccuggugcaccgggagcgcgagcuccacaagcagggcaagugcgcgaccugcgucuacaacaugauggggaagcgggagaagaagcugggcgaguucgggaaggccaagggcagccgcgcgaucugguacauguggcugggcgcccgguuccucgaguucgaggcccugggguucaugaacgaggaccacugguucucccgcgagaacagccuguccggcguggagggggagggccuccacaagcugggguacauccugcgggacaucagcaagauccccggcggcaacauguacgccgacgacacggccgggugggacacccgcaucaccgaggacgaccuccagaacgaggcgaagaucaccgacaucauggagccggagcacgcccugcuggccaaggccaucuucaagcucacguaccagaacaaggugguccgcgugcagcggcccgccaagaacggcaccgugauggacgucaucucccgccgggaccagcgcgggagcggccaggugggcaccuacgggcugaacaccuucacgaacauggaggcgcagcugauccggcagauggaguccgagggcaucuucagccccuccgagcucgagacccccaaccuggccgagcgcgcccuggacuggcucgagaaguacgggguggagcggcugaagcgcauggccaucagcggcgacgacugcgucgugaagccgaucgacgaccgguucgccaccgcgcugaccgcccucaacgacauggggaaggugcgcaaggacaucccccagugggagcccuccaagggcuggaacgacuggcagcagguccccuucugcagccaccacuuccaccagcugaucaugaaggacggccgggagaucguggugccgugccgcaaccaggacgagcuggucgggcgggcccgcgugucccagggcgccggguggagccuccgggagacggcgugccugggcaagagcuacgcccagauguggcagcugauguacuuccaccgccgggaccuccgccuggccgccaacgccaucugcuccgcggugcccgucgacugggugcccaccagccggaccaccugguccauccacgcccaccaccaguggaugacgaccgaggacaugcugagcguguggaaccgcgucuggaucgaggagaaccccuggauggaggacaagacccacaucuccagcugggaggacgugccguaccucgggaagcgcgaggaccaguggugcggcucccugaucggccugaccgcccgggccacgugggccaccaacauccagguggcgaucaaccagguccgccggcucaucgggaacgagaacuaccuggacuacaugaucagcaugaagcgcuucaagaacgaguccgaccccgagggcgcccugugguga

SEQ ID NO: 8320 - RNA, 9879 nt, Artificial Sequence
  derived and/or modified CDS sequence (opt1) from DENV-1__FJ024435__SS-prME
agcgugaccaugcugcugaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgagaccgagcccgacgacguggacugcuggugcaacgccaccgacaccugggugaccuacgggaccugcagccagaccggcgagcaccggcgggacaagcgguccguggcccucgcgccccacgugggccuggggcuggagacccgcaccgagaccuggaugagcuccgagggcgccuggaagcagauccagcgggucgagacgugggcccuccggcaccccggguucaccgugaccgcccuguuccuggcccacgcgaucggcaccagcaucacgcagaaggggaucaucuucauccuccugaugcuggugacccccuccauggccaugcggugcgucggcaucggcagccgcgacuucguggaggggcucuccggcgccaccuggguggacgucgugcuggagcacgggagcugcgugaccacgauggccaaggacaagcccacccuggacaucgagcuccugaagaccgaggucaccaaccccgccgugcugcggaagcucugcaucgaggcgaagaucuccaacacgaccaccgacagccgcugcccgacccagggcgaggccacgcugguggaggagcaggacgccaacuucgucugccggcgcaccuucguggaccggggcugggggaacggcugcgggcuguucggcaaggggucccucaucacgugcgccaaguucaagugcgugaccaagcuggagggcaagaucguccaguacgagaaccugaaguacagcgugaucgugacgguccacaccggcgaccagcaccagguggggaacgaguccaccgagcacggcaccaccgccacgaucacgccccaggcgcccaccaccgagauccagcucacggacuacggggcccugacccuggacugcagcccccgcaccggccucgacuucaacgagaugguccugcugaccaugaaggagaaguccuggcucgugcacaagcagugguuccuggaccugccccuccccuggacgagcggggccagcaccucccaggagaccuggaaccggcaggaccugcuggugaccuucaagacggcccacgccaagaagcaggaggucguggugcucggcagccaggagggcgcgaugcacaccgcccugaccggggccaccgagauccagacguccggcaccaccaccaucuucgccgggcaccugaagugccgccucaagauggacaagcugacgcugaagggcaugagcuacgucaugugcaccggguccuucaagcucgagaaggagcuggccgagacccagcacggcaccgugcuggugcagaucaaguacgagggcacggacgcgcccugcaagauccccuucagcacccaggacgagaagggggucacccagaacggccggcugaucaccgccaacccgaucgugacggacaaggagaagcccgugaacaucgaggccgagccgcccuucggggaguccuacaucgucaucggcgccggcgagaaggcgcucaagcugagcugguucaagaagggguccagcaucggcaagauguucgaggccaccgcccgcggggcccggcgcauggccauccugggcgacaccgcgugggacuucggguccaucggcggcguguucaccagcguggggaagcucguccaccagaucuucggcacggccuacggggugcuguucuccggcgugagcuggaccaugaagaucgggaucggcguccugcucaccuggcugggccugaacucccgcagcaccucccucagcaugacgugcaucgccguggggcuggugacccuguaccucggcgucauggugcaggccgacuccgggugcgugaucaacuggaagggccgggagcugaagugcgggagcggcaucuucgucaccaacgaggugcacaccuggaccgagcaguacaaguuccaggccgacagcccgaagcgccuguccgcggccaucggcaaggccugggaggagggggugugcggcauccggagcgccacgcgccucgagaacaucauguggaagcagaucuccaacgagcugaaccacauccugcucgagaacgacaugaaguucaccgucguggugggggacgucgccggcauccuggcgcaggggaagaagaugauccggccccagcccauggagcacaaguacagcuggaaguccuggggcaaggccaagaucaucggcgccgacgugcagaacaccaccuucaucaucgacgggcccaacacgccggagugccccgacgaccagcgcgccuggaacaucugggagguggaggacuacggcuucgggaucuucaccaccaacaucuggcugaagcuccgggacagcuacacccaggucugcgaccaccgccugauguccgcggccaucaaggacagcaaggccgugcacgccgacaugggcuacuggaucgaguccgagaagaacgagacguggaagcuggcccgggcgagcuucaucgaggugaagaccugcaucuggcccaagucccacacccucuggagcaacggcguccuggaguccgagaugaucauccccaagaucuacgggggcccgaucagccagcacaacuaccgccccggguacuucacccagacggccggccccuggcaccuggggaagcucgagcuggacuucgaccugugcgagggcaccaccgugguggucgacgagcacugcggcaaccgggggccgucccuccgcaccacgaccgugaccggcaagaucaucuacgaguggugcugccggagcugcacccugccgccccugcgcuuccgcggggaggacggcugcugguacgggauggagauccgccccgugaaggagaaggaggagaaccucgucaaguccauggugagcgccggcagcggcgagguggacuccuucagccuggggcugcucugcaucuccaucaugaucgaggaggucaugcggagccgcuggucccggaagaugcugaugacgggcacccuggccguguucuuccuccugaucguggggcagcugaccuggaacgaccucauccgccugugcaucauggucggcgccaacgcgagcgaccgcauggggaugggcaccacguaccuggcccucauggccaccuucaagaugcggccgauguucgccgugggccugcuguuccgccggcucaccucccgcgaggugcugcugcucaccaucgggcugagccuggucgccuccguggagcuccccaacagccuggaggagcugggcgacgggcucgcgaugggcaucaugauccugaagcugcucacggacuuccagucccaccagcugugggccacccugcucagccugaccuucaucaagaccacguucucccugcacuacgccuggaagaccauggccaugguccucagcguggugucccuguucccccugugccucagcaccaccucccagaagacgaccuggcugcccguccugcucggcagccuggggugcaagccgcugaccauguuccucaucgcggagaacaagaucuggggccggcgcuccuggccccugaacgaggggaucauggccgugggcaucgugagcauccugcucagcucccugcugaagaacgacgucccccucgccgggccccugaucgccggcggcaugcugaucgccugcuacgugaucagcggguccagcgcggaccucucccuggagaaggccgccgaggugagcugggaggaggaggccgagcacuccggcgccagccacaacauccuggucgaggugcaggacgacgggaccaugaagaucaaggacgaggagcgggacgacacccucacgauccugcugaaggcgacccuccuggccguguccggcgucuacccgcugagcauccccgccacccucuucgugugguacuucuggcagaagaagaagcagcgcuccggggugcugugggacacccccagcccgcccgaggucgagcgggccgugcuggacgacggcaucuaccgcaucaugcagcggggccugcucgggcgcucccaggugggcgucgggguguuccaggagaacguguuccacacgauguggcacgucacccggggcgccgugcugauguaccaggggaagcgccuggagcccagcugggcguccgugaagaaggaccucaucagcuacggcggcggguggcggcugcagggcuccuggaacaccggggaggagguccaggugaucgccguggagcccggcaagaaccccaagaacguccagaccgcccccgggacguucaagacccccgagggcgaggugggcgccaucgcccuggacuucaagcccgggaccagcggcucccccaucgugaaccgcgaggggaagaucgucggccucuacggcaacgggguggugaccacgagcggcaccuacgucagcgcgaucgcccaggccaaggccucccaggaggggccgcugcccgagaucgaggacgagguguuccggaagcgcaaccugaccaucauggaccuccaccccggcagcgggaagacccggcgcuaccugccggcgaucgugcgggaggccaucaagcgcaagcugcgcacgcucauccuggcccccacccgggucguggccuccgagauggccgaggcgcugaagggcaugcccauccgcuaccagaccaccgccgucaagagcgagcacacgggcaaggagaucgucgaccucaugugccacgccaccuucaccaugcggcugcugucccccgugcgcgugccgaacuacaacaugaucaucauggacgaggcccacuucaccgaccccagcuccaucgccgcgcggggguacaucagcacgcgcgucggcaugggggaggccgccgccaucuucaugaccgccacgccgcccggcuccguggaggcguucccgcagagcaacgccgugauccaggacgaggagcgggacauccccgagcgcuccuggaacagcggguacgaguggaucaccgacuuccccggcaagacggucugguucgugcccuccaucaagagcggcaacgacaucgccaacugccuccggaagaacgggaagcgcgugauccagcugucccggaagaccuucgacaccgaguaccagaagaccaagaacaacgacugggacuacgucgugacgaccgacaucagcgagaugggcgccaacuuccgcgcggaccgggugaucgacccgcgccggugccugaagcccgucauccucaaggacgggcccgagcgcgugauccuggccggccccaugccggucaccguggccuccgccgcccagcggcgcgggcggaucggccgcaaccacaacaaggagggcgaccaguacaucuacauggggcagccccugaacaacgacgaggaccacgcgcacuggaccgaggccaagaugcuccuggacaacaucaacacgcccgagggcaucauccccgcccuguucgagccggagcgcgagaaguccgccgccaucgacggggaguaccggcuccgcggcgaggcgcggaagaccuucguggagcugaugcgccgcggggaccugcccgucuggcucuccuacaagguggccagcgagggcuuccaguacagcgaccgccgguggugcuucgacggcgagcgcaacaaccaggugcuggaggagaacauggacgucgagaucuggaccaaggagggggagcggaagaagcugcgcccccgguggcucgacgcccgcaccuacuccgacccccuggcccugcgggaguucaaggaguucgccgcgggccgccggagcguguccggggaccucauccuggagaucggcaagcugccgcagcaccucacgcagcgcgcccagaacgcccuggacaaccuggugaugcuccacaacagcgagcagggcgggcgggccuaccgccacgcgauggaggagcugcccgacaccaucgagacccugaugcuccuggcccugaucgccguccucaccggcggggugacccuguucuuccuguccggccgggggcucggcaagacgagcaucggccugcugugcgugauggccuccagcguccuccuguggauggccuccguggagccccacuggaucgcggccagcaucauccuggaguucuuccucauggugcugcugauccccgagccggaccgccagcggacgccccaggacaaccagcucgccuacgucgugaucgggcugcuguucaugauccucaccguggccgccaacgagaugggccugcuggagaccacgaagaaggaccucgggaucggccacgucgcgguggagaaccaccaccacgccgccaugcuggacguggaccugcaccccgccuccgccuggacccucuacgcggucgccaccaccaucaucacgccgaugaugcgccacaccaucgagaacaccaccgccaacaucagccugacggccaucgccaaccaggcggccauccugauggggcucgacaagggcuggcccaucuccaagauggacaucggcgugccccugcuggcccucgggugcuacagccaggugaacccccugacccugaccgccgcgguccucaugcugguggcccacuacgccaucaucggcccggggcugcaggccaaggccacccgcgaggcgcagaagcggacggccgccggcaucaugaagaaccccaccguggacgggaucgucgccaucgaccucgaccccgugguguacgacgccaaguucgagaagcagcugggccagaucaugcugcucauccugugcaccucccagauccugcucaugcgcaccacgugggcgcugugcgagagcaucacccuggccaccggcccccucaccacgcugugggagggguccccgggcaaguucuggaacaccaccaucgccgucagcauggccaacaucuuccggggguccuaccuggccggcgcgggccucgccuucagccugaugaagucccucgggggcgggcgccgggggaccggggcccagggcgagacgcucggcgagaaguggaagcgccagcugaaccagcuguccaagagcgaguucaacaccuacaagcgguccgggaucauggagguggaccgcagcgaggccaaggagggccucaagcgcggggagaccaccaagcacgcggugucccgcggcacggccaagcugcggugguucgucgagcgcaaccuggugaagcccgaggggaaggugaucgaccugggcugcggccgcgggggcuggagcuacuacugcgccgggcucaagaaggucaccgaggugaagggcuacaccaagggcggccccggccacgaggagcccaucccgauggccaccuacggguggaaccuggugaagcugcacuccggcaaggacgucuucuucaucccgcccgagaagugcgacacgcuccugugcgacaucggggagagcucccccaacccgaccaucgaggagggccgcacccugcgggugcucaagaugguggagcccuggcugcgcgggaaccaguucugcaucaagauccugaaccccuacaugcccagcgucguggagacccucgagcagaugcagcggaagcacggcggcaugcuggugcgcaacccgcugucccggaacagcacccacgagauguacugggucuccugcgggacgggcaacaucgugagcgccgugaacaugaccucccgcaugcuccugaaccgcuucaccauggcgcaccggaagcccaccuacgagcgcgacgucgaccugggggccggcacgcggcacguggccguggagcccgaggucgccaaccucgacaucaucggccagcgcaucgagaacaucaagcacgagcacaagagcaccuggcacuacgacgaggacaaccccuacaagaccugggccuaccacggguccuacgaggugaagccgagcggcuccgcgagcagcauggucaacgggguggugaagcugcugaccaagcccugggacgucauccccauggugacgcagaucgccaugaccgacaccacccccuucggccagcagcggguguucaaggagaaggucgacacgcgcaccccgaaggccaagcgggggaccgcccagaucauggaggugaccgccaaguggcucuggggcuuccugucccgcaacaagaagccccggaucugcacgcgcgaggaguucacccggaaggugcgcagcaacgcggccaucggcgccgucuucguggacgagaaccaguggaacuccgccaaggaggcgguggaggacgagcgguucugggaccugguccaccgcgagcgggagcuccacaagcaggggaagugcgcgaccugcguguacaacaugaugggcaagcgcgagaagaagcugggggaguucggcaaggccaaggggagccgggccaucugguacauguggcugggcgcccgcuuccucgaguucgaggcgcugggcuucaugaacgaggaccacugguucucccgggagaacagccuguccgggguggagggcgaggggcuccacaagcugggcuacauccugcgcgacaucagcaagauccccgggggcaacauguacgccgacgacaccgccggcugggacacgcggaucaccgaggacgaccuccagaacgaggcccgcaucaccgacaucauggagccggagcacgcccugcuggcgaaguccaucuucaagcucaccuaccagaacaaggucgugcgcgugcagcggcccgccaagaacgggacggucauggacgugaucagccgccgggaccagcgcggcuccggccagguggggaccuacggccugaacaccuucaccaacauggaggcccagcugauccggcagauggagagcgaggggaucuucucccccagcgagcucgagacgcccaaccuggccgagcgcguccuggacuggcucgagaaguacggcguggagcggcugaagcgcauggccaucuccggggacgacugcguggucaagccgaucgacgaccgguucgcgaccgcccugaccgcccucaacgacaugggcaaggugcgcaaggacaucccccagugggagcccagcaagggguggaacgacuggcagcagguccccuucugcucccaccacuuccaccagcugaucaugaaggacggccgggagaucgucgugccgugccgcaaccaggacgagcuggugggccgggcccgcgucagccagggggccggcuggagccuccgggagaccgcgugccuggggaaguccuacgcccagauguggcagcugauguacuuccaccgccgggaccuccgccuggccgccaacgcgaucugcagcgccgugcccguggacuggauccccacgucccggaccaccuggagcauccacgcccaccaccaguggaugaccacggaggacaugcuguccgucuggaaccgcguguggaucgaggagaaccccuggauggaggacaagacccacaucagcuccuggggcgacgugccguaccucgggaagcgcgaggaccaguggugcggcagccugaucggccugaccgcccgggccaccugggcgaccaacauccaggucgccaucaaccaggugcgccggcucaucgggaacgagaacuaccuggacuacaugacguccaugaagcgcuucaagaacgagagcgaccccgagggcgcccugugguga

SEQ ID NO: 8321 - RNA, 9879 nt, Artificial Sequence
  derived and/or modified CDS sequence (opt1) from DENV-1__FJ024436__SS-prME
agcgugaccaugcugcucaugcugaugcccaccgcccuggccuuccaccucacgacccgcggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccgcaucaccgaggccgagcccgacgacguggacugcuggugcaacgccaccgacacgugggugaccuacgggaccugcagccagaccggcgagcaccggcgcgacaagcgguccguggcccucgcgccccacgugggccuggggcuggagacgcgcaccgagaccuggaugagcuccgagggcgccuggaagcagauccagcggguggagaccugggcccuccgccaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcggugcugcggaagcucugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacaccggcgaccagcaccagguggggaacgaguccacggaguacggcaccaccgcgaccaucacgccccaggcccccagcacggagauccagcucaccgacuacggggcccugacccuggacugcagcccccggaccggccucgacuucaacgagaugguccugcugacgaugaaggagaaguccuggcucgugcacaagcagugguuccuggaccugccgcuccccuggaccagcggggccuccaccagccaggagaccuggaaccggcaggaccugcuggugacguucaagaccgcccacgcgaagaagcaggaggucguggugcucggcucccaggagggcgccaugcacaccgcccugaccggggccacggagauccagaccagcggcaccaccacgaucuucgccgggcaccugaagugccgccucaagauggacaagcugacccugaagggcauguccuacgucaugugcaccgggagcuucaagcucgagaaggagguggcggagacccagcacggcacggugcugguccagaucaaguacgagggcaccgacgcccccugcaagauccccuucuccacccaggacgagaagggggugacccagaacggccggcugaucacggccaacccgaucgugaccgacaaggagaagcccgucaacaucgaggccgagccgcccuucggggagagcuacaucgugaucggcgcgggcgagaaggcccugaagcucuccugguucaagaaggggagcuccaucggcaagauguucgaggccaccgcccgcggggcccggcgcauggcgauccugggcgacaccgccugggacuucgggagcaucggcggcguguucacguccgucgggaagcuggugcaccagaucuucggcaccgccuacggggugcuguucagcggcgucuccuggaccaugaagaucgggaucggcgugcugcugaccuggcucggccugaacagccgcuccacgagccuguccaugaccugcaucgccguggggcucgucacccuguaccugggcgugauggugcaggccgacagcgggugcgucaucaacuggaagggccgggagcucaagugcgggagcggcaucuucgugaccaacgaggugcacacguggaccgagcaguacaaguuccaggcggacuccccgaagcgccugagcgccgccaucggcaaggccugggacgagggggucugcggcauccgguccgccacccgccuggagaacaucauguggaagcagaucagcaacgagcucaaccacauccugcuggagaacgacaugaaguucaccgugguggucggggacguggcgggcauccucgcccaggggaagaagaugauccggccccagcccauggaguacaaguacuccuggaaguccuggggcaaggccaagaucaucggcgccgacgugcagaacaccacguucaucaucgacgggcccaacaccccggagugccccgacgaccagcgcgcguggaacaucugggaggucgaggacuacggcuucgggaucuucaccaccaacaucuggcugaagcugcgggacuccuacacccaggugugcgaccaccgccucaugagcgccgccaucaaggacuccaaggccgugcacgccgacaugggcuacuggaucgagagcgagaagaacgagaccuggaagcuggcgcgggccuccuucaucgaggucaagaccugcaucuggcccaagagccacacccugugguccaacggcgugcucgagagcgagaugaucauccccaagaucuacgggggcccgaucucccagcacaacuaccgccccggguacuucacgcagaccgccggccccuggcaccuggggaagcuggagcucgacuucaaccugugcgagggcaccaccguggucguggacgagcacugcggcaaccgggggccgagccugcgcacgaccaccgugaccggcaagaucauccacgaguggugcugccgguccugcacgcugccgccccuccgcuucaagggggaggacggcugcugguacgggauggagauccggcccgucaaggagaaggaggagaaccuggucaagagcauggugagcgccggcuccggcgaggucgacagcuucucccucgggcugcugugcaucagcaucaugaucgaggaggugaugcgcucccgguggagccgcaagaugcucaugaccggcacccuggccguguucuuccugcucaucauggggcagcugaccuggaacgaccugauccggcucugcaucauggucggcgcgaacgccuccgaccgcauggggaugggcacgaccuaccuggcccugauggccaccuucaagaugcgcccgaugcucgccguggggcugcuguuccggcgccucaccagccgggaggugcugcugcucacgaucgggcugucccuggucgcgagcguggagcuccccaacucccuggaggagcugggcgacgggcucgccaugggcaucaugauccugaagcugcucaccgacuuccagagccaccagcugugggccacccugcucucccugaccuucaucaagacgaccuacagccugcacuacgccuggaagaccauggcgaugguccucuccaucgugagccuguucccccugugccucuccaccacgagccagaagaccaccuggcugcccgugcugcucggcucccuggggugcaagccgcugaccauguuccucaucgccgagaacaagaucuggggccgcaagagcuggccccugaacgaggggaucauggccgucggcaucgugagcauccugcucuccagccugcugaagaacgacgugccccucgccgggccccugaucgccggcggcaugcugaucgcgugcuacgucaucuccgggagcuccgccgaccucagccuggagaaggccgccgagguguccugggaggaggaggccgagcacagcggcgcgucccacaacauccugguggagguccaggacgacgggacgaugaagaucaaggacgaggagcgggacgacacccucaccauccugcugaaggccacccuccuggccgugagcggcguguacccgcuguccauccccgccacccucuucgucugguacuucuggcagaagaagaagcagcgcagcggggugcugugggacacgcccagcccgcccgagguggagcgggccguccuggacgacggcaucuaccgcaucaugcagcggggccugcucgggcgcagccaggugggcgugggggucuuccaggagaacguguuccacaccauguggcacgugacccggggcgcgguccugauguaccaggggaagcgccuggagcccuccugggccagcgugaagaaggaccucaucuccuacggcggcggguggcggcugcagggcagcuggaacaccggggaggaggugcaggucaucgccguggagcccggcaagaaccccaagaacgugcagacggcccccgggaccuucaagaccuccgagggcgaggucggcgccaucgcgcuggacuucaagcccgggaccagcggcagccccaucgugaaccgcgaggggaagaucgugggccucuacggcaacggggucgugacgaccuccggcaccuacgugagcgccaucgcccaggccaaggcgucccaggaggggccccugccggagaucgagaacgaggucuuccggaagcgcaaccugaccaucauggaccuccaccccggcagcgggaagacgcggcgcuaccugcccgccaucgugcgggaggccaucaagcgcaagcugcggacccucauccuggccccgacccgcguggucgccuccgagauggcggaggcccugaagggcaugcccauccgcuaccagaccacggccgucaagagcgagcacaccggcaaggagaucguggaccucaugugccacgccaccuucaccaugcggcugcugucccccguccgcgugcccaacuacaacaugaucaucauggacgaggcccacuucacggacccgagcuccaucgcggcccggggguacaucagcacccgcgugggcaugggggaggccgccgccaucuucaugaccgcgacgccgcccggcuccgucgaggccuucccccagagcaacgccgugauccaggacgaggagcgggacaucccggagcgcuccuggaacagcggguacgaguggaucacggacuuccccggcaagaccgugugguucguccccuccaucaagagcggcaacgacaucgccaacugccuccggaagaacgggaagcgcgugauccagcugucccggaagaccuucgacaccgaguaccagaagacgaagaacaacgacugggacuacguggucaccaccgacaucagcgagaugggcgcgaacuuccgcgccgaccgggugaucgacccccgccggugccugaagccggugauccucaaggacgggcccgagcgcgucauccuggccggccccaugcccgugaccgucgccuccgccgcgcagcggcgcgggcggaucggccgcaaccacaacaaggagggcgaccaguacaucuacauggggcagccgcugaacaacgacgaggaccacgcccacuggacggaggccaagaugcuccuggacaacaucaacacccccgagggcaucauccccgcccuguucgagcccgagcgggagaaguccgccgcgaucgacggggaguaccgccuccgcggcgaggcccggaagaccuucguggagcugaugcgccgcggggaccugccgguguggcucagcuacaaggucgccuccgagggcuuccaguacagcgaccgccgguggugcuucgacggcgagcgcaacaaccaggugcuggaggagaacauggacguggagaucuggaccaaggagggggagcggaagaagcugcgcccccgguggcucgacgcccgcacguacuccgacccccuggcccugcgggaguucaaggaguucgcggccggccgcaagagcgucuccggggaccucauccuggagaucggcaagcugccccagcaccucacccagcgggcccagaacgcccuggacaaccuggugaugcuccacaacagcgagcagggcgggcgcgcguaccggcacgccauggaggagcugccggacaccaucgagacccugaugcuccuggcccugaucgccgugcucacgggcggggucacccuguucuuccuguccggccgcgggcucggcaagaccagcaucggccugcugugcgugauggccuccagcgugcuccuguggauggcguccgucgagccccacuggaucgccgccagcaucauccuggaguucuuccucauggugcugcugauccccgagcccgaccggcagcgcaccccgcaggacaaccagcucgccuacguggucaucgggcugcuguucaugauccucaccguggccgcgaacgagaugggccugcuggagacgaccaagaaggaccucgggaucggccacguggccgucgagaaccaccaccacgccgccaugcuggacguggaccugcaccccgccuccgcguggacccucuacgccguggccaccacgaucaucacccccaugaugcggcacaccaucgagaacaccacggccaacaucagccugaccgccaucgcgaaccaggccgccauccugauggggcucgacaagggcuggccgaucuccaagauggacaucggcgucccccugcuggcccucgggugcuacagccaggugaacccccugacccugaccgcggccgugcucaugcuggucgcccacuacgccaucaucggccccgggcugcaggccaaggcgacgcgcgaggcccagaagcggaccgccgccggcaucaugaagaacccgaccguggacgggaucguggccaucgaccucgaccccgucguguacgacgcgaaguucgagaagcagcugggccagaucaugcugcucauccugugcaccucccagauccugcucaugcgcacgaccugggcccugugcgagagcaucacccuggccaccggcccccucacgacccugugggaggggucccccggcaaguucuggaacaccaccaucgccgugagcauggccaacaucuuccgcgggagcuaccuggcgggcgccggccucgccuucucccugaugaagucccucgggggcgggcggcgcgggacgggggcccagggcgagacccucggcgagaaguggaagcggcagcugaaccagcuguccaagagcgaguucaacaccuacaagcgcuccgggaucauggaggucgaccggagcgaggcgaaggagggccucaagcgcggggagaccacgaagcacgccgugucccggggcaccgccaagcugcgcugguucguggagcggaaccuggucaagccggaggggaaggugaucgaccugggcugcggccgcgggggcuggagcuacuacugcgccgggcucaagaaggugaccgaggucaagggcuacaccaagggcgggcccggccacgaggagcccauccccauggccacguacggguggaaccuggugaagcugcacuccggcaaggacguguucuucaucccgcccgagaagugcgacacccuccugugcgacaucggggagagcucccccaaccccaccaucgaggagggccggacccugcgcguccucaagaugguggagccguggcugcgggggaaccaguucugcaucaagauccugaaccccuacaugcccagcguggucgagacgcucgagcagaugcagcgcaagcacggcggcaugcuggugcggaacccccugucccgcaacagcacccacgagauguacuggguguccugcgggaccggcaacaucgucagcgcggugaacaugaccucccggaugcuccugaaccgcuucaccauggcccaccggaagccgacguacgagcgcgacguggaccugggggccggcacccgccacgucgccguggagcccgagguggccaaccucgacaucaucggccagcggaucgagaacaucaagcacgagcacaagagcaccuggcacuacgacgaggacaaccccuacaagaccugggcguaccacggguccuacgaggucaagcccagcggcagcgccuccagcauggugaacggggucgugaagcugcugacgaagccgugggacgugauccccauggucacccagaucgccaugaccgacaccacgcccuucggccagcagcgcguguucaaggagaagguggacacccggacccccaaggccaagcgcgggaccgcccagaucauggaggucacggcgaaguggcucuggggcuuccugucccggaacaagaagccgcgcaucugcacccgggaggaguucacccgcaaggugcggagcaacgccgccaucggcgccguguucgucgacgagaaccaguggaacuccgcgaaggaggccguggaggacgagcgcuucugggaccuggugcaccgggagcgcgagcuccacaagcaggggaagugcgcgaccugcgucuacaacaugaugggcaagcgggagaagaagcugggggaguucggcaaggccaaggggagccgcgccaucugguacauguggcugggcgcgcgguuccucgaguucgaggcccugggcuucaugaacgaggaccacugguucucccgcgagaacagccuguccgggguggagggcgaggggcuccacaagcugggcuacauccugcgggacaucagcaagauccccgggggcaacauguacgccgacgacacggccggcugggacacccgcaucaccgaggacgaccuccagaacgaggccaagaucaccgacaucauggagcccgagcacgcgcugcuggccaaguccaucuucaagcucacguaccagaacaaggugguccgggugcagcgcccggccaagaacgggaccgugauggacgucaucagccggcgcgaccagcgcggcuccggccaggugggcaccuacggccugaacaccuucacgaacauggaggcccagcugauccggcagauggagagcgaggggaucuucucccccagcgagcucgagacccccaaccuggccggccgcgugcuggacuggcucgagaagcacggggucgagcggcugaagcgcauggcgaucuccggcgacgacugcguggugaagcccaucgacgaccgguucgccaccgcccugaccgcccucaacgacauggggaagguccgcaaggacaucccgcagugggagcccagcaagggcuggaacgacuggcagcagguccccuucugcagccaccacuuccaccagcugaucaugaaggacggccgggagaucgugguccccugccgcaaccaggacgagcugguggggcgggcccgcgugucccagggcgcgggguggagccuccgggagacggccugccugggcaaguccuacgcccagauguggcagcugauguacuuccaccgccgggaccuccgccuggccgcgaacgccaucugcagcgccgucccgguggacugggugcccaccucccggaccaccuggagcauccacgcccaccaccaguggaugacgaccgaggacaugcuguccgucuggaaccgcguguggaucgaggagaaccccuggauggaggacaagacccacaucagcuccuggggcgacgugcccuaccucggcaagcgggaggaccaguggugcggcagccugaucgggcugaccgcccgcgcgacgugggccaccaacauccaggucgccaucaaccaggugcggcgccucaucggcaacgagaacuaccuggacuacaugaccuccaugaagcgcuucaagaacgagagcgacccggagggggcccugugguga

SEQ ID NO: 8322 - RNA, 9879 nt, Artificial Sequence
  derived and/or modified CDS sequence (opt1) from DENV-1__FJ024472__SS-prME
agcgugaccaugcugcugaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgagaccgagcccgacgacguggacugcuggugcaacgccacggacaccugggugaccuacgggaccugcagccagacgggcgagcaccggcgggacaagcgguccguggcccucgcgccccacgugggccuggggcuggagacccgcaccgagaccuggaugagcuccgagggcgccuggaagcagauccagcgggucgagacgugggcccuccggcaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagcuggccgagacccagcacggcaccgugcuggugcagaucaaguacgagggcaccgacgcgcccugcaagauccccuucagcacgcaggacgagaagggggucacccagaacggccggcugaucaccgccaacccgaucgugaccgacaaggagaagcccgugaacaucgaggccgagccgcccuucggggaguccuacaucgucaucggcgccggcgagaaggcgcucaagcugagcugguucaagaagggguccagcaucggcaagauguucgaggccacggcccgcggggcccggcgcauggccauccugggcgacaccgcgugggacuucggguccaucggcggcguguucaccagcguggggaagcucguccaccagaucuucggcaccgccuacggggugcuguucuccggcgugagcuggacgaugaagaucgggaucggcguccugcucaccuggcugggccugaacucccgcagcaccucccucagcaugaccugcaucgccguggggcuggugacgcuguaccucggcgucauggugcaggccgacuccgggugcgugaucaacuggaagggccgggagcugaagugcgggagcggcaucuucgucaccaacgaggugcacaccuggaccgagcaguacaaguuccaggccgacagcccgaagcgccuguccgcggccgugggcaaggccugggaggagggggucugcggcauccggagcgccacccgccucgagaacaucauguggaagcagaucuccaacgagcugaaccacauccugcucgagaacgacaugaaguucacggugguggucggggacguggccggcauccuggcgcaggggaagaagaugauccggccccagcccauggaguacaaguacagcuggaaguccuggggcaaggccaagaucaucggcgccgacgugcagaacaccaccuucaucaucgacgggcccaacaccccggagugccccgacgaccagcgcgccuggaacaucugggaggucgaggacuacggcuucgggaucuucacgaccaacaucuggcugaagcuccgggacagcuacacccaggugugcgaccaccgccugauguccgcggccaucaaggacagcaaggccgugcacgccgacaugggcuacuggaucgaguccgagaagaacgagaccuggaagcuggcccgggcgagcuucaucgaggucaagacgugcaucuggcccaagucccacacccucuggagcaacggcgugcuggaguccgagaugaucauccccaagaucuacgggggcccgaucagccagcacaacuaccgccccggguacuucacccagaccgccggccccuggcaccuggggaagcucgagcuggacuucgaccugugcgagggcacgaccguggucguggacgagcacugcggcaaccgggggccgucccuccgcaccaccacggugaccggcaagaucauccacgaguggugcugccggagcugcacccugccgccccugcgcuuccgcggggaggacggcugcugguacgggauggagauccgccccgucaaggagaaggaggagaaccucgugaaguccauggugagcgccggcagcggcgaggucgacuccuucagccuggggcugcucugcaucuccaucaugaucgaggaggugaugcggagccgcuggucccggaagaugcugaugaccggcacgcuggccgugaucuuccuccugaucauggggcagcugaccuggaacgaccucauccgccugugcaucauggucggcgccaacgcgagcgaccgcauggggaugggcaccaccuaccuggcccucauggccacguucaagaugcggccgauguucgccgugggccugcuguuccgccggcucaccucccgcgaggugcugcugcucaccaucgggcugagccuggucgccuccguggagcuccccaacagccuggaggagcugggcgacgggcucgcgaugggcaucaugauccugaagcugcucaccgacuuccagucccaccagcugugggccacgcugcucagccugaccuucaucaagaccaccuucucccugcacuacgccuggaagacgauggccaugguccucagcaucgugucccuguucccccugugccucagcaccaccucccagaagaccacguggcugcccgugcugcucggcagccuggggugcaagccgcugaccauguuccucaucgcggagaacaagaucuggggccggcgcuccuggccccugaacgaggggaucauggccgucggcaucgugagcauccugcucagcucccugcugaagaacgacgugccccucgccgggccccugaucgccggcggcaugcugaucgccugcuacgucaucagcggguccagcgcggaccucucccuggagaaggccgccgaggugagcugggaggaggaggccgagcacuccggcgccagccacaacauccugguggagguccaggacgacgggaccaugaagaucaaggacgaggagcgggacgacacccucaccauccugcugaaggcgacgcuccuggccguguccggcguguacccgcugagcauccccgccacccucuucgucugguacuucuggcagaagaagaagcagcgcuccggggugcugugggacacccccagcccgcccgagguggagcgggccguccuggacgacggcaucuaccgcaucaugcagcggggccugcucgggcgcucccaggugggcgugggggucuuccaggagaacguguuccacaccauguggcacgugacgcggggcgccguccugauguaccaggggaagcgccuggagcccagcugggcguccgugaagaaggaccucaucagcuacggcggcggguggcggcugcagggcuccuggaacaccggggaggaggugcaggucaucgccguggagcccggcaagaaccccaagaacgugcagaccgcccccgggaccuucaagacgcccgagggcgaggucggcgccaucgcccuggacuucaagcccgggaccagcggcucccccaucgugaaccgcgaggggaagaucgugggccucuacggcaacggggucgugaccaccagcggcacguacgugagcgcgaucgcccaggccaaggccucccaggaggggccgcugcccgagaucgaggacgaggucuuccggaagcgcaaccugaccaucauggaccuccaccccggcagcgggaagacccggcgcuaccugccggcgaucgugcgggaggccaucaagcgcaagcugcgcacccucauccuggcccccacgcggguggucgccuccgagauggccgaggcgcugaagggcaugcccauccgcuaccagaccaccgccgucaagagcgagcacaccggcaaggagaucguggaccucaugugccacgccacguucaccaugcggcugcugucccccguccgcgugccgaacuacaacaugaucaucauggacgaggcccacuucaccgaccccagcuccaucgccgcgcggggguacaucagcacccgcgugggcaugggggaggccgccgccaucuucaugacggccacgccgcccggcuccgucgaggcguucccgcagagcaacgccgugauccaggacgaggagcgggacauccccgagcgcuccuggaacagcggguacgaguggaucaccgacuuccccggcaagaccgugugguucguccccuccaucaagagcggcaacgacaucgccaacugccuccggaagaacgggaagcgcgugauccagcugucccggaagacguucgacaccgaguaccagaagaccaagaacaacgacugggacuacguggucaccacggacaucagcgagaugggcgccaacuuccgcgcggaccgggugaucgacccgcgccggugccugaagcccgugauccucaaggacgggcccgagcgcgucauccuggccggccccaugccggugaccgucgccuccgccgcccagcggcgcgggcggaucggccgcaaccacaacaaggagggcgaccaguacaucuacauggggcagccccugaacaacgacgaggaccacgcgcacuggaccgaggccaagaugcuccuggacaacaucaacacccccgagggcaucauccccgcccuguucgagccggagcgcgagaaguccgccgccaucgacggggaguaccggcuccgcggcgaggcgcggaagacguucguggagcugaugcgccgcggggaccugcccguguggcucuccuacaaggucgccagcgagggcuuccaguacagcgaccgccgguggugcuucgacggcgagcgcaacaaccaggugcuggaggagaacauggacguggagaucuggaccaaggagggggagcggaagaagcugcgcccccgguggcucgacgcccgcaccuacuccgacccccuggcccugcgggaguucaaggaguucgccgcgggccgccggagcgucuccggggaccucauccuggagaucggcaagcugccgcagcaccucacccagcgcgcccagaacgcccuggacaaccuggugaugcuccacaacagcgagcagggcgggcgggccuaccgccacgcgauggaggagcugcccgacacgaucgagacccugaugcuccuggcccugaucgccgugcucaccggcggggucacccuguucuuccuguccggccgggggcucggcaagaccagcaucggccugcugugcgugauggccuccagcgugcuccuguggauggccuccgucgagccccacuggaucgcggccagcaucauccuggaguucuuccucauggugcugcugauccccgagccggaccgccagcggacgccccaggacaaccagcucgccuacguggucaucgggcugcuguucaugauccucaccguggccgccaacgagaugggccugcuggagaccaccaagaaggaccucgggaucggccacguggcggucgagaaccaccaccacgccgccaugcuggacguggaccugcaccccgccuccgccuggacgcucuacgcgguggccaccaccaucaucaccccgaugaugcgccacacgaucgagaacaccaccgccaacaucagccugaccgccaucgccaaccaggcggccauccugauggggcucgacaagggcuggcccaucuccaagauggacaucggcgucccccugcuggcccucgggugcuacagccaggugaacccccugacgcugaccgccgcggugcucaugcuggucgcccacuacgccaucaucggcccggggcugcaggccaaggccacccgcgaggcgcagaagcggaccgccgccggcaucaugaagaaccccacgguggacgggaucguggccaucgaccucgaccccgucguguacgacgccaaguucgagaagcagcugggccagaucaugcugcucauccugugcaccucccagauccugcucaugcgcaccaccugggcgcugugcgagagcaucacgcuggccaccggcccccucaccacccugugggagggguccccgggcaaguucuggaacacgaccaucgccgugagcauggccaacaucuuccggggguccuaccuggccggcgcgggccucgccuucagccugaugaagucccucgggggcgggcgccgggggaccggggcccagggcgagacccucggcgagaaguggaagcgccagcugaaccagcuguccaagagcgaguucaacacguacaagcgguccgggaucauggaggucgaccgcagcgaggccaaggagggccucaagcgcggggagaccaccaagcacgcggugucccgcggcaccgccaagcugcggugguucguggagcgcaaccuggucaagcccgaggggaaggugaucgaccugggcugcggccgcgggggcuggagcuacuacugcgccgggcucaagaaggugacggaggucaagggcuacaccaagggcggccccggccacgaggagcccaucccgauggccaccuacggguggaaccuggugaagcugcacuccggcaaggacguguucuucaucccgcccgagaagugcgacacccuccugugcgacaucggggagagcucccccaacccgacgaucgaggagggccgcacccugcggguccucaagaugguggagcccuggcugcgcgggaaccaguucugcaucaagauccugaaccccuacaugcccagcguggucgagacccucgagcagaugcagcggaagcacggcggcaugcuggugcgcaacccgcugucccggaacagcacccacgagauguacuggguguccugcgggaccggcaacaucgucagcgccgugaacaugacgucccgcaugcuccugaaccgcuucaccauggcgcaccggaagcccaccuacgagcgcgacguggaccugggggccggcacccggcacgucgccguggagcccgagguggccaaccucgacaucaucggccagcgcaucgagaacaucaagcacgagcacaagagcacguggcacuacgacgaggacaaccccuacaagaccugggccuaccacggguccuacgaggucaagccgagcggcuccgcgagcagcauggugaacggggucgugaagcugcugaccaagcccugggacgugauccccauggucacccagaucgccaugacggacaccacccccuucggccagcagcggguguucaaggagaagguggacacccgcacgccgaaggccaagcgggggaccgcccagaucauggaggucaccgccaaguggcucuggggcuuccugucccgcaacaagaagccccggaucugcacccgcgaggaguucacgcggaaggugcgcagcaacgcggccaucggcgccguguucgucgacgagaaccaguggaacuccgccaaggaggcgguggaggacgagcgguucugggaccuggugcaccgcgagcgggagcuccacaagcaggggaagugcgcgaccugcgucuacaacaugaugggcaagcgcgagaagaagcugggggaguucggcaaggccaaggggagccgggccaucugguacauguggcugggcgcccgcuuccucgaguucgaggcgcugggcuucaugaacgaggaccacugguucucccgggagaacagccuguccgggguggagggcgaggggcuccacaagcugggcuacauccugcgcgacaucagcaagauccccgggggcaacauguacgccgacgacaccgccggcugggacacccggaucacggaggacgaccuccagaacgaggcccgcaucaccgacaucauggagccggagcacgcccugcuggcgaaguccaucuucaagcucaccuaccagaacaaggugguccgcgugcagcggcccgccaagaacgggaccgugauggacgucaucagccgccgggaccagcgcggcuccggccagguggggacguacggccugaacaccuucaccaacauggaggcccagcugauccggcagauggagagcgaggggaucuucucccccagcgagcucgagacccccaaccuggccgagcgcgugcuggacuggcucgagaaguacggcgucgagcggcugaagcgcauggccaucuccggggacgacugcguggugaagccgaucgacgaccgguucgcgacggcccugaccgcccucaacgacaugggcaagguccgcaaggacaucccccagugggagcccagcaagggguggaacgacuggcagcagguccccuucugcucccaccacuuccaccagcugaucaugaaggacggccgggagaucguggucccgugccgcaaccaggacgagcuggugggccgggcccgcgugagccagggggccggcuggagccuccgggagaccgcgugccuggggaaguccuacgcccagauguggcagcugauguacuuccaccgccgggaccuccgccuggccgccaacgcgaucugcagcgccguccccguggacuggauccccaccucccggacgaccuggagcauccacgcccaccaccaguggaugaccaccgaggacaugcuguccguguggaaccgcgucuggaucgaggagaaccccuggauggaggacaagacgcacaucagcuccuggggcgacgugccguaccucgggaagcgcgaggaccaguggugcggcagccugaucggccugaccgcccgggccaccugggcgaccaacauccagguggccaucaaccagguccgccggcucaucgggaacgagaacuaccuggacuacaugaccuccaugaagcgcuucaagaacgagagcgaccccgagggcgcccugugguga

SEQ ID NO: 8323 - RNA, 9879 nt, Artificial Sequence
  derived and/or modified CDS sequence (opt1) from DENV-1__FJ024439__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgagaccgagcccgacgacguggacugcuggugcaacgccacggacaccugggugaccuacgggaccugcagccagacgggcgagcaccggcgcgacaagcgguccguggcccucgcgccccacgugggccuggggcuggagacccgcaccgagaccuggaugagcuccgagggcgccuggaagcagauccagcgggucgagacgugggcccuccgccaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagguggccgagacccagcacggcaccgugcugguccagaucaaguacgagggcaccgacgcgcccugcaagauccccuucagcacgcaggacgagaagggggugacccagaacggccggcugaucaccgccaacccgaucgugaccgacaaggagaagcccgucaacaucgaggccgagccgcccuucggggaguccuacaucaucaucggcgccggcgagaaggcgcugaagcucagcugguucaagaagggguccagcaucggcaagauguucgaggccacggcccgcggggcccggcgcauggccauccugggcgacaccgcgugggacuucggguccaucggcggcguguucaccagcguggggaagcugguccaccagaucuucggcaccgccuacgggguccuguucuccggcgugagcuggacgaugaagaucgggaucggcguccugcugaccuggcucggccugaacucccgcagcaccuccuucagcaugaccugcaucgccguggggcuggugacgcucuaccugggcgucauggugcaggccgacuccgggugcgugaucaacuggaagggccgggagcugaagugcgggagcggcaucuucgucaccaacgaggugcacaccuggaccgagcaguacaaguuccaggccgacagcccgaagcgccucuccgcggccaucggcaaggccugggaggagggggugugcggcauccggagcgccacccgccuggagaacaucauguggaagcagaucuccaacgagcugaaccacauccuccuggagaacgacaugaaguucacggucguggugggggacgucgccggcauccuggcgcaggggaagaagaugauccggccccagcccauggaguacaaguacagcuggaaguccuggggcaaggccaagaucaucggcgccgacgugcagaacaccaccuucaucaucgacgggcccaacaccccggagugccccgacgaccagcgcgccuggaacaucugggagguggaggacuacggcuucgggaucuucacgaccaacaucuggcucaagcugcgggacagcuacacccaggucugcgaccaccgccugauguccgcggccaucaaggacagcaaggccgugcacgccgacaugggcuacuggaucgaguccgagaagaacgagaccuggaagcucgcccgggcgagcuucaucgaggugaagacgugcaucuggcccaagucccacacccuguggagcaacggcguccuggaguccgagaugaucauccccaagaucuacgggggcccgaucagccagcacaacuaccgccccggguacuucacccagaccgccggccccuggcaccucgggaagcuggagcuggacuucgaccucugcgagggcacgaccgugguggucgacgagcacugcggcaaccgggggccgucccugcgcaccaccacggugaccggcaagaucauccacgaguggugcugccggagcugcacccugccgccccugcgcuuccgcggggaggacggcugcugguacgggauggagauccgccccgugaaggagaaggaggagaaccuggucaaguccauggugagcgccggcagcggcgagguggacuccuucagccuggggcuccugugcaucuccaucaugaucgaggaggucaugcggagccgcuggucccggaagaugcugaugaccggcacgcucgccguguucuuccugcugaucauggggcagcucaccuggaacgaccugauccgccugugcaucauggugggcgccaacgcgagcgaccgcauggggaugggcaccaccuaccucgcccugauggccacguucaagaugcggccgauguucgccgucgggcuccucuuccgccggcugaccucccgcgaggugcugcuccugaccaucgggcugagccucguggccuccgucgagcugcccaacagccuggaggagcucggcgacgggcuggcgaugggcaucaugauccugaagcuccugaccgacuuccagucccaccagcugugggccacgcuccugagccugaccuucaucaagaccaccuucucccuccacuacgccuggaagacgauggccauggugcugagcaucgucucccuguucccccucugccugagcaccaccucccagaagaccacguggcugcccgugcuccugggcagccuggggugcaagccgcucaccauguuccugaucgcggagaacaagaucuggggccggcgcuccuggccccugaacgaggggaucauggccgugggcaucgucagcauccuccugagcucccugcucaagaacgacgugccccuggccgggccccugaucgccggcggcaugcucaucgccugcuacgugaucagcggguccagcgcggaccugucccuggagaaggccgccgaggucagcugggaggaggaggccgagcacuccggcgccagccacaacauccucguggaggugcaggacgacgggaccaugaagaucaaggacgaggagcgggacgacacccugaccauccugcucaaggcgacgcugcuggccgucuccggcguguacccgcucagcauccccgccacccuguucgugugguacuucuggcagaagaagaagcagcgcuccgggguccugugggacacccccagcccgcccgaggugggccgggccgugcucgacgacggcaucuaccgcaucaugcagcgggggcugcugggccgcucccaggucggggugggcguguuccaggagaacgucuuccacaccauguggcacgugacgcgcggggccgugcugauguaccagggcaagcgccucgagcccagcugggcguccgucaagaaggaccugaucagcuacggcgggggcuggcggcugcagggguccuggaacaccggcgaggagguccaggugaucgccgucgagcccgggaagaaccccaagaacgugcagaccgcccccggcaccuucaagacgcccgagggcgaggugggggccaucgcccucgacuucaagcccggcaccagcgggucccccaucgucaaccgcgagggcaagaucgugggccuguacgggaacggcguggucaccaccagcgggacguacgugagcgcgaucgcccaggccaaggccucccaggagggcccgcugcccgagaucgaggacgagguguuccggaagcgcaaccucaccaucauggaccugcaccccgggagcggcaagacccggcgcuaccugccggcgaucguccgggaggccaucaagcgcaagcuccgcacccugauccuggcccccacgcgggugguggccuccgagauggccgaggcgcucaagggcaugcccauccgcuaccagaccaccgccgucaagagcgagcacaccgggaaggagaucguggaccugaugugccacgccacguucaccaugcggcugcucucccccgugcgcgucccgaacuacaacaugaucaucauggacgaggcccacuucaccgaccccagcuccaucgccgcgcggggcuacaucagcacccgcguggggaugggcgaggccgccgccaucuucaugacggccacgccgcccggguccguggaggcguucccgcagagcaacgccgucauccaggacgaggagcgggacauccccgagcgcuccuggaacagcggcuacgaguggaucaccgacuuccccggcaagaccgugugguucgugcccuccaucaagagcgggaacgacaucgccaacugccugcggaagaacggcaagcgcgucauccagcugucccggaagacguucgacaccgaguaccagaagaccaagaacaacgacugggacuacguggugaccacggacaucagcgagaugggggccaacuuccgcgcggaccgggucaucgacccgcgccggugccucaagcccgugauccugaaggacggccccgagcgcgugauccuggccgggcccaugccggucaccguggccuccgccgcccagcggcgcggccggaucggccgcaaccacaacaaggagggggaccaguacaucuacaugggccagccccucaacaacgacgaggaccacgcgcacuggaccgaggccaagaugcugcuggacaacaucaacacccccgaggggaucauccccgcccucuucgagccggagcgcgagaaguccgccgccaucgacggcgaguaccggcugcgcggggaggcgcggaagacguucgucgagcugaugcgccggggcgaccuccccguguggcuguccuacaagguggccagcgagggcuuccaguacagcgaccgccgguggugcuucgacggggagcgcaacaaccagguccuggaggagaacauggacguggagaucuggaccaaggagggcgagcggaagaagcuccgcccccgguggcuggacgcccgcaccuacuccgacccccuggcccuccgggaguucaaggaguucgccgcggggcgccggagcguguccggcgaccugauccuggagaucggcaagcucccgcagcaccugacccagcgcgcccagaacgcccuggacaaccucgucaugcugcacaacagcgagcagggcgggcgggccuaccgccaggcgauggaggagcugcccgacacgaucgagacccucaugcugcuggcccucaucgccgugcugaccgggggcgugacccuguucuuccucuccgggcggggccugggcaagaccagcaucgggcugcucugcgucauggccuccagcgugcugcuguggauggccuccguggagccccacuggaucgcggccagcaucauccucgaguucuuccugaugguccugcucauccccgagccggaccgccagcggacgccccaggacaaccagcuggccuacguggugaucggccuccucuucaugauccugaccgucgccgccaacgagauggggcugcucgagaccaccaagaaggaccugggcaucgggcacguggcgguggagaaccaccaccacgccgccaugcuggacgucgaccuccaccccgccuccgccuggacgcuguacgcgguggccaccaccaucaucaccccgaugaugcgccacacgaucgagaacaccaccgccaacaucagccugaccgccaucgccaaccaggcggccauccucaugggccuggacaagggcuggcccaucuccaagauggacaucggggugccccugcucgcccugggcugcuacagccaggucaacccccugacgcucaccgccgcggugcugaugcugguggcccacuacgccaucaucgggccgggccuccaggccaaggccacccgcgaggcgcagaagcggaccgccgccgggaucaugaagaaccccacggucgacggcaucguggccaucgaccuggaccccguggucuacgacgccaaguucgagaagcagcugggccagaucaugcuccugauccugugcaccucccagauccuccugaugcgcaccaccugggcgcugugcgagagcaucacgcucgccaccgggccccugaccacccugugggagggcuccccggggaaguucuggaacacgaccaucgccgugagcauggccaacaucuuccggggcuccuaccucgccggcgcggggcuggccuucagccugaugaagucccucggcgggggccgccgggggaccggcgcccagggcgagacccugggggagaaguggaagcgccagcugaaccagcucuccaagagcgaguucaacacguacaagcgguccggcaucauggagguggaccgcagcgaggccaaggaggggcugaagcggggcgagaccaccaagcacgcggucucccgcgggaccgccaagcugcggugguucguggagcgcaaccucgugaagcccgagggcaaggucaucgaccugggcugcgggcggggcggguggagcuacuacugcgccggccugaagaaggugacggaggugaagggguacaccaagggcggccccgggcacgaggagcccaucccgauggccaccuacggcuggaaccuggucaagcuccacuccgggaaggacguguucuucaucccgcccgagaagugcgacacccugcugugcgacaucggcgagagcucccccaacccgacgaucgaggaggggcgcacccuccgggugcugaagauggucgagcccuggcugcgcggcaaccaguucugcaucaagauccucaaccccuacaugcccagcgugguggagacccuggagcagaugcagcggaagcacggcgggaugcugguccgcaacccgcucucccggaacagcacccacgagauguacuggguguccugcggcaccgggaacaucgugagcgccgucaacaugacgucccgcaugcugcugaaccgcuucaccauggcgcaccggaagcccaccuacgagcgcgacguggaccucggcgccggcacccggcacguggccgucgagcccgagguggccaaccuggacaucaucgggcagcgcaucgagaacaucaagcacgagcacaagagcacguggcacuacgacgaggacaaccccuacaagaccugggccuaccacggcuccuacgaggugaagccgagcggguccgcgagcagcauggucaacggcguggucaagcugcucaccaagcccugggacgugauccccauggugacccagaucgccaugacggacaccacccccuucgggcagcagcgggucuucaaggagaagguggacacccgcacgccgaaggccaagcggggcaccgcccagaucauggaggugaccgccaaguggcuguggggcuuccugucccgcaacaagaagccccggaucugcacccgcgaggaguucacgcggaagguccgcagcaacgcggccaucggggccguguucguggacgagaaccaguggaacuccgccaaggaggcggucgaggacgagcgguucugggaccucgugcaccgcgagcgggagcugcacaagcagggcaagugcgcgaccugcguguacaacaugauggggaagcgcgagaagaagcugggcgaguucgggaaggccaagggcagccgggccaucugguacauguggcucggcgcccgcuuccuggaguucgaggcgcugggguucaugaacgaggaccacugguucucccgggagaacagccucuccggcgucgagggggagggccugcacaagcugggguacauccuccgcgacaucagcaacauccccggcggcaacauguacgccgacgacaccgccgggugggacacccggaucacggaggacgaccugcagaacgaggcccgcaucaccgacaucauggagccggagcacgcccugcucgcgaaguccaucuucaagcugaccuaccagaacaagguggugcgcguccagcggcccgccaagaacggcaccgugauggacgugaucagccgccgggaccagcgcggguccggccaggucggcacguacgggcugaacaccuucaccaacauggaggcccagcucauccggcagauggagagcgagggcaucuucucccccagcgagcuggagacccccaaccuggccgagcgcgugcucgacuggcuggagaaguacgggguggagcggcugaagcgcauggccaucuccggcgacgacugcgucgugaagccgaucgacgaccgguucgcgacggcccucaccgcccugaacgacauggggaaggugcgcaaggacaucccccagugggagcccagcaagggcuggaacgacuggcagcagguccccuucugcucccaccacuuccaccagcugaucaugaaggacggccgggagaucguggugccgugccgcaaccaggacgagcucgucgggcgggcccgcgugagccagggcgccggguggagccugcgggagaccgcgugccugggcaaguccuacgcccagauguggcagcucauguacuuccaccgccgggaccugcgccuggccgccaacgcgaucugcagcgccgugcccgucgacuggauccccaccucccggacgaccuggagcauccacgcccaccaccaguggaugaccaccgaggacaugcucuccguguggaaccgcguguggaucgaggagaaccccuggauggaggacaagacgcacaucagcuccuggggcgacgucccguaccugggcaagcgcgaggaccaguggugcggcagccugaucgggcucaccgcccgggccaccugggcgaccaacauccagguggccaucaaccaggugcgccggcugaucggcaacgagaacuaccuggacuacaugaccuccaugaagcgcuucaagaacgagagcgaccccgagggggcccucugguga

SEQ ID NO: 8324 - RNA, 9879 nt, Artificial Sequence
  derived and/or modified CDS sequence (opt1) from DENV-1__FJ024441__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccgcaucaccgagaccgagcccgacgacguggacugcuggugcaacgccaccgacaccugggugaccuacgggaccugcagccagacgggcgagcaccggcgcgacaagcgguccguggcccucgcgccccacgugggccuggggcuggagacccgcaccgagaccuggaugagcuccgagggcgccuggcggcagauccagcgcgucgagacgugggcccuccggcaccccggguucaccgugaucgcccuguuccuggcccacgcgaucggcaccagcaucacccagaaggggaucaucuucauccuccugaugcuggugacgcccuccauggccaugcgcugcgucggcaucggcagccgggacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcgcaagcucugcaucgaggcgaagaucuccaacaccacgaccgacagccggugcccgacccagggcgaggccacccugguggaggagcaggacgccaacuucgucugccgccggacguucguggaccgcggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccggaccggccucgacuucaacgagaugguccugcugaccaugaaggagaaguccuggcucgugcacaagcagugguuccuggaccugccccuccccuggaccagcggggccagcacgucccaggagaccuggaaccgccaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccggcucaagauggacaagcugacccugaagggcaugagcuacgucaugugcacgggguccuucaagcucgagaaggagguggccgagacccagcacggcaccgugcugguccagaucaaguacgagggcaccgacgcgcccugcaagauccccuucagcacgcaggacgagaagggggugacccagaacggccgccugaucaccgccaacccgaucgugaccgacaaggagaagcccgucaacaucgaggccgagccgcccuucggggaguccuacaucacgaucggcgccggcgagaaggcgcugaagcucagcugguucaagaagggguccagcaucggcaagauguucgaggccaccgcccgcggggcccgccgcauggccauccugggcgacaccgcgugggacuucggguccaucggcggcguguucaccagcguggggaagcugguccaccagaucuucggcacggccuacggggugcuguucuccggcgugagcuggaccaugaagaucgggaucggcguccugcugaccuggcucggccugaacucccggagcaccucccugagcaugacgugcaucgccguggggcucgugacccuguaccugggcgucauggugcaggccgacuccgggugcgugaucaacuggaagggccgcgagcucaagugcgggagcggcaucuucgucaccaacgaggugcacaccuggaccgagcaguacaaguuccaggccgacagcccgaagcggcuguccgcggccaucggcaaggccugggaggagggggugugcggcauccgcagcgccacgcggcuggagaacaucauguggaagcagaucuccaacgagcucaaccacauccugcuggagaacgacaugaaguucaccgucguggugggggacgucgccggcauccucgcgcaggggaagaagaugauccgcccccagcccauggaguacaaguacagcuggaaguccuggggcaaggccaagaucaucggcgccgacgugcagaacaccaccuucaucaucgacgggcccaacacgccggagugccccgacgaccagcgggccuggaacaucugggagguggaggacuacggcuucgggaucuucaccaccaacaucuggcugaagcugcgcgacagcuacacccaggucugcgaccaccggcucauguccgcggccaucaaggacagcaaggccgugcacgccgacaugggcuacuggaucgaguccgagaagaacgagacguggaagcuggcccgcgcgagcuucaucgaggugaagaccugcgucuggcccaagucccacacccuguggagcaacggcgugcucgaguccgagaugaucauccccaagaucuacgggggcccgaucagccagcacaacuaccggcccggguacuucacccagacggccggccccuggcaccuggggaagcuggagcucgacuucgaccugugcgagggcaccaccguggucguggacgagcacugcggcaaccgcgggccgucccugcggaccacgaccgugaccggcaagaucauccacgaguggugcugccgcagcugcacccugccgccccuccgguuccgcggggaggacggcugcugguacgggauggagauccggcccgucaaggagaaggaggagaaccuggugaaguccauggugagcgccggcagcggcgaggucgacuccuucagccucgggcugcugugcaucuccaucaugaucgaggaggugaugcgcagccgguggucccgcaagaugcucaugacgggcacccuggccguguucuuccugcucaucauggggcagcugaccuggaacgaccugauccgccucugcaucauggucggcgccaacgcgagcgaccggauggggaugggcaccacguaccuggcccugauggccaccuucaagaugcgcccgauguucgccgugggccuccuguuccggcgccugaccucccgggaggugcuccugcugaccaucgggcucagccuggucgccuccguggagcugcccaacagccucgaggagcugggcgacgggcuggcgaugggcaucaugauccucaagcugcugacggacuuccagucccaccagcucugggccacccugcugagccucaccuucaucaagaccacguucucccugcacuacgccuggaagaccauggccaugguccugagcaucgugucccucuucccccugugccugagcaccaccucccagaagacgaccuggcuccccgugcugcugggcagccucgggugcaagccgcugaccauguuccugaucgcggagaacaagaucuggggccgccgguccuggccccucaacgaggggaucauggccgucggcaucgugagcauccugcugagcucccuccugaagaacgacgugccccuggccgggccccucaucgccggcggcaugcugaucgccugcuacgucaucagcggguccagcgcggaccugucccucgagaaggccgccgaggugagcugggaggaggaggccgagcacuccggcgccagccacaacauccugguggagguccaggacgacgggaccaugaagaucaaggacgaggagcgcgacgacacccugacgauccuccugaaggcgacccugcucgccguguccggcguguacccgcugagcauccccgccacccuguucgucugguacuucuggcagaagaagaagcagcgguccggggugcucugggacacccccagcccgcccgagguggagcgcgccguccuggacgacggcaucuaccggaucaugcagcgcggccugcuggggcggucccaggugggcgugggggucuuccaggagaacguguuccacacgauguggcacgugacccgcggcgccguccucauguaccaggggaagcggcuggagcccagcugggcguccgugaagaaggaccugaucagcuacggcggcggguggcgccuccagggcuccuggaacaccggggaggaggugcaggucaucgccguggagcccggcaagaaccccaagaacgugcagaccgcccccgggacguucaagacccccgagggcgaggucggcgccaucgcccuggacuucaagcccgggaccagcggcucccccaucgugaaccgggaggggaagaucgugggccuguacggcaacggggucgugaccacgagcggcaccuacgugagcgcgaucgcccaggccaaggccucccaggaggggccgcuccccgagaucgaggacgaggucuuccgcaagcggaaccugaccaucauggaccugcaccccggcagcgggaagacccgccgguaccucccggcgaucgugcgcgaggccaucaagcgcaagcugcggacgcugauccucgcccccacccgcguggucgccuccgagauggccgaggcgcugaagggcaugcccauccgguaccagaccaccgccgucaagagcgagcacacgggcaaggagaucguggaccugaugugccacgccaccuucaccaugcgccuccugucccccguccgggugccgaacuacaacaugaucaucauggacgaggcccacuucaccgaccccagcuccaucgccgcgcgcggguacaucagcacgcgggugggcaugggggaggccgccgccaucuucaugaccgccacgccgcccggcuccgucgaggcguucccgcagagcaacgccgugauccaggacgaggagcgcgacauccccgagcgguccuggaacagcggguacgaguggaucaccgacuuccccggcaagacggugugguucguccccuccaucaagagcggcaacgacaucgccaacugccugcgcaagaacgggaagcgggugauccagcucucccgcaagaccuucgacaccgaguaccagaagaccaagaacaacgacugggacuacguggucacgaccgacaucagcgagaugggcgccaacuuccgggcggaccgcgugaucgacccgcggcgcugccugaagcccgugauccugaaggacgggcccgagcgggucauccucgccggccccaugccggugaccgucgccuccgccgcccagcgccgggggcgcaucggccgcaaccacaacaaggagggcgaccaguacaucuacauggggcagccccugaacaacgacgaggaccacgcgcacuggaccgaggccaagaugcugcucgacaacaucaacacgcccgagggcaucauccccgcccuguucgagccggagcgggagaaguccgccgccaucgacggggaguaccgccugcggggcgaggcgcgcaagaccuucguggagcucaugcggcgcggggaccugcccguguggcuguccuacaaggucgccagcgagggcuuccaguacagcgaccggcgcuggugcuucgacggcgagcggaacaaccaggugcucgaggagaacauggacguggagaucuggaccaaggagggggagcgcaagaagcugcggccccgcuggcuggacgcccggaccuacuccgacccccucgcccugcgcgaguucaaggaguucgccgcgggccggcgcagcgucuccggggaccugauccucgagaucggcaagcugccgcagcaccugacgcagcgggcccagaacgcccucgacaaccuggugaugcugcacaacagcgagcagggcgggcgcgccuaccggcacgcgauggaggagcuccccgacaccaucgagacccugaugcugcucgcccugaucgccgugcugaccggcggggucacccucuucuuccuguccggccgcgggcugggcaagacgagcaucggccuccugugcgugauggccuccagcgugcugcucuggauggccuccgucgagccccacuggaucgcggccagcaucauccuggaguucuuccugauggugcuccugauccccgagccggaccggcagcgcacgccccaggacaaccagcuggccuacguggucaucgggcuccuguucaugauccugaccguggccgccaacgagaugggccuccuggagaccacgaagaaggaccuggggaucggccacguggcggucgagaaccaccaccacgccgccaugcucgacguggaccugcaccccgccuccgccuggacccuguacgcgguggccaccaccaucaucacgccgaugaugcgccacaccaucgagaacaccaccgccaacaucagccucacggccaucgccaaccaggcggccauccugauggggcuggacaagggcuggcccaucuccaagauggacaucggcgucccccuccuggcccuggggugcuacagccaggugaacccccucacccugaccgccgcggugcugaugcucgucgcccacuacgccaucaucggcccggggcugcaggccaaggccacccgggaggcgcagaagcgcacggccgccggcaucaugaagaaccccaccguggacgggaucguggccaucgaccuggaccccgucguguacgacgccaaguucgagaagcagcucggccagaucaugcugcugauccucugcaccucccagauccugcugaugcggaccacgugggcgcucugcgagagcaucacccuggccaccggcccccugaccacgcucugggagggguccccgggcaaguucuggaacaccaccaucgccgugagcauggccaacaucuuccgcggguccuaccuggccggcgcgggccuggccuucagccucaugaagucccucgggggcgggcggcgcgggaccggggcccagggcgagacgcugggcgagaaguggaagcggcagcucaaccagcuguccaagagcgaguucaacaccuacaagcgcuccgggaucauggaggucgaccggagcgaggccaaggagggccugaagcgcggggagaccaccaagcacgcggugucccggggcacggccaagcuccgcugguucguggagcggaaccuggucaagcccgaggggaaggugaucgaccugggcugcggccgcgggggcuggagcuacuacugcgccgggcugaagaaggugaccgaggucaagggcuacaccaagggcgggcccggccacgaggagcccaucccgauggccaccuacggguggaaccucgugaagcugcacuccggcaaggacguguucuucaucccgcccgagaagugcgacacgcugcucugcgacaucggggagagcucccccaacccgaccaucgaggagggccggacccugcgcguccugaagaugguggagcccuggcuccgggggaaccaguucugcaucaagauccugaaccccuacaugcccagcguggucgagacccuggagcagaugcagcgcaagcacggcggcaugcucgugcggaacccgcugucccgcaacagcacccacgagauguacuggguguccugcgggacgggcaacaucgucagcgccgugaacaugaccucccgcaugcugcucaaccgguucaccauggcgcaccgcaagcccaccuacgagcgggacguggaccugggggccggcacgcgccacgucgccguggagcccgagguggccaaccuggacaucaucggccagcggaucgagaacaucaagcacgagcacaagagcaccuggcacuacgacgaggacaaccccuacaagaccugggccuaccacggguccuacgaggucaagccgagcggcuccgcgagcagcauggugaacggggucgugaagcuccugaccaagcccugggacgugauccccauggucacgcagaucgccaugaccgacaccacccccuucggccagcagcgcguguucaaggagaagguggacacgcggaccccgaaggccaagcgcgggaccgcccagaucauggaggucaccgccaaguggcuguggggcuuccucucccggaacaagaagccccgcaucugcacgcgggaggaguucacccgcaaggugcggagcaacgcggccaucggcgccguguucgucgacgagaaccaguggaacuccgccaaggaggcgguggaggacgagcgcuucugggaccuggugcaccgggagcgcgagcugcacaagcaggggaagugcgcgaccugcgucuacaacaugaugggcaagcgggagaagaagcucggggaguucggcaaggccaaggggagccgcgccaucugguacauguggcugggcgcccgguuccuggaguucgaggcgcucggcuucaugaacgaggaccacugguucucccgcgagaacagccuguccgggguggagggcgaggggcugcacaagcucggcuacauccugcgggacaucagcaagauccccgggggcaacauguacgccgacgacaccgccggcugggacacgcgcaucaccgaggacgaccugcagaacgaggcccgcaucaccgacaucauggagccggagcacgcccuccuggcgaaguccaucuucaagcugaccuaccagaacaaggugguccgggugcagcgccccgccaagaacgggacggugauggacgucaucagccggcgcgaccagcggggcuccggccaggugggcaccuacggccucaacaccuucaccaacauggaggcccagcugauccgccagauggagagcgaggggaucuucucccccagcgagcuggagacgcccaaccucgccgagcgggugcuggacuggcuggagaaguacggcgucgagcgccucaagcggauggccaucuccggggacgacugcguggugaagccgaucgacgaccgcuucgcgaccgcccugaccgcccugaacgacaugggcaagguccggaaggacaucccccagugggagcccagcaagggguggaacgacuggcagcagguccccuucugcucccaccacuuccaccagcucaucaugaaggacggccgcgagaucguggucccgugccggaaccaggacgagcuggugggccgcgcccgggugagccagggggccggcuggagccugcgcgagaccgcgugccucgggaaguccuacgcccagauguggcagcugauguacuuccaccggcgcgaccugcggcucgccgccaacgcgaucugcagcgccguccccguggacuggauccccacgucccgcaccaccuggagcauccacgcccaccaccaguggaugaccacggaggacaugcuguccguguggaaccgcgucuggaucgaggagaaccccuggauggaggacaagacccacaucagcuccuggggcgacgugccguaccuggggaagcgggaggaccaguggugcggcagccucaucggccugaccgcccgcgccaccugggcgaccaacauccagguggccaucaaccagguccggcgccugaucgggaacgagaacuaccucgacuacaugacguccaugaagcgguucaagaacgagagcgaccccgagggcgcccugugguga

SEQ ID NO: 8325 - RNA, 9879 nt, Artificial Sequence
  derived and/or modified CDS sequence (opt1) from DENV-1__FJ024442__SS-prME
agcgugaccaugcugcucaugcugaugcccaccgcccuggccuuccaccucaccacccggggcggggagccccacaugaucgugagcaagcaggagcggggcaagagccugcuguucaagaccuccgccggggugaacaugugcacccucaucgccauggaccugggcgagcugugcgaggacaccaugaccuacaagugcccccgcaucaccgagaccgagcccgacgacguggacugcuggugcaacgccacggacaccugggucaccuacgggaccugcagccagacgggcgagcaccggcgcgacaagcgguccguggcccucgcgccccacgugggccuggggcuggagacccgcaccgagaccuggaugagcuccgagggcgcguggaagcagauccagcgggucgagacgugggcccuccgccaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagguggccgagacccagcacggcaccgugcugguccagaucaaguacgagggcaccgacgcgcccugcaagauccccuucagcacgcaggacgagaagggggugacccagaacggccggcugaucaccgccaacccgaucgugaccgacaaggagaagcccgucaacaucgaggccgagccgcccuucggggaguccuacaucaucaucggcgccggcgagaaggcgcugaagcucagcugguucaagaagggguccagcaucggcaagauguucgaggccacggcccgcggggcccggcgcauggccauccugggcgacaccgcgugggacuucggguccaucggcggcguguucaccagcguggggaagcugguccaccagaucuucggcaccgccuacggggugcuguucuccggcgugagcuggacgaugaagaucgggaucggcguccugcugaccuggcucggccugaacucccgcagcaccucccugagcaugaccugcaucgccguggggcucgugacgcuguaccugggcgucauggugcaggccgacuccgggugcgugaucaacuggaagggccgggagcucaagugcgggagcggcaucuucgucaccaacgaggugcacaccuggaccgagcaguacaaguuccaggccgacagcccgaagcgccuguccgcggccaucggcaaggccugggaggagggggugugcggcauccggagcgccacccgccuggagaacaucauguggaagcagaucuccaacgagcucaaccacauccugcuggagaacgacaugaaguucacggucguggugggggacgucgccggcauccucgcgcaggggaagaagaugauccggccccagcccauggaguacaaguacagcuggaaguccuggggcaaggccaagaucaucggcgccgacgugcagaacaccaccuucaucaucgacgggcccaacaccccggagugccccgacgaccagcgcgccuggaacaucugggagguggaggacuacggcuucgggaucuucacgaccaacaucuggcugaagcugcgggacagcuacacccaggucugcgaccaccgccucauguccgcggccaucaaggacagcaaggccgugcacgccgacaugggcuacuggaucgaguccgagaagaacgagaccuggaagcuggcccgggcgagcuucaucgaggugaagacgugcaucuggcccaagucccacacccuguggagcaacggcguccucgaguccgagaugaucauccccaagaucuacgggggcccgaucagccagcacaacuaccgccccggguacuucacccagaccgccggccccuggcaccuggggaagcuggagcucgacuucaaccugugcgagggcacgaccgugguggucgacgagcacugcggcaaccgggggccgucccugcgcaccaccacggugaccggcaagaucauccacgaguggugcugccggagcugcacccugccgccccuccgcuuccgcggggaggacggcugcugguacgggauggagauccgccccgugaaggagaaggaggagaaccuggucaaguccauggugagcgccggcagcggcgagguggacuccuucagccucgggcugcugugcaucuccaucaugaucgaggaggucaugcggagccgcuggucccggaagaugcucaugaccggcacgcuggccguguucuuccugcucaucauggggcagcugaccuggaacgaccugauccgccucugcaucauggugggcgccaacgcgagcgaccgcauggggaugggcaccaccuaccuggcccugauggccacguucaagaugcggccgauguucgccgucggccuccuguuccgccggcugaccucccgcgaggugcuccugcugaccaucgggcucagccugguggccuccgucgagcugcccaacagccucgaggagcugggcgacgggcuggcgaugggcaucaugauccucaagcugcugaccgacuuccagucccaccagcucugggccacgcugcugagccucaccuucaucaagaccaccuucucccugcacuacgccuggaagacgauggccauggugcugagcaucgucucccucuucccccugugccugagcaccaccucccagaagaccacguggcuccccgugcugcugggcagccucgggugcaagccgcugaccauguuccugaucgcggagaacaagaucuggggccggcgcuccuggccccucaacgaggggaucauggccgugggcaucgucagcauccugcugagcucccuccugaagaacgacgugccccuggccgggccccucaucgccggcggcaugcugaucgccugcuacgugaucagcggguccagcgcggaccugucccucgagaaggccgccgaggucagcugggaggaggaggccgagcacuccggcgccagccacaacauccugguggaggugcaggacgacgggaccaugaagaucaaggacgaggagcgggacgacacccugaccauccuccugaaggcgacgcugcucgccgucuccggcguguacccgcugagcauccccgccacccuguucgugugguacuucuggcagaagaagaagcagcgcuccgggguccucugggacacccccagcccgcccgagguggagcgggccgugcuggacgacggcaucuaccgcaucaugcagcggggccugcuggggcgcucccaggucggcguggggguguuccaggagaacgucuuccacaccauguggcacgugacgcggggcgccgugcucauguaccaggggaagcgccuggagcccagcugggcguccgucaagaaggaccugaucagcuacggcggcggguggcggcuccagggcuccuggaacaccggggaggagguccaggugaucgccgucgagcccggcaagaaccccaagaacgugcagaccgcccccgggaccuucaagacgcccgagggcgaggugggcgccaucgcccuggacuucaagcccgggaccagcggcucccccaucgucaaccgcgaggggcggaucgugggccuguacggcaacgggguggucaccaccagcggcacguacgugagcgcgaucgcccaggccaaggccucccaggaggggccgcuccccgagaucgaggacgagguguuccgcaagcggaaccugaccaucauggaccugcaccccggcagcgggaagacccgccgguaccucccggcgaucguccgcgaggccaucaagcgcaagcugcggacccugauccucgcccccacgcgcgugguggccuccgagauggccgaggcgcugaagggcaugcccauccgguaccagaccaccgccgucaagagcgagcacaccggcaaggagaucguggaccugaugugccacgccacguucaccaugcgccuccugucccccgugcgggucccgaacuacaacaugaucaucauggacgaggcccacuucaccgaccccagcuccaucgccgcgcgcggguacaucagcacccgggugggcaugggggaggccgccgccaucuucaugacggccacgccgcccggcuccguggaggcguucccgcagagcaacgccgucauccaggacgaggagcgcgacauccccgagcgguccuggaaccugggguacgaguggaucaccgacuuccccggcaagaccgugugguucgugcccagcaucaaguccggcaacgacaucgccaacugccuccgcaagaacgggaagcgggucauccagcugagccgcaagacguucgacaccgaguaccagaagaccaagaacaacgacugggacuacguggugaccacggacaucuccgagaugggcgccaacuuccgggcggaccgcgucaucgacccgcggcgcugccugaagcccgugauccucaaggacgggcccgagcgggugauccuggccggccccaugccggucaccguggccagcgccgcccagcgccgggggcgcaucggccgcaaccacaacaaggagggcgaccaguacaucuacauggggcagccccugaacaacgacgaggaccacgcgcacuggaccgaggccaagaugcuccuggacaacaucaacacccccgagggcaucauccccgcccuguucgagccggagcgggagaaguccgccgccaucgacggggaguaccgccuccggggcgaggcgcgcaagacguucgucgagcugaugcggcgcggggaccugcccguguggcucagcuacaagguggccuccgagggcuuccaguacagcgaccggcgcuggugcuucgacggcgagcggaacaaccagguccuggaggagaacauggacguggagaucuggaccaaggagggggagcgcaagaagcugcggccccgcuggcucgacgcccggaccuacagcgacccccuggcccugcgcgaguucaaggaguucgccgcgggccggcgcuccgugagcggggaccucauccuggagaucggcaagcugccgcagcaccucacccagcgggcccagaacgcccuggacaaccuggucaugcuccacaacuccgagcagggcgggcgcgccuaccggcacgcgauggaggagcugcccgacacgaucgagacccugaugcuccuggcccugaucgccgugcucaccggcggggugacccuguucuuccugagcggccgcgggcucggcaagaccuccaucggccugcugugcgucauggccagcuccgugcuccuguggauggccagcguggagccccacuggaucgcggccuccaucauccuggaguucuuccucaugguccugcugauccccgagccggaccggcagcgcacgccccaggacaaccagcucgccuacguggugaucgggcugcuguucaugauccucaccgucgccgccaacgagaugggccugcuggagaccaccaagaaggaccucgggaucggccacguggcgguggagaaccaccaccacgccgccaugcuggacgucgaccugcaccccgccagcgccuggacgcucuacgcgguggccaccaccaucaucaccccgaugaugcgccacacgaucgagaacaccaccgccaacaucucccugaccgccaucgccaaccaggcggccauccugauggggcucgacaagggcuggcccaucagcaagauggacaucggcgugccccugcuggcccucgggugcuacucccaggucaacccccugacgcugaccgccgcggugcucaugcugguggcccacuacgccaucaucggcccggggcugcaggccaaggccacccgggaggcgcagaagcgcaccgccgccggcaucaugaagaaccccacggucgacgggaucguggccaucgaccucgaccccguggucuacgacgccaaguucgagaagcagcugggccagaucaugcugcucauccugugcaccagccagauccugcucaugcggaccaccugggcgcugugcgaguccaucacgcuggccaccggcccccucaccacccugugggaggggagcccgggcaaguucuggaacacgaccaucgccguguccauggccaacaucuuccgcgggagcuaccuggccggcgcgggccucgccuucucccugaugaagucccucgggggcgggcggcgcgggaccggggcccagggcgagacccucggcgagaaguggaagcggcagcugaaccagcugagcaaguccgaguucaacacguacaagcgcagcgggaucauggagguggaccgguccgaggccaaggagggccucaagcgcggggagaccaccaagcacgcggucagccggggcaccgccaagcugcgcugguucguggagcggaaccuggugaagcccgaggggaaggucaucgaccugggcugcggccgcgggggcugguccuacuacugcgccgggcucaagaaggugacggaggugaagggcuacaccaagggcgggcccggccacgaggagcccaucccgauggccaccuacggguggaaccuggucaagcugcacagcggcaaggacguguucuucaucccgcccgagaagugcgacacccuccugugcgacaucggggaguccagccccaacccgacgaucgaggagggccggacccugcgcgugcucaagauggucgagcccuggcugcgggggaaccaguucugcaucaagauccugaaccccuacaugcccuccgugguggagacccucgagcagaugcagcgcaagcacggcggcaugcugguccggaacccgcugagccgcaacuccacccacgagauguacugggugagcugcgggaccggcaacaucguguccgccgucaacaugacgagccgcaugcuccugaaccgguucaccauggcgcaccgcaagcccaccuacgagcgggacguggaccugggggccggcacccgccacguggccgucgagcccgagguggccaaccucgacaucaucggccagcggaucgagaacaucaagcacgagcacaaguccacguggcacuacgacgaggacaaccccuacaagaccugggccuaccacgggagcuacgaggugaagccguccggcagcgcguccagcauggucaacgggguggucaagcugcugaccaagcccugggacgugauccccauggugacccagaucgccaugacggacaccacccccuucggccagcagcgcgucuucaaggagaagguggacacccggacgccgaaggccaagcgcgggaccgcccagaucauggaggugaccgccaaguggcucuggggcuuccugagccggaacaagaagccccgcaucugcacccgggaggaguucacgcgcaagguccgguccaacgcggccaucggcgccguguucguggacgagaaccaguggaacagcgccaaggaggcggucgaggacgagcgcuucugggaccuggugcaccgggagcgcgagcuccacaagcaggggaagugcgcgaccugcguguacaacaugaugggcaagcgggagaagaagcugggggaguucggcaaggccaaggggucccgcgccaucugguacauguggcugggcgcccgguuccucgaguucgaggcgcugggcuucaugaacgaggaccacugguucagccgcgagaacucccugagcggggucgagggcgaggggcuccacaagcugggcuacauccugcgggacaucuccaagauccccgggggcaacauguacgccgacgacaccgccggcugggacacccgcaucacggaggacgaccuccagaacgaggcccgcaucaccgacaucauggagccggagcacgcccugcuggccaagagcaucuucaagcucaccuaccagaacaagguggugcggguccagcgccccgccaagaacgggaccgugauggacgugaucucccggcgcgaccagcggggcagcgggcaggucggcacguacggccugaacaccuucaccaacauggaggcccagcugauccgccagauggaguccgaggggaucuucagccccuccgagcucgagacccccaaccuggccgagcgggugcuggacuggcucgagaaguacggcguggagcgccugaagcggauggccaucagcggggacgacugcgucgugaagccgaucgacgaccgcuucgcgacggcccugaccgcccucaacgacaugggcaaggugcggaaggacaucccccagugggagcccuccaagggguggaacgacuggcagcagguccccuucugcagccaccacuuccaccagcugaucaugaaggacggccgcgagaucguggugccgugccggaaccaggacgagcuggucggccgcgcccgggugucccagggggccggcuggagccuccgcgagaccgcgugccugggcaagagcuacgcccagauguggcagcugauguacuuccaccggcgcgaccuccggcuggccgccaacgcgaucugcuccgccgugcccgucgacuggauccccaccagccgcacgaccugguccauccacgcccaccaccaguggaugaccaccgaggacaugcugagcguguggaaccgcguguggaucgaggagaaccccuggauggaggacaagacgcacaucuccagcuggggcgacgucccguaccucgggaagcgggaggaccaguggugcggcucccugaucggccugaccgcccgcgccaccugggcgaccaacauccagguggccaucaaccaggugcggcgccucaucgggaacgagaacuaccuggacuacaugaccagcaugaagcgguucaagaacgagggcgaccccgagggggcccugugguga

SEQ ID NO: 8326 - RNA, 9879 nt, Artificial Sequence
  derived and/or modified CDS sequence (opt1) from DENV-1__FJ373296__SS-prME
agcgugaccaugcugcucaugcugaugcccaucgcccuggccuuccaccucaccacccgcggcggggagccccacaugaucgugagcaagcaggagcggggcaagagccugcuguucaagaccagcgcgggggugaacaugugcacccucaucgccauggaccugggcgagcugugcgaggacaccaugaccuacaagugcccccgcaucaccgaggccgagcccgacgacguggacugcuggugcaacgccaccgacaccugggugacguacgggaccugcagccagaccggcgagcaccggcgcgacaagcgguccguggcccucgcgccccacgugggccuggggcuggagacccgcacggagaccuggaugagcuccgagggcgccuggaagcagauccagcggguggagaccugggcccuccgccaccccggguucaccgugaucgcccuguuccuggcgcacgccaucggcacgagcaucacccagaaggggaucaucuucauccuccugaugcuggugacccccuccauggccaugcggugcgucggcaucggcagccgcgacuucguggaggggcucuccggcgccaccuggguggacgucgugcuggagcacgggagcugcgugacgaccauggccaaggacaagcccacccuggacaucgagcuccugaagaccgaggucacgaaccccgcggugcugcggaagcucugcaucgaggccaagaucuccaacaccaccaccgacagccgcugcccgacgcagggcgaggccacccugguggaggagcaggacgccaacuucgucugccggcgcaccuucguggaccggggcugggggaacggcugcgggcuguucggcaaggggucccucaucacgugcgccaaguucaagugcgugacgaagcuggagggcaagaucguccaguacgagaaccugaaguacagcgugaucgugaccguccacaccggcgaccagcaccagguggggaacgaguccaccgagcacggcacgaccgcgaccaucacgccccaggcccccaccacggagauccagcucaccgacuacggggcccugacccuggacugcagcccccgcaccggccucgacuucaacgagaugguccugcugacgaugaaggagaaguccuggcucgugcacaagcagugguuccuggaccugccccuccccuggaccagcggggccagcaccucccaggagaccuggaaccggcaggaccugcuggugacguucaagaccgcccacgcgaagaagcaggaggucguggugcucggcagccaggagggcgccaugcacaccgcccugaccggggccacggagauccagaccuccggcaccaccacgaucuucgccgggcaccugaagugccgccucaagauggacaagcugacccugaagggcaugagcuacgucaugugcaccggguccuucaagcucgagaaggagguggcggagacccagcacggcacggugcugguccagaucaaguacgagggcaccgacgcccccugcaagauccccuucagcacccaggacgagaagggggccacccagaacggccggcugaucacggccaacccgaucgugaccgacaaggagaagcccgugaacaucgaggcggagccgcccuucggggaguccuacaucgucaucggcgccggcgagaaggcccugaagcucagcugguucaagaagggguccagcaucggcaagauguucgaggccaccgcccgcggggcgcggcgcauggccauccugggcgacaccgccugggacuucggguccaucggcggcguguucacgagcguggggaagcugguccaccagaucuucggcaccgccuacgggguccucuucuccggcgugagcuggaccaugaagaucgggaucggcguccugcugaccuggcucggccugaacucccgcagcacgucccugagcaugaccugcaucgccguggggcucgugacccuguaccugggcgucauggugcaggcggacuccgggugcgugaucaacuggaagggccgggagcucaagugcgggagcggcaucuucgucaccaacgaggugcacacguggaccgagcaguacaaguuccaggccgacagcccgaagcgccuguccgccgccaucggcaaggccugggaggagggggugugcggcauccggagcgcgacccgccuggagaacaucauguggaagcagaucuccaacgagcucaaccacauccugcuggagaacgacaugaagcucaccgucguggugggggacgucgccggcauccuggggcagggcaagaagaugauccggccccagcccauggaguacaaguacagcuggaaguccuggggcaaggccaagaucaucggggccgacgcgcagaacaccacguucaucaucgacggccccaacaccccggagugccccgacgaccagcgcgccuggaacaucugggagguggaggacuacggguucggcaucuucaccaccaacaucuggcugaagcuccgggacagcuacacccaggugugcgaccaccgccugauguccgccgccaucaaggacagcaaggccguccacgcggacaugggcuacuggaucgaguccgagaagaacgagaccuggaagcuggcccgggccagcuucaucgaggugaagaccugcaucuggcccaagucccacacccucuggagcaacggggugcuggaguccgagaugaucauccccaagaucuacggcgggccgaucagccagcacaacuaccgccccggcuacuucacgcagaccgccgggcccuggcaccugggcaagcucgagcuggacuucgaccugugcgagggcaccaccgucgugguggacgagcacugcgggaaccggggcccgucccuccgcacgaccaccgucaccgggaagaucauccacgaguggugcugccggagcugcacgcugccgccccugcgcuuccggggcgaggacgggugcugguacggcauggagauccgccccgugaaggagaaggaggagaaccucgugaaguccauggucagcgccggcagcggggagguggacuccuucagccugggccugcucugcaucuccaucaugaucgaggaggugaugcggagccgcuggucccggaagaugcugaugaccgggacccuggcggucuucuuccuccugaucaugggccagcugaccuggaacgaccucauccgccugugcaucauggugggggccaacgccagcgaccgcaugggcaugggcacgaccuaccuggcccucauggccaccuucaagaugcggccgauguucgcgguggggcugcuguuccgccggcucaccucccgcgagguccugcugcucacgaucggccugagccugguggccuccguggagcuccccaacagccuggaggagcugggggacggccucgccaugggcaucaugauccugaagcugcucaccgacuuccagucccaccagcugugggccacccugcucagccugaccuucaucaagacgaccuucucccugcacuacgcguggaagaccauggccaugguccucagcaucgugucccuguucccccugugccucagcaccacgucccagaagaccaccuggcugcccguccugcucgggagccugggcugcaagccgcugaccauguuccucaucgccgagaacaagaucugggggcggaaguccuggccccugaacgagggcaucauggccguggggaucgugagcauccugcucagcucccugcugaagaacgacgucccccucgccggcccccugaucgcgggcgggaugcugaucgccugcuacgugaucagcggcuccagcgccgaccucucccuggagaaggccgccgaggugagcugggaggaggaggcggagcacuccggggccagccacaacauccuggucgaggugcaggacgacggcacgaugaagaucaaggacgaggagcgcgacgacacccucaccauccugcugaaggccacccuccuggccguguccggggucuacccgcugagcauccccgccacccucuucgugugguacuucuggcagaagaagaagcagcgguccggcgugcugugggacacgcccagcccgcccgaggucgagcgcgcggugcuggacgacggcaucuaccggaucaugcagcgcgggcugcucggccggucccaggugggggucggcguguuccaggagaacguguuccacaccauguggcacgucacccgcggggccgugcugauguaccagggcaagcggcuggagcccagcugggccuccgugaagaaggaccucaucagcuacggcgggggcuggcgccugcggggguccuggaacaccggcgaggagguccaggugaucgccguggagcccgggaagaaccccaagaacguccagacggcccccggcaccuucaagacccccgagggcgaggugggggcgaucgcccuggacuucaagcccggcaccagcgggucccccaucgugaaccgcgagggcaagaucgucggccucuacgggaacggcguggugacgaccagcgggaccuacgucagcgccaucgcccaggcgaaggccucccaggagggcccgcugcccgagaucgaggacgagguguuccggaagcgcaaccugaccaucauggaccuccaccccgggagcggcaagacgcggcgcuaccugccggccaucgugcgggaggccaucaagcgcaagcugcgcacccucauccuggcccccacccgggucguggcguccgagauggccgaggcccugaagggcaugcccauccgcuaccagaccacggccgucaagagcgagcacaccgggaaggagaucgucgaccucaugugccacgccaccuucaccaugcggcugcugucccccgugcgcgugccgaacuacaacaugaucaucauggacgaggcgcacuucacggaccccagcuccaucgccgcccggggcuacaucagcacccgcgucgggaugggcgaggccgccgcgaucuucaugaccgccacgccgcccggguccguggaggccuucccgcagagcaacgccgugauccaggacgaggagcgggacauccccgagcgcuccuggaacagcggcuacgaguggaucacggacuuccccggcaagaccgucugguucgugcccuccaucaagagcgggaacgacaucgcgaacugccuccggaagaacggcaagcgcgugauccagcugucccggaagaccuucgacaccgaguaccagaagacgaagaacaacgacugggacuacgucgugaccaccgacaucagcgagaugggggccaacuuccgcgccgaccgggugaucgacccgcgccggugccugaagcccgucauccucaaggacggccccgagcgcgugauccuggccgggcccaugccggugaccgucgccuccgcggcccagcggcgcggccggaucggccgcaaccacaacaaggagggggaccaguacaucuacaugggccagccccugaacaacgacgaggaccacgcccacuggacggaggccaagaugcuccuggacaacaucaacacccccgaggggaucauccccgcccuguucgagccggagcgcgagaaguccgcggccguggacggcgaguaccggcuccgcggggaggcccggaagaccuucgucgagcugaugcgccggggcgaccugcccguguggcucuccuacaagguggccagcgagggcuuccaguacagcgaccgccgguggugcuucgacggggagcgcaacaaccagguccuggaggagaacauggacguggagaucuggaccaaggagggcgagcggaagaagcugcgcccccgguggcucgacgcccgcacguacuccgacccccuggcgcugcgggaguucaaggaguucgccgccgggcgccggagcguguccggcgaccucauccuggagaucggcaagcugccgcagcaccucacccagcgcgcccagaacgcgcuggacaaccuggucaugcuccacaacagcgagcagggcgggcgggccuaccgccacgccauggaggagcugcccgacaccaucgagacccugaugcuccuggcccugaucgccgugcucaccgggggcgugacccuguucuuccuguccgggcggggccucggcaagaccagcaucgggcugcugugcgucauggcguccagcgugcuccuguggauggccuccguggagccccacuggaucgccgccagcaucauccuggaguucuuccucaugguccugcugauccccgagccggaccgccagcggacgccccaggacaaccagcucgccuacguggugaucggccugcuguucaugauccucaccgucgcggccaacgagauggggcugcuggagacgaccaagaaggaccucggcaucgggcacguggccguggagaaccaccaccacgccgccaugcuggacgucgaccugcaccccgcguccgccuggacccucuacgccguggccaccacgaucaucaccccgaugaugcgccacaccaucgagaacaccacggccaacaucagccugaccgcgaucgccaaccaggccgccauccugaugggccucgacaagggcuggcccaucuccaagauggacaucggggugccccugcuggcgcucggcugcuacagccaggucaacccccugacccugaccgccgccgugcucaugcugguggcccacuacgccaucaucgggccgggccugcaggcgaaggccacgcgcgaggcccagaagcggaccgccgccgggaucaugaagaaccccaccgucgacggcaucguggcgaucgaccucgaccccguggucuacgacgccaaguucgagaagcagcugggccagaucaugcugcucauccugugcaccucccagauccugcucaugcgcacgaccugggcccugugcgagagcaucacccuggccaccgggccccucacgacccugugggagggcuccccggggaaguucuggaacaccaccaucgccgugagcauggcgaacaucuuccggggcuccuaccuggccggcgccgggcucgccuucagccugaugaagucccugggcgggggccgccgggggacgggcgcgcagggcgagacccucggggagaaguggaagcgccagcugaaccagcuguccaagagcgaguucaacaccuacaagcgguccggcaucauggagguggaccgcagcgaggccaaggaggggcucaagcggggcgagaccacgaagcacgccgucucccgcgggaccgccaagcugcggugguucguggagcgcaaccuggugaagcccgagggcaaggucaucgaccugggcugcgggcggggcggguggagcuacuacugcgccggccucaagaaggugaccgaggugaagggguacaccaagggcggccccgggcacgaggagcccaucccgauggcgacguacggcuggaaccuggucaagcugcacuccgggaaggacguguucuucaucccgcccgagaagugcgacacccuccugugcgacaucggcgagagcucccccaacccgaccaucgaggaggggcgcacccugcgggugcucaagauggucgagcccuggcugcgcggcaaccaguucugcaucaagauccugaaccccuacaugcccagcgugguggagacgcucgagcagaugcagcggaagcacggcgggaugcugguccgcaacccgcugucccggaacagcacccacgagauguacuggguguccugcggcaccgggaacaucgugagcgccgucaacaugaccucccgcaugcuccugaaccgcuucaccauggcccaccggaagcccacguacgagcgcgacguggaccugggcaccggcacccggcacguggccgucgagcccgagguggccaaccucgacaucaucgggcagcgcaucgagaacaucaagcacgagcacaagagcaccuggcacuacgacgaggacaaccccuacaagacgugggcguaccacggcuccuacgaggugaagccgagcggguccgccagcagcauggucaacggcguggucaagcugcugaccaagcccugggacgugauccccauggugacccagaucgccaugaccgacacgacccccuucgggcagcagcgggucuucaaggagaagguggacacccgcaccccgaaggccaagcggggcacggcccagaucauggaggugaccgcgcgcuggcucuggggcuuccugucccggaacaagaagccccgcaucugcacccgggaggaguucacccgcaagguccggagcaacgccgccaucggggccguguucguggacgagaaccaguggaacuccgcgaaggaggccgucgaggacgagcgcuucugggaccuggugcaccgggagcgcgagcuccacaagcagggcaagugcgccacgugcguguacaacaugauggggaagcgggagaagaagcugggcgaguucgggaaggccaagggcagccgcgccaucugguacauguggcugggcgcgcgguuccucgaguucgaggcccugggguucaugaacgaggaccacugguucucccgcgagaacagccuguccggcgucgagggggagggccuccacaagcugggguacauccugcgggacaucagcaagauccccggcggcaacauguacgccgacgacaccgccgggugggacacccgcaucaccgaggacgaccuccagaacgaggccaagaucacggacaucauggagccggagcacgcgcugcuggccaaggccaucuucaagcucaccuaccagaacaagguggugcgcguccagcggcccgccaagaacggcaccgugauggacgugaucucccgccgggaccagcgcgggagcggccaggucggcaccuacgggcugaacacguucaccaacauggaggcccagcugauccggcagauggaguccgagggcaucuucagccccuccgagcucgagacccccaaccuggcggagcgcgcccuggacuggcucgagaaguacgggguggagcggcugaagcgcauggccaucagcggcgacgacugcguggucaagccgaucgacgaccgguucgccaccgcccugacggcgcucaacgacauggggaaggugcgcaaggacaucccccagugggagcccuccaagggcuggaacgacuggcagcagguccccuucugcagccaccacuuccaccagcugaucaugaaggacggccgggagaucgucgugccgugccgcaaccaggacgagcugguggggcgggcccgcgucucccagggcgccggguggagccuccgggagaccgccugccugggcaagagcuacgcgcagauguggcagcugauguacuuccaccgccgggaccuccgccuggccgccaacgccaucugcuccgccgugcccguggacuggguccccaccagccggaccacgugguccauccacgcgcaccaccaguggaugaccaccgaggacaugcugagcguguggaaccgcguguggaucgaggagaaccccuggauggaggacaagacccacaucuccagcugggaggacgucccguaccucgggaagcgcgaggaccaguggugcggcucccugaucggccugacggcccgggccaccugggccaccaacauccagguggccaucaaccaggugcgccggcucaucgggaacgagaacuaccuggacuacaugaccagcaugaagcgcuucaagaacgaguccgaccccgagggcgcgcugugguga

SEQ ID NO: 8327 - RNA, 9879 nt, Artificial Sequence
  derived and/or modified CDS sequence (opt1) from DENV-1__FJ182018__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgagaccgagcccgacgacguggacugcuggugcaacgccacggacaccugggugaccuacgggaccugcagccagacgggcgagcaccggcgggacaagcgguccguggcccucgcgccccacgugggccuggggcuggagacccgcaccgagaccuggaugagcuccgagggcgccuggaagcagauccagcgggucgagacgugggcccuccggcaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagguggccgagacccagcacggcaccgugcugguccagaucaaguacgagggcaccgacgcgcccugcaagauccccuucagcacgcaggacgagaagggggugacccagaacggccggcugaucaccgccaacccgaucgugaccgacaaggagaagcccgucaacaucgaggccgagccgcccuucggggaguccuacaucaucaucggcgccggcgagaaggcgcugaagcucagcugguucaagaagggguccagcaucggcaagauguucgaggccacggcccgcggggcccggcgcauggccauccugggcgacaccgcgugggacuucggguccaucggcggcguguucaccagcguggggaagcugguccaccagaucuucggcaccgccuacggggugcuguucuccggcgugagcuggacgaugaagaucgggaucggcguccugcugaccuggcucggccugaacucccgcagcaccucccugagcaugaccugcaucgccguggggcucgugacgcuguaccugggcgucauggugcaggccgacuccgggugcgugaucaacuggaagggccgggagcucaagugcgggagcggcaucuucgucaccaacgaggugcacaccuggaccgagcaguacaaguuccaggccgacagcccgaagcgccuguccgcggccaucggcaaggccugggaggagggggugugcggcauccggagcgccacccgccuggagaacaucauguggaagcagaucuccaacgagcucaaccacauccugcuggagaacgacaugaaguucacggucguggugggggacgucgccggcauccucgcgcaggggaagaagaugauccggccccagcccauggaguacaaguacagcuggaaguccuggggcaaggccaagaucaucggcgccgacgugcagaacaccaccuucaucaucgacgggcccaacaccccggagugccccgacgaccagcgcgccuggaacaucugggagguggaggacuacggcuucgggaucuucacgaccaacaucuggcugaagcugcgggacagccacacccaggucugcgaccaccgccucauguccgcggccaucaaggacagcaaggccgugcacgccgacaugggcuacuggaucgaguccgagaagaacgagaccuggaagcuggcccgggcgagcuucaucgaggugaagacgugcaucuggcccaagucccacacccuguggagcaacggcguccucgaguccgagaugaucauccccaagaucuacgggggcccgaucagccagcacaacuaccgccccggguacuucacccagaccgccggccccuggcaccuggggaagcuggagcucgacuucgaccugugcgagggcacgaccgugguggucgacgagcacugcggcaaccgggggccgucccugcgcaccaccacggugaccggcaagaucauccacgaguggugcugccggagcugcacccugccgccccuccgcuuccgcggggaggacggcugcugguacgggauggagauccgccccgugaaggagaaggaggagaaccuggucaaguccauggugagcgccggcagcggcgagguggacuccuucagccucgggcugcugugcaucuccaucaugaucgaggaggucaugcggagccgcuggucccggaagaugcucaugaccggcacgcuggccguguucuuccugcucaucauggggcagcugaccuggaacgaccugauccgccucugcaucauggugggcgccaacgcgagcgaccgcauggggaugggcaccaccuaccuggcccugauggccacguucaagaugcggccgauguucgccgucggccuccuguuccgccggcugaccucccgcgaggugcuccugcugaccaucgggcucagccugguggccuccgucgagcugcccaacagccucgaggagcugggcgacgggcuggcgaugggcaucaugauccucaagcugcugaccgacuuccagucccaccagcucugggccacgcugcugagccucaccuucaucaagaccaccuucucccugcacuacgccuggaagacgauggccauggugcugagcaucgucucccucuucccccugugccugagcaccaccucccagaagaccacguggcuccccgugcugcugggcagccucgggugcaagccgcugaccauguuccugaucgcggagaacaagaucuggggccggcgcuccuggccccucaacgaggggaucauggccgugggcaucgucagcauccugcugagcucccuccugaagaacgacgugccccuggccgggccccucaucgccggcggcaugcugaucgccugcuacgugaucagcggguccagcgcggaccugucccucgagaaggccgccgaggucagcugggaggaggaggccgagcacuccggcgccagccacaacauccugguggaggugcaggacgacgggaccaugaagaucaaggacgaggagcgggacgacacccugaccauccuccugaaggcgacgcugcucgccgucuccggcguguacccgcugagcauccccgccacccuguucgugugguacuucuggcagaagaagaagcagcgcuccgggguccucugggacacccccagcccgcccgagguggagcgggccgugcuggacgacggcaucuaccgcaucaugcagcggggccugcuggggcgcucccaggucggcguggggguguuccaggagaacgucuuccacaccauguggcacgugacgcggggcgccgugcucauguaccaggggaagcgccuggagcccagcugggcguccgucaagaaggaccugaucagcuacggcggcggguggcggcuccagggcuccuggaacaccggggaggagguccaggugaucgccgucgagcccggcaagaaccccaagaacgugcagaccgcccccgggaccuucaagacgcccgagggcgaggugggcgccaucgcccuggacuucaagcccgggaccagcggcucccccaucgucaaccgcgaggggaagaucgugggccuguacggcaacgggguggucaccaccagcggcacguacgugagcgcgaucgcccaggccaaggccucccaggaggggccgcuccccgagaucgaggacgagguguuccggaagcgcaaccugaccaucauggaccugcaccccggcagcgggaagacccggcgcuaccucccggcgaucguccgggaggccaucaagcgcaagcugcgcacccugauccucgcccccacgcgggugguggccuccgagauggccgaggcgcugaagggcaugcccauccgcuaccagaccaccgccgucaagagcgagcacaccggcaaggagaucguggaccugaugugccacgccacguucaccaugcggcuccugucccccgugcgcgucccgaacuacaacaugaucaucauggacgaggcccacuucaccgaccccagcuccaucgccgcgcggggguacaucagcacccgcgugggcaugggggaggccgccgccaucuucaugacggccacgccgcccggcuccguggaggcguucccgcagagcaacgccaucauccaggacgaggagcgggacauccccgagcgcuccuggaacagcggguacgaguggaucaccgacuuccccggcaagaccgucugguucgugcccuccaucaagagcggcaacgacaucgccaacugccugcggaagaacgggaagcgcgugauccagcucucccggaagacguucgacaccgaguaccagaagaccaagaacaacgacugggacuacgucgugaccacggacaucagcgagaugggcgccaacuuccgcgcggaccgggugaucgacccgcgccggugccugaagcccgucauccugaaggacgggcccgagcgcgugauccucgccggccccaugccggugaccgucgccuccgccgcccagcggcgcgggcggaucggccgcaaccacaacaaggagggcgaccaguacaucuacauggggcagccccugaacaacgacgaggaccacgcgcacuggaccgaggccaagaugcugcucgacaacaucaacacccccgagggcaucauccccgcccuguucgagccggagcgcgagaaguccgccgccaucgacggggaguaccggcugcgcggcgaggcgcggaagacguucguggagcucaugcgccgcggggaccugcccgucuggcuguccuacaagguggccagcgagggcuuccaguacagcgaccgccgguggugcuucgacggcgagcgcaacaaccaggugcucgaggagaacauggacgucgagaucuggaccaaggagggggagcggaagaagcugcgcccccgguggcuggacgcccgcaccuacuccgacccccucgcccugcgggaguucaaggaguucgccgcgggccgccggagcguguccggggaccugauccucgagaucggcaagcugccgcagcaccugacccagcgcgcccagaacgcccucgacaaccuggugaugcugcacaacagcgagcagggcgggcgggccuaccgccacgcgauggaggagcuccccgacacgaucgagacccugaugcugcucgcccugaucgccguccugaccggcggggugacccucuucuuccuguccggccgggggcugggcaagaccagcaucggccuccugugcgugauggccuccagcguccugcucuggauggccuccguggagccccacuggaucgcggccagcaucauccuggaguucuuccugauggugcuccugauccccgagccggaccgccagcggacgccccaggacaaccagcuggccuacgucgugaucgggcuccuguucaugauccugaccguggccgccaacgagaugggccuccuggagaccaccaagaaggaccuggggaucggccacgucgcgguggagaaccaccaccacgccgccaugcucgacguggaccugcaccccgccuccgccuggacgcuguacgcggucgccaccaccaucaucaccccgaugaugcgccacacgaucgagaacaccaccgccaacaucagccucaccgccaucgccaaccaggcggccauccugauggggcuggacaagggcuggcccaucuccaagauggacaucggcgugccccuccuggcccuggggugcuacagccaggugaacccccucacgcugaccgccgcgguccugaugcucguggcccacuacgccaucaucggcccggggcugcaggccaaggccacccgcgaggcgcagaagcggaccgccgccggcaucaugaagaaccccacgguggacgggaucgucgccaucgaccuggaccccgugguguacgacgccaaguucgagaagcagcucggccagaucaugcugcugauccucugcaccucccagauccugcugaugcgcaccaccugggcgcucugcgagagcaucacgcuggccaccggcccccugaccacccucugggagggguccccgggcaaguucuggaacacgaccaucgccgucagcauggccaacaucuuccggggguccuaccuggccggcgcgggccuggccuucagccucaugaagucccucgggggcgggcgccgggggaccggggcccagggcgagacccugggcgagaaguggaagcgccagcucaaccagcuguccaagagcgaguucaacacguacaagcgguccgggaucauggagguggaccgcagcgaggccaaggagggccugaagcgcggggagaccaccaagcacgcggugucccgcggcaccgccaagcuccggugguucgucgagcgcaaccuggugaagcccgaggggaaggugaucgaccugggcugcggccgcgggggcuggagcuacuacugcgccgggcugaagaaggucacggaggugaagggcuacaccaagggcggccccggccacgaggagcccaucccgauggccaccuacggguggaaccucgugaagcugcacuccggcaaggacgucuucuucaucccgcccgagaagugcgacacccugcucugcgacaucggggagagcucccccaacccgacgaucgaggagggccgcacccugcgggugcugaagaugguggagcccuggcuccgcgggaaccaguucugcaucaagauccugaaccccuacaugcccagcgucguggagacccuggagcagaugcagcggaagcacggcggcaugcucgugcgcaacccgcugucccggaacagcacccacgagauguacugggucuccugcgggaccggcaacaucgugagcgccgugaacaugacgucccgcaugcugcucaaccgcuucaccauggcgcaccggaagcccaccuacgagcgcgacgucgaccugggggccggcacccggcacguggccguggagcccgaggucgccaaccuggacaucaucggccagcgcaucgagaacaucaagcacgagcacaagagcacguggcacuacgacgaggacaaccccuacaagaccugggccuaccacggguccuacgaggugaagccgagcggcuccgcgagcagcauggugaacggggucgugaagcuccugaccaagcccugggacgucauccccauggugacccagaucgccaugacggacaccacccccuucggccagcagcggguguucaaggagaaggucgacacccgcacgccgaaggccaagcgggggaccgcccagaucauggaggugaccgccaaguggcuguggggcuuccucucccgcaacaagaagccccggaucugcacccgcgaggaguucacgcggaaggugcgcagcaacgcggccaucggcgccgucuucguggacgagaaccaguggaacuccgccaaggaggcgguggaggacgagcgguucugggaccugguccaccgcgagcgggagcugcacaagcaggggaagugcgcgaccugcguguacaacaugaugggcaagcgcgagaagaagcucggggaguucggcaaggccaaggggagccgggccaucugguacauguggcugggcgcccgcuuccuggaguucgaggcgcucggcuucaugaacgaggaccacugguucucccgggagaacagccuguccgggguggagggcgaggggcugcacaagcucggcuacauccugcgcgacaucagcaagauccccgggggcaacauguacgccgacgacaccgccggcugggacacccggaucacggaggacgaccugcagaacgaggcccgcaucaccgacaucauggagccggagcacgcccuccuggcgaaguccaucuucaagcugaccuaccagaacaaggucgugcgcgugcagcggcccgccaagaacgggaccgucauggacgugaucagccgccgggaccagcgcggcuccggccagguggggacguacggccucaacaccuucaccaacauggaggcccagcugauccggcagauggagagcgaggggaucuucucccccagcgagcuggagacccccaaccucgccgagcgcguccuggacuggcuggagaaguacggcguggagcggcucaagcgcauggccaucuccggggacgacugcguggucaagccgaucgacgaccgguucgcgacggcccugaccgcccugaacgacaugggcaaggugcgcaaggacaucccccagugggagcccagcaagggguggaacgacuggcagcagguccccuucugcucccaccacuuccaccagcucaucaugaaggacggccgggagaucgucgugccgugccgcaaccaggacgagcuggugggccgggcccgcgucagccagggggccggcuggagccugcgggagaccgcgugccucgggaaguccuacgcccagauguggcagcugauguacuuccaccgccgggaccugcgccucgccgccaacgcgaucugcagcgccgugcccguggacuggauccccaccucccggacgaccuggagcauccacgcccaccaccaguggaugaccaccgaggacaugcuguccgucuggaaccgcguguggaucgaggagaaccccuggauggaggacaagacgcacaucagcuccuggggcgacgugccguaccuggggaagcgcgaggaccaguggugcggcagccucaucggccugaccgcccgggccaccugggcgaccaacauccaggucgccaucaaccaggugcgccggcugaucgggaacgagaacuaccucgacuacaugaccuccaugaagcgcuucaagaacgagggcgaccccgagggggcccugugguga

SEQ ID NO: 8328 - RNA, 9879 nt, Artificial Sequence
  derived and/or modified CDS sequence (opt1) from DENV-1__FJ410287__SS-prME
agcgugaccaugcugcugaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgagaccgagcccgacgacguggacugcuggugcaacgccacggacaccugggucaccuacgggaccugcagccagacgggcgagcaccggcgcgacaagcggagcguggcccucgcgccccacgugggccuggggcuggagacccggaccgagaccuggaugagcuccgagggcgccuggaagcagauccagcgggucgagacgugggcccuccgccaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugccccacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgagccaggcgcccaccaccgagauccagcucaccgacuacggggcccugacgcuggacugcagcccccggaccggccucgacuucaacgagaugguccugcugaccaugaaggagaaguccuggcucgugcacaagcagugguuccuggaccugccccucccguggaccagcggggccuccacgagccaggagaccuggaaccggcaggaccugcuggugaccuucaagaccgcccacgccaagaagcaggaggucguggugcucggcucccaggagggcgcgaugcacacggcccugaccggggccaccgagauccagaccagcggcacgaccaccaucuucgccgggcaccugaagugccgccucaagauggacaagcugacccugaagggcauguccuacgucaugugcacggggagcuucaagcucgagaaggagguggccgagacccagcacggcaccgugcugguccagaucaaguacgagggcaccgacgcgcccugcaagauccccuuccugacgcaggacgagaagggggugacccagaacggccggcugaucaccgccaaccccaucgugaccgacaaggagaagccggucaacaucgaggccgagccgcccuucggggaguccuacaucaucaucggcgccggcgagaaggcgcucaagcugagcugguucaagaagggguccagcaucggcaagauguucgaggccacggcccgcggggcccggcgcauggccauccugggcgacaccgcgugggacuucggguccaucggcggcguguucaccagcguggggaagcucguccaccagaucuucggcaccgccuacggggugcuguucuccggcgugagcuggacgaugaagaucgggaucggcguccugcucaccuggcugggccugaacucccgcagcaccucccucagcaugaccugcaucgccguggggcuggugacgcuguaccucggcgucauggugcaggccgacuccgggugcgugaucaacuggaagggccgggagcugaagugcgggagcggcaucuucgucaccaacgaggugcacaccuggaccgagcaguacaaguuccaggccgacagccccaagcgccuguccgcggccaucggcaaggccugggaggagggggugugcggcauccggagcgccacccgccucgagaacaucauguggaagcagaucuccaacgagcugaaccacauccugcucgagaacgacaugaaguucacggucguggugggggacgucgccggcauccuggcgcaggggaagaagaugauccggccgcagcccauggaguacaaguacagcuggaaguccuggggcaaggccaagaucaucggcgccgacgugcagaacaccaccuucaucaucgacgggcccaacacccccgagugcccggacgaccagcgcgccuggaacaucugggagguggaggacuacggcuucgggaucuucacgaccaacaucuggcugaagcuccgggacagcuacacccaggucugcgaccaccgccugauguccgcggccaucaaggacagcaaggccgugcacgccgacaugggcuacuggaucgaguccgagaagaacgagaccuggaagcuggcccgggcgagcuucaucgaggugaagacgugcaucuggcccaagucccacacccucuggagcaacggcguccuggaguccgagaugaucauccccaagaucuacgggggccccaucagccagcacaacuaccgcccgggguacuucacccagaccgccggccccuggcaccuggggaagcucgagcuggacuucgaccugugcgagggcacgaccgugguggucgacgagcacugcggcaaccgggggcccucccuccgcaccaccacggugaccggcaagaucauccacgaguggugcugccggagcugcacccugccgccccugcgcuuccgcggggaggacggcugcugguacgggauggagauccgccccgugaaggagaaggaggagaaccucgucaaguccauggugagcgccggcagcggcgagguggacuccuucagccuggggcugcucugcaucuccaucaucaucgaggaggucaugcggagccgcuggucccggaagaugcugaugaccggcacgcuggccguguucuuccuccugaucauggggcagcugaccuggaacgaccucauccgccugugcaucauggugggcgccaacgcgagcgaccgcauggggaugggcaccaccuaccuggcccucauggccacguucaagaugcggcccauguucgccgucggccugcuguuccgccggcucaccucccgcgaggugcugcugcucaccaucgggcugagccugguggccuccgucgagcucccgaacagccuggaggagcugggcgacgggcucgcgaugggcaucaugauccugaagcugcucaccgacuuccagucccaccagcugugggccacgcugcucagccugaccuucaucaagaccaccuucucccugcacuacgccuggaagacgauggccauggugcucagcaucgucucccuguucccccugugccucagcaccaccucccagaagaccacguggcugcccgugcugcucggcagccuggggugcaagccccugaccauguuccucaucgcggagaacaagaucuggggccggcgcuccuggccgcugaacgaggggaucauggccgugggcaucgucagcauccugcucagcucccugcugaagaacgacgugccccucgccgggccccugaucgccggcggcaugcugaucgccugcuacgugaucagcggguccagcgcggaccucucccuggagaaggccgccgaggucagcugggaggaggaggccgagcacuccggcgccagccacaacauccugguggaggugcaggacgacgggaccaugaagaucaaggacgaggagcgggacgacacccucaccauccugcugaaggcgacgcuccuggccgucuccggcguguacccccugagcaucccggccacccucuucgugugguacuucuggcagaagaagaagcagcgcuccgggguccugugggacacccccuccccgcccgagguggagcgggccgugcuggacgacggcaucuaccgcaucaugcagcggggccugcucgggcgcucccaggucggcguggggguguuccaggagaacgucuuccacaccauguggcacgugacgcggggcgccgugcugauguaccaggggaagcgccuggagccgagcugggcguccgucaagaaggaccucaucagcuacggcggcggguggcggcugcagggcuccuggaacaccggggaggagguccaggugaucgccgucgagcccggcaagaaccccaagaacgugcagaccgcccccgggaccuucaagacgccggagggcgaggugggcgccaucgcccuggacuucaagcccgggaccagcggcucccccaucgucaaccgcgaggggaagaucgugggccucuacggcaacgggguggucaccaccagcggcacguacgugagcgcgaucgcccaggccaaggccucccaggaggggccccugccggagaucgaggacgagguguuccggaagcgcaaccugaccaucauggaccuccaccccggcagcgggaagacccggcgcuaccugcccgcgaucguccgggaggccaucaagcgcaagcugcgcacccucauccuggccccgacgcgggugguggccuccgagauggccgaggcgcugaagggcaugcccauccgcuaccagaccaccgccgucaagagcgagcacaccggcaaggagaucguggaccucaugugccacgccacguucaccaugcggcugcugucccccgugcgcguccccaacuacaacaugaucaucauggacgaggcccacuucaccgacccgagcuccaucgccgcgcggggguacaucagcacccgcgugggcaugggggaggccgccgccaucuucaugacggccacgccgcccggcuccguggaggcguucccccagagcaacgccgucauccaggacgaggagcgggacaucccggagcgcuccuggaacagcggguacgaguggaucaccgacuuccccggcaagaccgugugguucgugcccuccaucaagagcggcaacgacaucgccaacugccuccggaagaacgggaagcgcgucauccagcugucccggaagacguucgacaccgaguaccagaagaccaagaacaacgacugggacuacguggugaccacggacaucagcgagaugggcgccaacuuccgcgcggaccgggucaucgacccccgccggugccugaagccggugauccucaaggacgggcccgagcgcgugauccuggccggccccaugcccgucaccguggccuccgccgcccagcggcgcgggcggaucggccgcaaccacaacaaggagggcgaccaguacaucuacauggggcagccgcugaacaacgacgaggaccacgcgcacuggaccgaggccaagaugcuccuggacaacaucaacacccccgagggcaucauccccgcccuguucgagcccgagcgcgagaaguccgccgccaucgacggggaguaccggcuccgcggcgaggcgcggaagacguucgucgagcugaugcgccgcggggaccugccgguguggcucuccuacaagguggccagcgagggcuuccaguacagcgaccgccgguggugcuucgacggcgagcgcaacaaccagguccuggaggagaacauggacguggagaucuggaccaaggagggggagcggaagaagcugcgcccccgguggcucgacgcccgcaccuacuccgacccccuggcccugcgggaguucaaggaguucgccgcgggccgccggagcguguccggggaccucauccuggagaucggcaagcugccccagcaccucacccagcgcgcccagaacgcccuggacaaccuggucaugcuccacaacagcgagcagggcgggcgggccuaccgccacgcgauggaggagcugccggacacgaucgagacccugaugcuccuggcccugaucgccgugcucaccggcggggugacccuguucuuccuguccggccgggggcucggcaagaccagcaucggccugcugugcgucauggccuccagcgugcuccuguggauggccuccguggagccccacuggaucgcggccagcaucauccuggaguucuuccucaugguccugcugauccccgagcccgaccgccagcggacgccgcaggacaaccagcucgccuacguggugaucgggcugcuguucaugauccucaccgucgccgccaacgagaugggccugcuggagaccaccaagaaggaccucgggaucggccacguggcgguggagaaccaccaccacgccgccaugcuggacgucgaccugcaccccgccuccgccuggacgcucuacgcgguggccaccaccaucaucacccccaugaugcgccacacgaucgagaacaccaccgccaacaucagccugaccgccaucgccaaccaggcggccauccugauggggcucgacaagggcuggccgaucuccaagauggacaucggcgugccccugcuggcccucgggugcuacagccaggucaacccccugacgcugaccgccgcggugcucaugcugguggcccacuacgccaucaucggccccgggcugcaggccaaggccacccgcgaggcgcagaagcggaccgccgccggcaucaugaagaacccgacggucgacgggaucguggccaucgaccucgaccccguggucuacgacgccaaguucgagaagcagcugggccagaucaugcugcucauccugugcaccucccagauccugcucaugcgcaccaccugggcgcugugcgagagcaucacgcuggccaccggcccccucaccacccugugggaggggucccccggcaaguucuggaacacgaccaucgccgugagcauggccaacaucuuccggggguccuaccuggccggcgcgggccucgccuucagccugaugaagucccucgggggcgggcgccgggggaccggggcccagggcgagacccucggcgagaaguggaagcgccagcugaaccagcuguccaagagcgaguucaacacguacaagcgguccgggaucauggagguggaccgcagcgaggccaaggagggccucaagcgcggggagaccaccaagcacgcggucucccgcggcaccgccaagcugcggugguucguggagcgcaaccuggugaagccggaggggaaggucaucgaccugggcugcggccgcgggggcuggagcuacuacugcgccgggcucaagaaggugacggaggugaagggcuacaccaagggcggccccggccacgaggagcccauccccauggccaccuacggguggaaccuggucaagcugcacuccggcaaggacguguucuucaucccgcccgagaagugcgacacccuccugugcgacaucggggagagcucccccaaccccacgaucgaggagggccgcacccugcgggugcucaagauggucgagccguggcugcgcgggaaccaguucugcaucaagauccugaaccccuacaugcccagcgugguggagacccucgagcagaugcagcggaagcacggcggcaugcugguccgcaacccccugucccggaacagcacccacgagauguacuggguguccugcgggaccggcaacaucgugagcgccgucaacaugacgucccgcaugcuccugaaccgcuucaccauggcgcaccggaagccgaccuacgagcgcgacguggaccugggggccggcacccggcacguggccgucgagcccgagguggccaaccucgacaucaucggccagcgcaucgagaacaucaagcacgagcacaagagcacguggcacuacgacgaggacaaccccuacaagaccugggccuaccacggguccuacgaggugaagcccagcggcuccgcgagcagcauggucaacgggguggucaagcugcugaccaagccgugggacgugauccccauggugacccagaucgccaugacggacaccacccccuucggccagcagcgggucuucaaggagaagguggacacccgcacgcccaaggccaagcgggggaccgcccagaucauggaggugaccgccaaguggcucuggggcuuccugucccgcaacaagaagccgcggaucugcacccgcgaggaguucacgcggaagguccgcagcaacgcggccaucggcgccguguucguggacgagaaccaguggaacuccgccaaggaggcggucgaggacgagcgguucugggaccuggugcaccgcgagcgggagcuccacaagcaggggaagugcgcgaccugcguguacaacaugaugggcaagcgcgagaagaagcugggggaguucggcaaggccaaggggagccgggccaucugguacauguggcugggcgcccgcuuccucgaguucgaggcgcugggcuucaugaacgaggaccacugguucucccgggagaacagccuguccggggucgagggcgaggggcuccacaagcugggcuacauccugcgcgacaucagcaagauccccgggggcaacauguacgccgacgacaccgccggcugggacacccggaucacggaggacgaccuccagaacgaggcccgcaucaccgacaucauggagcccgagcacgcccugcuggcgaaguccaucuucaagcucaccuaccagaacaagguggugcgcguccagcggccggccaagaacgggaccgugauggacgugaucagccgccgggaccagcgcggcuccgggcaggucggcacguacggccugaacaccuucaccaacauggaggcccagcugauccggcagauggagagcgaggggaucuucucccccagcgagcucgagacccccaaccuggccgagcgcgugcuggacuggcucgagaaguacggcguggagcggcugaagcgcauggccaucuccggggacgacugcgucgugaagcccaucgacgaccgguucgcgacggcccugaccgcccucaacgacaugggcaaggugcgcaaggacaucccgcagugggagcccagcaagggguggaacgacuggcagcagguccccuucugcucccaccacuuccaccagcugaucaugaaggacggccgggagaucguggugcccugccgcaaccaggacgagcuggucggccgggcccgcgugagccagggggccggcuggagccuccgggagaccgcgugccuggggaaguccuacgcccagauguggcagcugauguacuuccaccgccgggaccuccgccuggccgccaacgcgaucugcagcgccgugccggucgacuggauccccaccucccggacgaccuggagcauccacgcccaccaccaguggaugaccaccgaggacaugcuguccguguggaaccgcguguggaucgaggagaaccccuggauggaggacaagacgcacaucagcuccuggggcgacguccccuaccucgggaagcgcgaggaccaguggugcggcagccugaucggccugaccgcccgggccaccugggcgaccaacauccagguggccaucaaccaggugcgccggcucaucgggaacgagaacuaccuggacuacaugaccuccaugaagcgcuucaagaacgagggcgacccggagggggcccugugguga

SEQ ID NO: 8329 - RNA, 9879 nt, Artificial Sequence
  derived and/or modified CDS sequence (opt1) from DENV-1__FJ432719__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacacgaugaccuacaagugcccccggaucaccgagaccgagcccgacgacguggacugcuggugcaacgccacggacaccugggucaccuacgggaccugcagccagacgggcgagcaccggcgggacaagcgguccguggcccucgcgccccacgugggccuggggcuggagacccgcaccgagaccuggaugagcuccgagggcgcguggaagcagauccagcgggucgagacgugggcccuccggcaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccgccgagauccagcucaccgacuacggggcccugacccuggacugcagcccccgcacgggccucgacuucaacgagaugguccugcugaccaugaaggagaaguccuggcucgugcacaagcagugguuccuggaccugccccuccccuggaccagcggggccagcaccucccaggagacguggaaccggcaggaccugcuggugaccuucaagaccgcccacgcgaagaagcaggaggucguggugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgucaugugcaccggguccuucaagcucgagaaggagcuggcggagacgcagcacggcaccgugcuggugcagaucaaguacgagggcaccgacgcccccugcaagauccccuucagcacccaggacgagaagggggucacgcagaacggccggcugaucaccgccaacccgaucgugaccgacaaggagaagcccgugaacaucgaggccgagccgcccuucggggaguccuacaucgucaucggcgcgggcgagaaggcccucaagcugagcugguucaagaagggguccagcaucggcaagauguucgaggccaccgcccgcggggcccggcgcauggcgauccugggcgacacggccugggacuucggguccaucggcggcguguucaccagcguggggaagcucguccaccagaucuucggcaccgccuacggggugcuguucuccggcgugagcuggaccaugaagaucgggaucggcguccugcucacguggcugggccugaacucccgcagcaccucccucagcaugaccugcaucgccguggggcuggugacccuguaccucggcgucauggugcaggccgacuccgggugcgugaucaacuggaagggccgggagcugaagugcgggagcggcaucuucgucacgaacgaggugcacaccuggaccgagcaguacaaguuccaggcggacagcccgaagcgccuguccgccgccaucggcaaggccugggaggagggggugugcggcauccggagcgccacccgccucgagaacaucauguggaagcagaucuccaacgagcugaaccacauccugcucgagaacgacaugaaguucaccgucguggugggggacgucgcgggcauccuggcccaggggaagaagaugauccggccccagcccauggaguacaaguacagcuggaaguccuggggcaaggccaagaucaucggcgccgacgugcagaacacgaccuucaucaucgacgggcccaacaccccggagugccccgacgaccagcgcgcguggaacaucugggagguggaggacuacggcuucgggaucuucaccacgaacaucuggcugaagcuccgggacagcuacacccaggucugcgaccaccgccugauguccgccgccaucaaggacagcaaggccgugcacgccgacaugggcuacuggaucgaguccgagaagaacgagaccuggaagcuggcgcgggccagcuucaucgaggugaagaccugcaucuggcccaagucccacacgcucuggagcaacggcguccuggaguccgagaugaucauccccaagaucuacgggggcccgaucagccagcacaacuaccgccccggguacuucacccagaccgccggccccuggcaccuggggaagcucgagcuggacuucgaccugugcgagggcaccacggugguggucgacgagcacugcggcaaccgggggccgucccuccgcaccaccaccgugacgggcaagaucauccacgaguggugcugccggagcugcacccugccgccccugcgcuuccgcggggaggacggcugcugguacgggauggagauccgccccgugaaggagaaggaggagaaccucgucaaguccauggugagcgccggcagcggcgagguggacuccuucagccuggggcugcucugcaucuccaucaugaucgaggaggucaugcggagccgcuggucccggaagaugcugaugaccggcacccuggccguguucuuccuccugaucauggggcagcugacguggaacgaccucauccgccugugcaucauggugggcgcgaacgccagcgaccgcauggggaugggcaccaccuaccuggcccucauggccaccuucaagaugcggccgauguucgccgucggccugcuguuccgccggcucacgucccgcgaggugcugcugcucaccaucgggcugagccugguggcguccgucgagcuccccaacagccuggaggagcugggcgacgggcucgccaugggcaucaugauccugaagcugcucaccgacuuccagucccaccagcugugggccacccugcucagccugacguucaucaagaccaccuucucccugcacuacgccuggaagaccauggcgauggugcucagcaucgucucccuguucccccugugccucagcacgaccucccagaagaccaccuggcugcccgugcugcucggcagccuggggugcaagccgcugacgauguuccucaucgccgagaacaagaucuggggccggcgcuccuggccccugaacgaggggaucauggccgugggcaucgucagcauccugcucagcucccugcugaagaacgacgugccccucgccgggccccugaucgccggcggcaugcugaucgcgugcuacgugaucagcggguccagcgccgaccucucccuggagaaggccgccgaggucagcugggaggaggaggccgagcacuccggcgcgagccacaacauccugguggaggugcaggacgacgggaccaugaagaucaaggacgaggagcgggacgacacccucaccauccugcugaaggccacccuccuggccgucuccggcguguacccgcugagcauccccgccacccuguucgugugguacuucuggcagaagaagaagcagcgcuccgggguccugugggacacccccagcccgcccgagguggagcgggccgugcuggacgacggcaucuaccgcaucaugcagcggggccugcucgggcgcucccaggucggcguggggguguuccaggagaacgucuuccacaccauguggcacgugacccggggcgcggugcugauguaccaggggaagcgccuggagcccagcugggccuccgucaagaaggaccucaucagcuacggcggcggguggcggcugcagggcuccuggaacacgggggaggagguccaggugaucgccgucgagcccggcaagaaccccaagaacgugcagaccgcccccgggaccuucaagacccccgagggcgaggugggcgccaucgcgcuggacuucaagcccgggacgagcggcucccccaucgucaaccgcgaggggaagaucgugggccucuacggcaacgggguggucaccaccagcggcaccuacgugagcgccaucgcccaggccaaggcgucccaggaggggccgcugcccgagaucgaggacgagguguuccggaagcgcaaccugacgaucauggaccuccaccccggcagcgggaagacccggcgcuaccugccggccaucguccgggaggccaucaagcgcaagcugcgcacccucauccuggcccccacccgggugguggccuccgagauggcggaggcccugaagggcaugcccauccgcuaccagacgaccgccgucaagagcgagcacaccggcaaggagaucguggaccucaugugccacgccaccuucacgaugcggcugcugucccccgugcgcgucccgaacuacaacaugaucaucauggacgaggcccacuucaccgaccccagcuccaucgcggcccggggguacaucagcacccgcgugggcaugggggaggccgccgccaucuucaugaccgcgacgccgcccggcuccguggaggccuucccgcagagcaacgccgucauccaggacgaggagcgggacauccccgagcgcuccuggaacagcggguacgaguggaucaccgacuuccccggcaagaccgugugguucgugcccuccaucaagagcggcaacgacaucgccaacugccuccggaagaacgggaagcgcgucauccagcugucccggaagaccuucgacacggaguaccagaagaccaagaacaacgacugggacuacguggugaccaccgacaucagcgagaugggcgcgaacuuccgcgccgaccgggucaucgacccgcgccggugccugaagcccgugauccucaaggacgggcccgagcgcgugauccuggccggccccaugccggucacgguggccuccgccgcgcagcggcgcgggcggaucggccgcaaccacaacaaggagggcgaccaguacaucuacauggggcagccccugaacaacgacgaggaccacgcccacuggaccgaggccaagaugcuccuggacaacaucaacacccccgagggcaucauccccgcccuguucgagccggagcgcgagaaguccgccgcgaucgacggggaguaccggcuccgcggcgaggcccggaagaccuucgucgagcugaugcgccgcggggaccugcccguguggcucuccuacaagguggccagcgagggcuuccaguacagcgaccgccgguggugcuucgacggcgagcgcaacaaccagguccuggaggagaacauggacguggagaucuggacgaaggagggggagcggaagaagcugcgcccccgguggcucgacgcccgcaccuacuccgacccccuggcccugcgggaguucaaggaguucgcggccggccgccggagcguguccggggaccucauccuggagaucggcaagcugccgcagcaccucacccagcgcgcccagaacgcccuggacaaccuggucaugcuccacaacagcgagcagggcgggcgggcguaccgccacgccauggaggagcugcccgacaccaucgagacgcugaugcuccuggcccugaucgccgugcucaccggcggggugacccuguucuuccuguccggccgggggcucggcaagaccagcaucggccugcugugcgucauggccuccagcgugcuccuguggauggcguccguggagccccacuggaucgccgccagcaucauccuggaguucuuccucaugguccugcugauccccgagccggaccgccagcggacgccccaggacaaccagcucgccuacguggugaucgggcugcuguucaugauccucacggucgccgcgaacgagaugggccugcuggagaccaccaagaaggaccucgggaucggccacguggccguggagaaccaccaccacgccgccaugcuggacgucgaccugcaccccgccuccgcguggacccucuacgccguggccacgaccaucaucaccccgaugaugcgccacaccaucgagaacacgaccgccaacaucagccugaccgccaucgcgaaccaggccgccauccugauggggcucgacaagggcuggcccaucuccaagauggacaucggcgugccccugcuggcccucgggugcuacagccaggucaacccccugacccugacggcggccgugcucaugcugguggcccacuacgccaucaucggcccggggcugcaggccaaggcgacccgcgaggcccagaagcggaccgccgccggcaucaugaagaaccccaccgucgacgggaucguggccaucgaccucgaccccguggucuacgacgcgaaguucgagaagcagcugggccagaucaugcugcucauccugugcacgucccagauccugcucaugcgcaccaccugggcccugugcgagagcaucacccuggccacgggcccccucaccacccugugggagggguccccgggcaaguucuggaacaccacgaucgccgugagcauggccaacaucuuccggggguccuaccuggcgggcgccggccucgccuucagccugaugaagucccucgggggcgggcgccgggggaccggggcccagggcgagacccucggcgagaaguggaagcgccagcugaaccagcuguccaagagcgaguucaacaccuacaagcgguccgggaucauggagguggaccgcagcgaggcgaaggagggccucaagcgcggggagacgaccaagcacgccgucucccgcggcaccgccaagcugcggugguucguggagcgcaaccuggugaagcccgaggggaaggucaucgaccugggcugcggccgcgggggcuggagcuacuacugcgccgggcucaagaaggugaccgaggugaagggcuacacgaagggcggccccggccacgaggagcccaucccgauggccaccuacggguggaaccuggucaagcugcacuccggcaaggacguguucuucaucccgcccgagaagugcgacacccuccugugcgacaucggggagagcucccccaacccgaccaucgaggagggccgcacgcugcgggugcucaagauggucgagcccuggcugcgcgggaaccaguucugcaucaagauccugaaccccuacaugcccagcgugguggagacccucgagcagaugcagcggaagcacggcggcaugcugguccgcaacccgcugucccggaacagcacccacgagauguacuggguguccugcgggaccggcaacaucgugagcgcggucaacaugaccucccgcaugcuccugaaccgcuucacgauggcccaccggaagcccaccuacgagcgcgacguggaccugggggccggcacccggcacguggccgucgagcccgagguggccaaccucgacaucaucggccagcgcaucgagaacaucaagcacgagcacaagagcaccuggcacuacgacgaggacaaccccuacaagacgugggcguaccacggguccuacgaggugaagccgagcggcuccgccagcagcauggucaacgggguggucaagcugcugaccaagcccugggacgugauccccauggugacccagaucgccaugaccgacacgacccccuucggccagcagcgggucuucaaggagaagguggacacccgcaccccgaaggccaagcgggggacggcccagaucauggaggugaccgcgaaguggcucuggggcuuccugucccgcaacaagaagccccggaucugcacccgcgaggaguucacccggaagguccgcagcaacgccgccaucggcgccguguucguggacgagaaccaguggaacuccgcgaaggaggccgucgaggacgagcgguucugggaccuggugcaccgcgagcgggagcuccacaagcaggggaagugcgccacgugcguguacaacaugaugggcaagcgcgagaagaagcugggggaguucggcaaggccaaggggagccgggccaucugguacauguggcugggcgcgcgcuuccucgaguucgaggcccugggcuucaugaacgaggaccacugguucucccgggagaacagccuguccggggucgagggcgaggggcuccacaagcugggcuacauccugcgcgacaucagcaagauccccgggggcaacauguacgccgacgacaccgccggcugggacacccggaucaccgaggacgaccuccagaacgaggcccgcaucacggacaucauggagccggagcacgcgcugcuggccaaguccaucuucaagcucaccuaccagaacaagguggugcgcguccagcggcccgccaagaacgggaccgugauggacgugaucagccgccgggaccagcgcggcuccgggcaggucggcaccuacggccugaacacguucaccaacauggaggcccagcugauccggcagauggagagcgaggggaucuucucccccagcgagcucgagacccccaaccuggccgagcgcgugcuggacuggcucgagaaguacggcguggagcggcugaagcgcauggcgaucuccggggacgacugcgucgugaagccgaucgacgaccgguucgccaccgcccugacggcccucaacgacaugggcaaggugcgcaaggacaucccccagugggagcccagcaagggguggaacgacuggcagcagguccccuucugcucccaccacuuccaccagcugaucaugaaggacggccgggagaucguggugccgugccgcaaccaggacgagcuggucggccgggcccgcgugagccagggggcgggcuggagccuccgggagaccgccugccuggggaaguccuacgcccagauguggcagcugauguacuuccaccgccgggaccuccgccuggccgcgaacgccaucugcagcgccgugcccgucgacuggauccccaccucccggaccacguggagcauccacgcccaccaccaguggaugaccaccgaggacaugcuguccguguggaaccgcguguggaucgaggagaaccccuggauggaggacaagacccacaucagcuccuggggcgacgucccguaccucgggaagcgcgaggaccaguggugcggcagccugaucggccugacggcccgggcgaccugggccaccaacauccagguggccaucaaccaggugcgccggcucaucgggaacgagaacuaccuggacuacaugaccuccaugaagcgcuucaagaacgagagcgaccccgagggcgcccugugguga

SEQ ID NO: 8330 - RNA, 9879 nt, Artificial Sequence
  derived and/or modified CDS sequence (opt1) from DENV-1__FJ182020__SS-prME
agcgugaccaugcugcucaugcugaugcccaccgcccuggccuuccaccucacgacccggggcggggagccccacaugaucgugagcaagcaggagcggggcaagagccugcuguucaagaccagcgccggggugaacaugugcacccucaucgccauggaccugggcgaguucugcgaggacaccaugaccuacaagugcccccgcaucaccgaggccgagcccgacgacguggacugcuggugcaacgccaccgacacgugggugaccuacgggaccugcagccagaccggcgagcaccggcgggacaagcgguccguggcccuggcgccccacgugggccucgggcuggagacgcgcaccgagaccuggaugagcuccgagggcgccuggaagcagauccagcggguggagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugcccgacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaagaucguccaguacgagaaccugaaguacagcgugaucgugaccguccacaccggcgaccagcaccagguggggaacgaguccacggagcacggcaccaccgcgaccaucacgccccaggcccccagcacggagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccagcggggccuccaccagccaggagaccuggaaccggaaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcauguccuacgucaugugcaccgggagcuucaagcuggagaaggagguggcggagacccagcacggcacggugcucguccagaucaaguacgagggcaccgacgcccccugcaagauccccuucuccacccaggacgagaagggggugacccagaacggccggcugaucacggccaacccgaucgugaccgacaaggagaagcccgucaacaucgaggccgagccgcccuucggggagagcuacaucgugaucggcgcgggcgagaaggcccugaagcuguccugguucaagaaggggagcuccaucggcaagauguucgaggccaccgcccgcggggcccggcgcauggcgauccucggcgacaccgccugggacuucgggagcaucggcggcguguucacguccgucgggaagcuggugcaccagaucuucggcaccgccuacggggugcuguucagcggcgucuccuggaccaugaagaucgggaucggcgugcuccugaccuggcugggccucaacagccgcuccacgagccuguccaugaccugcaucgccguggggcuggucacccucuaccugggcgugauggugcaggccgacagcgggugcgucaucaacuggaagggccgggagcugaagugcgggagcggcaucuucgugaccaacgaggugcacacguggaccgagcaguacaaguuccaggcggacuccccgaagcgccucagcgccgccaucggcaaggccugggaggagggggucugcggcauccgguccgccacccgccuggagaacaucauguggaagcagaucagcaacgagcugaaccacauccuccuggagaacgacaugaaguucaccgugguggucggggacguggcgggcauccuggcccaggggaagaagaugauccggccccagcccauggaguacaaguacuccuggaaguccuggggcaaggccaagaucaucggcgccgacgugcagaacaccacguucaucaucgacgggcccaacaccccggagugccccgacgaccagcgcgcguggaacaucugggaggucgaggacuacggcuucgggaucuucaccaccaacaucuggcucaagcugcgggacuccuacacccaggugugcgaccaccgccugaugagcgccgccaucaaggacuccaaggccgugcacgccgacaugggcuacuggaucgagagcgagaagaacgagaccuggaagcucgcgcgggccuccuucaucgaggucaagaccugcaucuggcccaagagccacacccugugguccaacggcgugcuggagagcgagaugaucauccccaagaucuacgggggcccgaucucccagcacaacuaccgccccggguacuucacgcagaccgccggccccuggcaccucgggaagcuggagcuggacuucgaccucugcgagggcaccaccguggucguggacgagcacugcggcaaccgggggccgagccugcgcacgaccaccgugaccggcaagaucauccacgaguggugcugccgguccugcacgcugccgccccugcgcuucaagggggaggacggcugcugguacgggauggagauccggcccgucaaggagaaggaggagaaccuggucaagagcauggugagcgccggcuccggcgaggucgacagcuucucccuggggcuccugugcaucagcaucaugaucgaggaggugaugcgcucccgguggagccgcaagaugcugaugaccggcacccucgccguguucuuccugcugaucauggggcagcucaccuggaacgaccugauccggcugugcaucauggucggcgcgaacgccuccgaccgcauggggaugggcacgaccuaccucgcccugauggccaccuucaagaugcgcccgauguucgccguggggcuccuguuccggcgccugaccagccgggaggugcugcuccugacgaucgggcugucccucgucgcgagcguggagcugcccaacucccuggaggagcucggcgacgggcuggccaugggcaucaugauccugaagcuccugaccgacuuccagagccaccagcugugggccacccuccugucccugaccuucaucaagacgaccuucagccuccacuacgccuggaagaccauggcgaugguccuguccaucgugagccuguucccccucugccuguccaccacgagccagaagaccaccuggcugcccgugcuccugggcucccuggggugcaagccgcucaccauguuccugaucgccgagaacaagaucuggggccgcaagagcuggccccugaacgaggggaucauggccgucggcaucgugagcauccuccuguccagccugcucaagaacgacgugccccuggccgggccccugaucgccggcggcaugcucaucgcgugcuacgucaucuccgggagcuccgccgaccugagccuggagaaggccgccgagguguccugggaggaggaggccgagcacagcggcgcgucccacaacauccucguggagguccaggacgacgggacgaugaagaucaaggacgaggagcgggacgacacccugaccauccugcucaaggccacccugcuggccgugagcggcguguacccgcucuccauccccgccacccuguucgucugguacuucuggcagaagaagaagcagcgcagcggggugcugugggacacgcccagcccgcccgagguggagcgggccguccucgacgacggcaucuaccgcaucaugcagcggggccugcuggggcgcagccaggugggcgugggggucuuccaggagaacguguuccacaccauguggcacgugacccggggcgcgguccugauguaccaggggaagcgccucgagcccuccugggccagcgugaagaaggaccugaucuccuacggcggcggguggcggcugcagggcagcuggaacaccggggaggaggugcaggucaucgccguggagcccggcaagaaccccaagaacgugcagacggcccccgggaccuucaagaccuccgagggcgaggucggcgccaucgcgcucgacuucaagcccgggaccagcggcagccccaucgugaaccgcgaggggaagaucgugggccuguacggcaacggggucgugacgaccuccggcaccuacgugagcgccaucgcccaggccaaggcgucccaggaggggccccugccggagaucgaggacgaggucuuccggaagcgcaaccucaccaucauggaccugcaccccggcagcgggaagacgcggcgcuaccugcccgccaucgugcgggaggccaucaagcgcaagcuccggacccugauccuggccccgacccgcguggucgccuccgagauggcggaggcccucaagggcaugcccauccgcuaccagaccacggccgucaagagcgagcacaccggcaaggagaucguggaccugaugugccacgccaccuucaccaugcggcugcucucccccguccgcgugcccaacuacaacaugaucaucauggacgaggcccacuucacggacccgagcuccaucgcggcccggggguacaucagcacccgcgugggcaugggggaggccgccgccaucuucaugaccgcgacgccgcccggcuccgucgaggccuucccccagagcaacgccgugauccaggacgaggagcgggacaucccggagcgcuccuggaacagcggguacgaguggaucacggacuuccccggcaagaccgugugguucguccccuccaucaagagcggcaacgacaucgccaacugccugcggaagaacgggaagcgcgugauccagcugucccggaagaccuucgacaccgaguaccagaagacgaagaacaacgacugggacuacguggucaccaccgacaucagcgagaugggcgcgaacuuccgcgccgaccgggugaucgacccccgccggugccucaagccggugauccugaaggacgggcccgagcgcgucauccuggccggccccaugcccgugaccgucgccuccgccgcgcagcggcgcgggcggaucggccgcaaccacaacaaggagggcgaccaguacaucuacauggggcagccgcucaacaacgacgaggaccacgcccacuggacggaggccaagaugcugcuggacaacaucaacacccccgagggcaucauccccgcccucuucgagcccgagcgggagaaguccgccgcgaucgacggggaguaccgccugcgcggcgaggcccggaagaccuucguggagcugaugcgccgcggggaccucccgguguggcugagcuacaaggucgccuccgagggcuuccaguacagcgaccgccgguggugcuucgacggcgagcgcaacaaccaggugcuggaggagaacauggacguggagaucuggaccaaggagggggagcggaagaagcuccgcccccgguggcuggacgcccgcacguacuccgacccccuggcccuccgggaguucaaggaguucgcggccggccgccggagcgucuccggggaccugauccuggagaucggcaagcucccccagcaccugacccagcgcgcccagaacgcccuggacaaccucgugaugcugcacaacagcgagcagggcgggcgggcguaccgccacgccauggaggagcugccggacaccaucgagacccucaugcugcuggcccucaucgccgugcugacgggcggggucacccuguucuuccucuccggccgggggcugggcaagaccagcaucggccugcucugcgugauggccuccagcgugcugcuguggauggcguccgucgagccccacuggaucgccgccagcaucauccucgaguucuuccugauggugcugcucauccccgagcccgaccgccagcggaccccgcaggacaaccagcuggccuacguggucaucgggcuccucuucaugauccugaccguggccgcgaacgagaugggccugcucgagacgaccaagaaggaccuggggaucggccacguggccgucgagaaccaccaccacgccgccaugcuggacguggaccuccaccccgccuccgcguggacccuguacgccguggccaccacgaucaucacccccaugaugcgccacaccaucgagaacaccacggccaacaucagccugaccgccaucgcgaaccaggccgccauccucauggggcuggacaagggcuggccgaucuccaagauggacaucggcgucccccugcucgcccuggggugcuacagccaggugaacccccugacccucaccgcggccgugcugaugcuggucgcccacuacgccaucaucggccccgggcuccaggccaaggcgacgcgggaggcccagaagcgcaccgccgccggcaucaugaagaacccgaccguggacgggaucguggccaucgaccuggaccccgucguguacgacgcgaaguucgagaagcagcugggccagaucaugcuccugauccugugcaccucccagauccuccugaugcgcacgaccugggcccugugcgagagcaucacccucgccaccggcccccugacgacccugugggaggggucccccggcaaguucuggaacaccaccaucgccgugagcauggccaacaucuuccgggggagcuaccucgcgggcgccggccuggccuucucccugaugaagucccucgggggcgggcgccggggcacgggggcccagggcgagacccugggcgagaaguggaagcgccagcugaaccagcucuccaagagcgaguucaacaccuacaagcgguccgggaucauggaggucgaccgcagcgaggcgaaggagggccugaagcgcggggagaccacgaagcacgccgugucccgcggcaccgccaagcugcggugguucguggagcgcaaccucgucaagccggaggggaaggugaucgaccugggcugcggccgcggcggguggagcuacuacugcgccgggcugaagaaggugaccgaggucaagggguacaccaagggcgggcccggccacgaggagcccauccccauggccacguacggguggaaccuggugaagcuccacuccggcaaggacguguucuucaucccgcccgagaagugcgacacccugcugugcgacaucggggagagcucccccaaccccaccaucgaggagggccgcacccuccggguccugaagaugguggagccguggcugcgcgggaaccaguucugcaucaagauccucaaccccuacaugcccagcguggucgagacgcuggagcagaugcagcggaagcacggcggcaugcuggugcgcaacccccucucccggaacagcacccacgagauguacuggguguccugcgggaccggcaacaucgucagcgcggugaacaugaccucccgcaugcugcugaaccgguucaccauggcccaccgcaagccgacguacgagcgcgacguggaccucggggccggcacccggcacgucgccguggagcccgagguggccaaccuggacaucaucggccagcgcaucgagaacaucaagcacgagcacaagagcaccuggcacuacgacgaggacaaccccuacaagaccugggcguaccacggguccuacgaggucaagcccagcggcagcgccuccagcauggugaacggggucgugaagcugcucacgaagccgugggacgugauccccauggucacccagaucgccaugaccgacaccacgcccuucggccagcagcggguguucaaggagaagguggacacccgcacccccaaggccaagcgggggaccgcccagaucauggaggucacggcgaaguggcuguggggcuuccugucccgcaacaagaagccgcggaucugcacccgcgaggaguucacccggaaggugcgcagcaacgccgccaucggcgccguguucgucgacgagaaccaguggaacuccgcgaaggaggccguggaggacgagcgguucugggaccucgugcaccgcgagcgggagcugcacaagcaggggaagugcgcgaccugcgucuacaacaugaugggcaagcgcgagaagaagcugggggaguucggcaaggccaaggggagccgggccaucugguacauguggcucggcgcgcgcuuccuggaguucgaggcccugggcuucaugaacgaggaccacugguucucccgggagaacagccucuccgggguggagggcgaggggcugcacaagcugggcuacauccuccgcgacaucagcaagauccccgggggcaacauguacgccgacgacacggccggcugggacacccggaucaccgaggacgaccugcagaacgaggccaagaucaccgacaucauggagcccgagcacgcgcugcucgccaaguccaucuucaagcugacguaccagaacaaggugguccgcgugcagcggccggccaagaacgggaccgugauggacgucaucagccgccgcgaccagcggggcuccggccaggugggcaccuacggccugaacaccuucacgaacauggaggcccagcucauccgccagauggagagcgaggggaucuucucccccagcgagcuggagacccccaaccuggccggccgggugcucgacuggcuggagaagcacggggucgagcgccugaagcggauggcgaucuccggcgacgacugcguggugaagcccaucgacgaccgcuucgccaccgcccucaccgcccugaacgacauggggaagguccggaaggacaucccgcagugggagcccagcaagggcuggaacgacuggcagcagguccccuucugcagccaccacuuccaccagcugaucaugaaggacggccgcgagaucgugguccccugccggaaccaggacgagcucguggggcgcgcccgggugucccagggcgcgggguggagccugcgcgagacggccugccugggcaaguccuacgcccagauguggcagcucauguacuuccaccggcgcgaccugcggcuggccgcgaacgccaucugcagcgccgucccgguggacugggugcccaccucccgcaccaccuggagcauccacgcccaccaccaguggaugacgaccgaggacaugcucuccgucuggaaccggguguggaucgaggagaaccccuggauggaggacaagacccacaucagcuccuggggcgacgugcccuaccugggcaagcgcgaggaccaguggugcggcagccugaucgggcucaccgcccgggcgacgugggccaccaacauccaggucgccaucaaccaggugcgccgccugaucggcaacgagaacuaccuggacuacaugaccuccaugaagcgguucaagaacgagagcgacccggagggggcccucugguga

SEQ ID NO: 8331 - RNA, 9879 nt, Artificial Sequence
  derived and/or modified CDS sequence (opt1) from DENV-1__FJ182022__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccgcaucaccgagaccgagcccgacgacguggacugcuggugcaacgccacggacaccugggugaccuacgggaccugcagccagacgggcgagcaccggcgcgacaagcgguccguggcccucgcgccccacgugggccuggggcuggagacccgcaccgagaccuggaugagcuccgagggcgccuggaagcagauccagcgggucgagacgugggcccuccgccaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugcggggcaugagcuacgucaugugcacgggguccuucaagcucgagaaggagguggccgagacccagcacggcaccgugcugguccagaucaaguacgagggcaccgacgcgcccugcaagauccccuucagcacgcaggacgagaagggggugacccagaacggccgccugaucaccgccaacccgaucgugaccgacaaggagaagcccgucaacaucgaggccgagccgcccuucggggaguccuacaucgugaucggcgccggcgagaaggcgcugaagcucagcugguucaagaagggguccagcaucggcaagauguucgaggccacggcccgcggggcccgccgcauggccauccugggcgacaccgcgugggacuucggguccaucggcggcguguucaccagcgucgggaagcuggugcaccagaucuucggcaccgccuacggggugcuguucuccggcgucagcuggacgaugaagaucgggaucggcgugcugcugaccuggcucggccugaacucccggagcaccucccugagcaugaccugcaucgccguggggcucgucacgcuguaccugggcgugauggugcaggccgacuccgggugcgucaucaacuggaagggccgcgagcucaagugcgggagcggcaucuucgugaccaacgaggugcacaccuggaccgagcaguacaaguuccaggccgacagcccgaagcggcuguccgcggccaucggcaaggccugggaggagggggucugcggcauccgcagcgccacccggcuggagaacaucauguggaagcagaucuccaacgagcucaaccacauccugcuggagaacgacaugaaguucacggugguggucggggacguggccggcauccucgcgcaggggaagaagaugauccgcccccagcccauggagcacaaguacagcuggaaguccuggggcaaggccaagaucaucggcgccgacgugcagaacaccaccuucaucaucgacgggcccaacaccccggagugccccgacgaccagcgggccuggaacaucugggaggucgaggacuacggcuucgggaucuucacgaccaacaucuggcugaagcugcgcgacagcuacacccaggugugcgaccaccggcucauguccgcggccaucaaggacagcaaggccgugcacgccgacaugggcuacuggaucgaguccgagaagaacgagaccuggaagcuggcccgcgcgagcuucaucgaggucaagacgugcaucuggcccaagucccacacccuguggagcaacggcgugcucgaguccgagaugaucauccccaagaucuacgggggcccgaucagccagcacaacuaccggcccggguacuucacccagaccgccggccccuggcaccuggggaagcuggagcucgacuucgaccugugcgagggcacgaccguggucguggacgagcacugcggcaaccgcgggccgucccugcggaccaccacggugaccggcaagaucauccacgaguggugcugccgcagcugcacccugccgccccuccgguuccgcggggaggacggcugcugguacgggauggagauccggcccgucaaggagaaggaggagaaccuggugaaguccauggugagcgccggcagcggcgaggucgacuccuucagccucgggcugcugugcaucuccaucaugaucgaggaggugaugcgcagccgguggucccgcaagaugcucaugaccggcacgcuggccguguucuuccugcucaucauggggcagcugaccuggaacgaccugauccgccucugcaucauggucggcgccaacgcgagcgaccggauggggaugggcaccaccuaccuggcccugauggccacguucaagaugcgcccgauguucgccgugggccuccuguuccggcgccugaccucccgggaggugcuccugcugaccaucgggcucagccuggucgccuccguggagcugcccaacagccucgaggagcugggcgacgggcuggcgaugggcaucaugauccucaagcugcugaccgacuuccagucccaccagcucugggccacgcugcugagccucaccuucaucaagaccaccuucucccugcacuacgccuggaagacgauggccaugguccugagcaucgugucccucuucccccugugccugagcaccaccucccagaagaccacguggcuccccgugcugcugggcagccucgggugcaagccgcugaccauguuccugaucgcggagaacaagaucuggggccgccgguccuggccccucaacgaggggaucauggccgucggcaucgugagcauccugcugagcucccuccugaagaacgacgugccccuggccgggccccucaucgccggcggcaugcugaucgccugcuacgucaucagcggguccagcgcggaccugucccucgagaaggccgccgaggugagcugggaggaggaggccgagcacuccggcgccagccacaacauccugguggagguccaggacgacgggaccaugaagaucaaggacgaggagcgcgacgacacccugaccauccuccugaaggcgacgcugcucgccguguccggcguguacccgcugagcauccccgccacccuguucgucugguacuucuggcagaagaagaagcagcgguccggggugcucugggacacccccagcccgcccgagguggagcgcgccguccuggacgacggcaucuaccggaucaugcagcgcggccugcuggggcggucccaggugggcgugggggucuuccaggagaacguguuccacaccauguggcacgugacgcgcggcgccguccucauguaccaggggaagcggcuggagcccagcugggcguccgugaagaaggaccugaucagcuacggcggcggguggcgccuccagggcuccuggaacaccggggaggaggugcaggucaucgccguggagcccggcaagaaccccaagaacgugcagaccgcccccgggaccuucaagacgcccgagggcgaggucggcgccaucgcccuggacuucaagcccgggaccagcggcucccccaucgugaaccgggaggggaagaucgugggccuguacggcaacggggucgugaccaccagcggcacguacgugagcgcgaucgcccaggccaaggccucccaggaggggccgcuccccgagaucgaggacgaggucuuccgcaagcggaaccugaccaucauggaccugcaccccggcagcgggaagacccgccgguaccucccggcgaucgugcgcgaggccaucaagcgcaagcugcggacccugauccucgcccccacgcgcguggucgccuccgagauggccgaggcgcugaagggcaugcccauccgguaccagaccaccgccgucaagagcgagcacaccggcaaggagaucguggaccugaugugccacgccacguucaccaugcgccuccugucccccguccgggugccgaacuacaacaugaucaucauggacgaggcccacuucaccgaccccagcuccaucgccgcgcgcggguacaucagcacccgggugggcaugggggaggccgccgccaucuucaugacggccacgccgcccggcuccgucgaggcguucccgcagagcaacgccgugauccaggacgaggagcgcgacauccccgagcgguccuggaacagcggguacgaguggaucaccgacuuccccggcaagaccgugugguucguccccuccaucaagagcggcaacgacaucgccaacugccugcgcaagaacgggaagcgggugauccagcucucccgcaagacguucgacaccgaguaccagaagaccaagaacaacgacugggacuacguggucaccacggacaucagcgagaugggcgccaacuuccgggcggaccgcgugaucgacccgcggcgcugccugaagcccgugauccugaaggacgggcccgagcgggucauccucgccggccccaugccggugaccgucgccuccgccgcccagcgccgggggcgcaucggccgcaaccacaacaaggagggcgaccaguacaucuacauggggcagccccugaacaacgacgaggaccacgcgcacuggaccgaggccaagaugcugcucgacaacaucaacacccccgagggcaucauccccgcccuguucgagccggagcgggagaaguccgccgccaucgacggggaguaccgccugcggggcgaggcgcgcaagacguucguggagcucaugcggcgcggggaccugcccguguggcuguccuacaaggucgccagcgagggcuuccaguacagcgaccggcgcuggugcuucgacggcgagcggaacaaccaggugcucgaggagaacauggacguggagaucuggaccaaggagggggagcgcaagaagcugcggccccgcuggcuggacgcccggaccuacuccgacccccucgcccugcgcgaguucaaggaguucgccgcgggccggcgcagcgucuccggggaccugauccucgagaucggcaagcugccgcagcaccugacccagcgggcccagaacgcccucgacaaccuggugaugcugcacaacagcgagcagggcgggcgcgccuaccggcacgcgauggaggagcuccccgacacgaucgagacccugaugcugcucgcccugaucgccgugcugaccggcggggucacccucuucuuccuguccggccgcgggcugggcaagaccagcaucggccuccugugcgugauggccuccagcgugcugcucuggauggccuccgucgagccccacuggaucgcggccagcaucauccuggaguucuuccugauggugcuccugauccccgagccggaccggcagcgcacgccccaggacaaccagcuggccuacguggucaucgggcuccuguucaugauccugaccguggccgccaacgagaugggccuccuggagaccaccaagaaggaccuggggaucggccacguggcggucgagaaccaccaccacgccgccaugcucgacguggaccugcaccccgccuccgccuggacgcuguacgcgguggccaccaccaucaucaccccgaugaugcgccacacgaucgagaacaccaccgccaacaucagccucaccgccaucgccaaccaggcggccauccugauggggcuggacaagggcuggcccaucuccaagauggacaucggcgucccccuccuggcccuggggugcuacagccaggugaacccccucacgcugaccgccgcggugcugaugcucgucgcccacuacgccaucaucggcccggggcugcaggccaaggccacccgggaggcgcagaagcgcaccgccgccggcaucaugaagaaccccacgguggacgggaucguggccaucgaccuggaccccgucguguacgacgccaaguucgagaagcagcucggccagaucaugcugcugauccucugcaccucccagauccugcugaugcggaccaccugggcgcucugcgagagcaucacgcuggccaccggcccccugaccacccucugggagggguccccgggcaaguucuggaacacgaccaucgccgugagcauggccaacaucuuccgcggguccuaccuggccggcgcgggccuggccuucagccucaugaagucccucgggggcgggcggcgcgggaccggggcccagggcgagacccugggcgagaaguggaagcggcagcucaaccagcuguccaagagcgaguucaacacguacaagcgcuccgggaucauggaggucgaccggagcgaggccaaggagggccugaagcgcggggagaccaccaagcacgcggugucccggggcaccgccaagcuccgcugguucguggagcggaaccuggucaagcccgaggggaaggugaucgaccugggcugcggccgcgggggcuggagcuacuacugcgccgggcugaagaaggugacggaggucaagggcuacaccaagggcgggcccggccacgaggagcccaucccgauggccaccuacggguggaaccucgugaagcugcacuccggcaaggacguguucuucaucccgcccgagaagugcgacacccugcucugcgacaucggggagagcucccccaacccgacgaucgaggagggccggacccugcgcguccugaagaugguggagcccuggcuccgggggaaccaguucugcaucaagauccugaaccccuacaugcccagcguggucgagacccuggagcagaugcagcgcaagcacggcggcaugcucgugcggaacccgcugucccgcaacagcacccacgagauguacuggguguccugcgggaccggcaacaucgucagcgccgugaacaugacgucccgcaugcugcucaaccgguucaccauggcgcaccgcaagcccaccuacgagcgggacguggaccugggggccggcacccgccacgucgccguggagcccgagguggccaaccuggacaucaucggccagcggaucgagaacaucaagcacgagcacaagagcacguggcacuacgacgaggacaaccccuacaagaccugggccuaccacggguccuacgaggucaagccgagcggcuccgcgagcagcauggugaacggggucgugaagcuccugaccaagcccugggacgugauccccauggucacccagaucgccaugacggacaccacccccuucggccagcagcgcguguucaaggagaagguggacacccggacgccgaaggccaagcgcgggaccgcccagaucauggaggucaccgccaaguggcuguggggcuuccucucccggaacaagaagccccgcaucugcacccgggaggaguucacgcgcaaggugcggagcaacgcggccaucggcgccguguucgucgacgagaaccaguggaacuccgccaaggaggcgguggaggacgagcgcuucugggaccuggugcaccgggagcgcgagcugcacaagcaggggaagugcgcgaccugcgucuacaacaugaugggcaagcgggagaagaagcucggggaguucggcaaggccaaggggagccgcgccaucugguacauguggcugggcgcccgguuccuggaguucgaggcgcucggcuucaugaacgaggaccacugguucucccgcgagaacagccuguccgggguggagggcgaggggcugcacaagcucggcuacauccugcgggacaucagcaagauccccgggggcaacauguacgccgacgacaccgccggcugggacacccgcaucacggaggacgaccugcagaacgaggcccgcaucaccgacaucauggagccggagcacgcccuccuggcgaaguccaucuucaagcugaccuaccagaacaaggugguccgggugcagcgccccgccaagaacgggaccgugauggacgucaucagccggcgcgaccagcggggcuccggccaggugggcacguacggccucaacaccuucaccaacauggaggcccagcugauccgccagauggagagcgaggggaucuucucccccagcgagcuggagacccccaaccucgccgagcgggugcuggacuggcuggagaaguacggcgucgagcgccucaagcggauggccaucuccggggacgacugcguggugaagccgaucgacgaccgcuucgcgacggcccugaccgcccugaacgacaugggcaagguccggaaggacaucccccagugggagcccagcaagggguggaacgacuggcagcagguccccuucugcucccaccacuuccaccagcucaucaugaaggacggccgcgagaucguggucccgugccggaaccaggacgagcuggugggccgcgcccgggugagccagggggccggcuggagccugcgcgagaccgcgugccucgggaaguccuacgcccagauguggcagcugauguacuuccaccggcgcgaccugcggcucgccgccaacgcgaucugcagcgccguccccguggacuggauccccaccucccgcacgaccuggagcauccacgcccaccaccaguggaugaccaccgaggacaugcuguccguguggaaccgcgucuggaucgaggagaaccccuggauggaggacaagacgcacaucagcuccuggggcgacgugccguaccuggggaagcgggaggaccaguggugcggcagccucaucggccugaccgcccgcgccaccugggcgaccaacauccagguggccaucaaccagguccggcgccugaucgggaacgagaacuaccucgacuacaugaccuccaugaagcgguucaagaacgagagcgaccccgagggcgcccugugguga

SEQ ID NO: 8332 - RNA, 9879 nt, Artificial Sequence
  derived and/or modified CDS sequence (opt1) from DENV-1__FJ024447__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgagaccgagcccgacgacguggacugcuggugcaacgccacggacaccugggugaccuacgggaccugcagccagacgggcgagcaccggcgcgacaagcgguccguggcccucgcgccccacgugggccuggggcuggagacccgcaccgagaccuggaugagcuccgagggcgccuggaagcagauccagcgggucgagacgugggcccuccgccaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagguggccgagacccagcacggcaccgugcugguccagaucaaguacgagggcaccgacgcgcccugcaagauccccuucagcacgcaggacgagaagggggugacccagaacggccggcugaucaccgccaacccgaucgugaccgacaaggagaagcccgucaacaucgaggccgagccgcccuucggggaguccuacaucgugaucggcgccggcgagaaggcgcugaagcucagcugguucaagaagggguccagcaucggcaagauguucgaggccacggcccgcggggcccggcgcauggccauccugggcgacaccgcgugggacuucggguccaucggcggcguguucaccagcgucgggaagguggugcaccagaucuucggcaccgccuacgggguccuguucuccggcgugagcuggacgaugaagaucgggaucggcgugcuccugaccuggcugggccucaacucccgcagcaccucccugagcaugaccugcaucgccgucgggcuggugacgcucuaccugggcgugaugguccaggccgacuccgggugcgugaucaacuggaagggccgggagcugaagugcgggagcggcaucuucgugaccaacgagguccacaccuggaccgagcaguacaaguuccaggccgacagcccgaagcgccucuccgcggccaucggcaaggccugggaggagggggugugcggcauccggagcgccacccgccuggagaacaucauguggaagcagaucuccaacgagcugaaccacauccuccuggagaacgacaugaaguucacgguggucgugggggacguggccggcauccuggcgcaggggaagaagaugauccggccccagcccauggaguacaaguacagcuggaaguccuggggcaaggccaagaucaucggcgccgacguccagaacaccaccuucaucaucgacgggcccaacaccccggagugccccgacgaccagcgcgccuggaacaucugggagguggaggacuacggcuucgggaucuucacgaccaacaucuggcucaagcugcgggacagcuacacccaggugugcgaccaccgccugauguccgcggccaucaaggacagcaaggccguccacgccgacaugggcuacuggaucgaguccgagaagaacgagaccuggaagcucgcccgggcgagcuucaucgaggugaagacgugcaucuggcccaagucccacacccuguggagcaacggcgugcuggaguccgagaugaucauccccaagaucuacgggggcccgaucagccagcacaacuaccgccccggguacuucacccagaccgccggccccuggcaccucgggaagcuggagcuggacuucgaccucugcgagggcacgaccgucgugguggacgagcacugcggcaaccgggggccgucccugcgcaccaccacggucaccggcaagaucauccacgaguggugcugccggagcugcacccugccgccccugcgcuuccgcggggaggacggcugcugguacgggauggagauccgccccgugaaggagaaggaggagaaccuggugaaguccauggucagcgccggcagcggcgagguggacuccuucagccuggggcuccugugcaucuccaucaugaucgaggaggugaugcggagccgcuggucccggaagaugcugaugaccggcacgcucgccgucuucuuccugcugaucauggggcagcucaccuggaacgaccugauccgccugugcaucauggugggcgccaacgcgagcgaccgcauggggaugggcaccaccuaccucgcccugauggccacguucaagaugcggccgauguucgccguggggcuccuguuccgccggcugaccucccgcgagguccugcuccugaccaucgggcugagccucguggccuccgucgagcugcccaacagccuggaggagcucggcgacgggcuggcgaugggcaucaugauccugaagcuccugaccgacuuccagucccaccagcugugggccacgcuccugagccugaccuucaucaagaccaccuucucccuccacuacgccuggaagacgauggccauggugcugagcaucgugucccuguucccccucugccugagcaccaccucccagaagaccacguggcugcccguccuccugggcagccuggggugcaagccgcucaccauguuccugaucgcggagaacaagaucuggggccggcgcuccuggccccugaacgaggggaucauggccgugggcaucgugagcauccuccugagcucccugcucaagaacgacgucccccuggccgggccccugaucgccggcggcaugcucaucgccugcuacgugaucagcggguccagcgcggaccugucccuggagaaggccgccgaggugagcugggaggaggaggccgagcacuccggcgccagccacaacauccucgucgaggugcaggacgacgggaccaugaagaucaaggacgaggagcgggacgacacccugaccauccugcucaaggcgacgcugcuggccguguccggcgucuacccgcucagcauccccgccacccuguucgugugguacuucuggcagaagaagaagcagcgcuccggggugcugugggacacccccagcccgcccgaggucggccgggccgugcucgacgacggcaucuaccgcaucaugcagcgggggcugcugggccgcucccaggugggggucggcguguuccaggagaacguguuccacaccauguggcacgucacgcgcggggccgugcugauguaccagggcaagcgccucgagcccagcugggcguccgugaagaaggaccugaucagcuacggcgggggcuggcggcugcagggguccuggaacaccggcgaggagguccaggugaucgccguggagcccgggaagaaccccaagaacguccagaccgcccccggcaccuucaagacgcccgagggcgaggugggggccaucgcccucgacuucaagcccggcaccagcgggucccccaucgugaaccgcgagggcaagaucgucggccuguacgggaacggcguggugaccaccagcgggacguacgucagcgcgaucgcccaggccaaggccucccaggagggcccgcugcccgagaucgaggacgagguguuccggaagcgcaaccucaccaucauggaccugcaccccgggagcggcaagacccggcgcuaccugccggcgaucgugcgggaggccaucaagcgcaagcuccgcacccugauccuggcccccacgcgggucguggccuccgagauggccgaggcgcucaagggcaugcccauccgcuaccagaccaccgccgucaagagcgagcacaccgggaaggagaucgucgaccugaugugccacgccacguucaccaugcggcugcucucccccgugcgcgugccgaacuacaacaugaucaucauggacgaggcccacuucaccgaccccagcuccaucgccgcgcggggcuacaucagcacccgcgucgggaugggcgaggccgccgccaucuucaugacggccacgccgcccggguccguggaggcguucccgcagagcaacgccgugauccaggacgaggagcgggacauccccgagcgcuccuggaacagcggcuacgaguggaucaccgacuuccccggcaagaccgucugguucgugcccuccaucaagagcgggaacgacaucgccaacugccugcggaagaacggcaagcgcgugauccagcugucccggaagacguucgacaccgaguaccagaagaccaagaacaacgacugggacuacgucgugaccacggacaucagcgagaugggggccaacuuccgcgcggaccgggugaucgacccgcgccggugccucaagcccgucauccugaaggacggccccgagcgcgugauccuggccgggcccaugccggucaccguggccuccgccgcccagcggcgcggccggaucggccgcaaccacaacaaggagggggaccaguacaucuacaugggccagccccucaacaacgacgaggaccacgcgcacuggaccgaggccaagaugcugcuggacaacaucaacacccccgaggggaucauccccgcccucuucgagccggagcgcgagaaguccgccgccaucgacggcgaguaccggcugcgcggggaggcgcggaagacguucguggagcugaugcgccggggcgaccuccccgucuggcuguccuacaagguggccagcgagggcuuccaguacagcgaccgccgguggugcuucgacggggagcgcaacaaccaggugcuggaggagaacauggacgucgagaucuggaccaaggagggcgagcggaagaagcuccgcccccgguggcuggacgcccgcaccuacuccgacccccuggcccuccgggaguucaaggaguucgccgcggggcgccggagcguguccggcgaccugauccuggagaucggcaagcucccgcagcaccugacccagcgcgcccagaacgcccuggacaaccucgugaugcugcacaacagcgagcagggcgggcgggccuaccgccacgcgauggaggagcugcccgacacgaucgagacccucaugcugcuggcccucaucgccguccugaccgggggcgugacccuguucuuccucuccgggcggggccugggcaagaccagcaucgggcugcucugcgugauggccuccagcguccugcuguggauggccuccguggagccccacuggaucgcggccagcaucauccucgaguucuuccugauggugcugcucauccccgagccggaccgccagcggacgccccaggacaaccagcuggccuacgucgugaucggccuccucuucaugauccugaccguggccgccaacgagauggggcugcucgagaccaccaagaaggaccugggcaucgggcacgucgcgguggagaaccaccaccacgccgccaugcuggacguggaccuccaccccgccuccgccuggacgcuguacgcggucgccaccaccaucaucaccccgaugaugcgccacacgaucgagaacaccaccgccaacaucagccugaccgccaucgccaaccaggcggccauccucaugggccuggacaagggcuggcccaucuccaagauggacaucggggugccccugcucgcccugggcugcuacagccaggugaacccccugacgcucaccgccgcgguccugaugcugguggcccacuacgccaucaucgggccgggccuccaggccaaggccacccgcgaggcgcagaagcggaccgccgccgggaucaugaagaaccccacgguggacggcaucgucgccaucgaccuggaccccgugguguacgacgccaaguucgagaagcagcugggccagaucaugcuccugauccugugcaccucccagauccuccugaugcgcaccaccugggcgcugugcgagagcaucacgcucgccaccgggccccugaccacccugugggagggcuccccggggaaguucuggaacacgaccaucgccgucagcauggccaacaucuuccggggcuccuaccucgccggcgcggggcuggccuucagccugaugaagucccucggcgggggccgccgggggaccggcgcccagggcgagacccugggggagaaguggaagcgccagcugaaccagcucuccaagagcgaguucaacacguacaagcgguccggcaucauggagguggaccgcagcgaggccaaggaggggcugaagcggggcgagaccaccaagcacgcggugucccgcgggaccgccaagcugcggugguucgucgagcgcaaccucgugaagcccgagggcaaggugaucgaccugggcugcgggcggggcggguggagcuacuacugcgccggccugaagaaggucacggaggugaagggguacaccaagggcggccccgggcacgaggagcccaucccgauggccaccuacggcuggaaccuggugaagcuccacuccgggaaggacgucuucuucaucccgcccgagaagugcgacacccugcugugcgacaucggcgagagcucccccaacccgacgaucgaggaggggcgcacccuccgggugcugaagaugguggagcccuggcugcgcggcaaccaguucugcaucaagauccucaaccccuacaugcccagcgucguggagacccuggagcagaugcagcggaagcacggcgggaugcuggugcgcaacccgcucucccggaacagcacccacgagauguacugggucuccugcggcaccgggaacaucgugagcgccgugaacaugacgucccgcaugcugcugaaccgcuucaccauggcgcaccggaagcccaccuacgagcgcgacgucgaccucggcgccggcacccggcacguggccguggagcccgaggucgccaaccuggacaucaucgggcagcgcaucgagaacaucaagcacgagcacaagagcacguggcacuacgacgaggacaaccccuacaagaccugggccuaccacggcuccuacgaggugaagccgagcggguccgcgagcagcauggucaacggcguggugaagcugcucaccaagcccugggacgucauccccauggugacccagaucgccaugacggacaccacccccuucgggcagcagcggguguucaaggagaaggucgacacccgcacgccgaaggccaagcggggcaccgcccagaucauggaggugaccgccaaguggcuguggggcuuccugucccgcaacaagaagccccggaucugcacccgcgaggaguucacgcggaaggugcgcagcaacgcggccaucggggccgucuucguggacgagaaccaguggaacuccgccaaggaggcgguggaggacgagcgguucugggaccucguccaccgcgagcgggagcugcacaagcagggcaagugcgcgaccugcguguacaacaugauggggaagcgcgagaagaagcugggcgaguucgggaaggccaagggcagccgggccaucugguacauguggcucggcgcccgcuuccuggaguucgaggcgcugggguucaugaacgaggaccacugguucucccgggagaacagccucuccggcguggagggggagggccugcacaagcugggguacauccuccgcgacaucagcaacauccccggcggcaacauguacgccgacgacaccgccgggugggacacccggaucacggaggacgaccugcagaacgaggcccgcaucaccgacaucauggagccggagcacgcccugcucgcgaaguccaucuucaagcugaccuaccagaacaaggucgugcgcgugcagcggcccgccaagaacggcaccgucauggacgugaucagccgccgggaccagcgcggguccggccaggugggcacguacgggcugaacaccuucaccaacauggaggcccagcucauccggcagauggagagcgagggcaucuucucccccagcgagcuggagacccccaaccuggccgagcgcguccucgacuggcuggagaaguacgggguggagcggcugaagcgcauggccaucuccggcgacgacugcguggucaagccgaucgacgaccgguucgcgacggcccucaccgcccugaacgacauggggaaggugcgcaaggacaucccccagugggagcccagcaagggcuggaacgacuggcagcagguccccuucugcucccaccacuuccaccagcugaucaugaaggacggccgggagaucgucgugccgugccgcaaccaggacgagcucguggggcgggcccgcgucagccagggcgccggguggagccugcgggagaccgcgugccugggcaaguccuacgcccagauguggcagcucauguacuuccaccgccgggaccugcgccuggccgccaacgcgaucugcagcgccgugcccguggacuggauccccaccucccggacgaccuggagcauccacgcccaccaccaguggaugaccaccgaggacaugcucuccgucuggaaccgcguguggaucgaggagaaccccuggauggaggacaagacgcacaucagcuccuggggcgacgugccguaccugggcaagcgcgaggaccaguggugcggcagccugaucgggcucaccgcccgggccaccugggcgaccaacauccaggucgccaucaaccaggugcgccggcugaucggcaacgagaacuaccuggacuacaugaccuccaugaagcgcuucaagaacgagagcgaccccgagggggcccucugguga

SEQ ID NO: 8333 - RNA, 9879 nt, Artificial Sequence
  derived and/or modified CDS sequence (opt1) from DENV-1__FJ182025__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgagaccgagcccgacgacguggacugcuggugcaacgccacggacaccugggugaccuacgggaccugcagccagacgggcgagcaccggcgcgacaagcgguccguggcccucgcgccccacgugggccuggggcuggagacccgcaccgagaccuggaugagcuccgagggcgccuggaagcagauccagcggguggagacgugggcccuccgccaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagguggccgagacccagcacggcaccgugcugguccagaucaaguacgagggcaccgacgcgcccugcaagauccccuucagcacgcaggacgagaagggggugacccagaacggccggcugaucaccgccaacccgaucgugaccgacaaggagaagcccgucaacaucgaggccgagccgcccuucggggaguccuacaucgugaucggcgccggcgagaaggcgcugaagcucagcugguucaagaagggguccagcaucggcaagauguucgaggccacggcccgcggggcccggcgcauggccauccugggcgacaccgcgugggacuucggguccaucggcggcguguucaccagcgucgggaagcuggugcaccagaucuucggcaccgccuacgggguccucuucuccggcgucagcuggacgaugaagaucgggaucggcgugcugcugaccuggcucggccugaacucccgcagcaccucccugagcaugaccugcaucgccguggggcucgucacgcuguaccugggcgugauggugcaggccgacuccgggugcgucaucaacuggaagggccgggagcucaagugcgggagcggcaucuucgugaccaacgaggugcacaccuggaccgagcaguacaaguuccaggccgacagcccgaagcgccuguccgcggccaucggcaaggccugggaggagggggucugcggcauccggagcgccacccgccuggagaacaucauguggaagcagaucuccaacgagcucaaccacauccugcuggagaacgacaugaaguucacggugguggucggggacguggccggcauccucgcgcaggggaagaagaugauccggccccagcccauggaguacaaguacagcuggaaguccuggggcaaggccaagaucaucggcgccgacgugcagaacaccaccuucaucaucgacgggcccaacaccccggagugccccgacgaccagcgcgccuggaacaucugggaggucgaggacuacggcuucgggaucuucacgaccaacaucuggcugaagcugcgggacagcuacacccaggugugcgaccaccgccucauguccgcggccaucaaggacagcaaggccgugcacgccgacaugggcuacuggaucgaguccgagaagaacgagaccuggaagcuggcccgggcgagcuucaucgaggucaagacgugcaucuggcccaagucccacacccuguggagcaacggcgugcucgaguccgagaugaucauccccaagaucuacgggggcccgaucagccagcacaacuaccgccccggguacuucacccagaccgccggccccuggcaccuggggaagcuggagcucgacuucgaccugugcgagggcacgaccguggucguggacgagcacugcggcaaccgggggccgucccugcgcaccaccacggugaccggcaagaucauccacgaguggugcugccggagcugcacccugccgccccuccgcuuccgcggggaggacggcugcugguacgggauggagauccgccccgucaaggagaaggaggagaaccuggugaaguccauggugagcgccggcagcggcgaggucgacuccuucagccucgggcugcugugcaucuccaucaugaucgaggaggugaugcggagccgcuggucccggaagaugcucaugaccggcacgcuggccguguucuuccugcucaucauggggcagcugaccuggaacgaccugauccgccucugcaucauggucggcgccaacgcgagcgaccgcauggggaugggcaccaccuaccuggcccugauggccacguucaagaugcggccgauguucgccguggggcuccuguuccgccggcugaccucccgcgaggugcuccugcugaccaucgggcucagccuggucgccuccguggagcugcccaacagccucgaggagcugggcgacgggcuggcgaugggcaucaugauccucaagcugcugaccgacuuccagucccaccagcucugggccacgcugcugagccucaccuucaucaagaccaccuucucccugcacuacgccuggaagacgauggccaugguccugagcaucgugucccucuucccccugugccugagcaccaccucccagaagaccacguggcuccccgugcugcugggcagccucgggugcaagccgcugaccauguuccugaucgcggagaacaagaucuggggccggcgcuccuggccccucaacgaggggaucauggccgucggcaucgugagcauccugcugagcucccuccugaagaacgacgugccccuggccgggccccucaucgccggcggcaugcugaucgccugcuacgucaucagcggguccagcgcggaccugucccucgagaaggccgccgaggugagcugggaggaggaggccgagcacuccggcgccagccacaacauccugguggagguccaggacgacgggaccaugaagaucaaggacgaggagcgggacgacacccugaccauccuccugaaggcgacgcugcucgccguguccggcguguacccgcugagcauccccgccacccuguucgucugguacuucuggcagaagaagaagcagcgcuccggggugcucugggacacccccagcccgcccgaggugggccgggccguccuggacgacggcaucuaccgcaucaugcagcgggggcugcugggccgcucccaggugggggugggcgucuuccaggagaacguguuccacaccauguggcacgugacgcgcggggccguccucauguaccagggcaagcgccuggagcccagcugggcguccgugaagaaggaccugaucagcuacggcgggggcuggcggcuccagggguccuggaacaccggcgaggaggugcaggucaucgccguggagcccgggaagaaccccaagaacgugcagaccgcccccggcaccuucaagacgcccgagggcgaggucggggccaucgcccuggacuucaagcccggcaccagcgggucccccaucgugaaccgcgagggcaagaucgugggccuguacgggaacggcgucgugaccaccagcgggacguacgugagcgcgaucgcccaggccaaggccucccaggagggcccgcuccccgagaucgaggacgaggucuuccggaagcgcaaccugaccaucauggaccugcaccccgggagcggcaagacccggcgcuaccucccggcgaucgugcgggaggccaucaagcgcaagcugcgcacccugauccucgcccccacgcggguggucgccuccgagauggccgaggcgcugaagggcaugcccauccgcuaccagaccaccgccgucaagagcgagcacaccgggaaggagaucguggaccugaugugccacgccacguucaccaugcggcuccugucccccguccgcgugccgaacuacaacaugaucaucauggacgaggcccacuucaccgaccccagcuccaucgccgcgcggggcuacaucagcacccgcguggggaugggcgaggccgccgccaucuucaugacggccacgccgcccggguccgucgaggcguucccgcagagcaacgccgugauccaggacgaggagcgggacauccccgagcgcuccuggaacagcggcuacgaguggaucaccgacuuccccggcaagaccgugugguucguccccuccaucaagagcgggaacgacaucgccaacugccugcggaagaacggcaagcgcgugauccagcucucccggaagacguucgacaccgaguaccagaagaccaagaacaacgacugggacuacguggucaccacggacaucagcgagaugggggccaacuuccgcgcggaccgggugaucgacccgcgccggugccugaagcccgugauccugaaggacggccccgagcgcgucauccucgccgggcccaugccggugaccgucgccuccgccgcccagcggcgcggccggaucggccgcaaccacaacaaggagggggaccaguacaucuacaugggccagccccugaacaacgacgaggaccacgcgcacuggaccgaggccaagaugcugcucgacaacaucaacacccccgaggggaucauccccgcccuguucgagccggagcgcgagaaguccgccgccaucgacggcgaguaccggcugcgcggggaggcgcggaagacguucguggagcucaugcgccggggcgaccugcccguguggcuguccuacaaggucgccagcgagggcuuccaguacagcgaccgccgguggugcuucgacggggagcgcaacaaccaggugcucgaggagaacauggacguggagaucuggaccaaggagggcgagcggaagaagcugcgcccccgguggcuggacgcccgcaccuacuccgacccccucgcccugcgggaguucaaggaguucgccgcggggcgccggagcgucuccggcgaccugauccucgagaucggcaagcugccgcagcaccugacccagcgcgcccagaacgcccucgacaaccuggugaugcugcacaacagcgagcagggcgggcgggccuaccgccacgcgauggaggagcuccccgacacgaucgagacccugaugcugcucgcccugaucgccgugcugaccgggggcgucacccucuucuuccuguccgggcggggccugggcaagaccagcaucgggcuccugugcgugaucgccuccagcgugcugcucuggauggccuccgucgagccccacuggaucgcggccagcaucauccuggaguucuuccugauggugcuccugauccccgagccggaccgccagcggacgccccaggacaaccagcuggccuacguggucaucggccuccuguucaugauccugaccguggccgccaacgagauggggcuccuggagaccaccaagaaggaccugggcaucgggcacguggcggucgagaaccaccaccacgccgccaugcucgacguggaccugcaccccgccuccgccuggacgcuguacgcgguggccaccaccaucaucaccccgaugaugcgccacacgaucgagaacaccaccgccaacaucagccucaccgccaucgccaaccaggcggccauccugaugggccuggacaagggcuggcccaucuccaagauggacaucggggucccccuccuggcccugggcugcuacagccaggugaacccccucacgcugaccgccgcggugcugaugcucgucgcccacuacgccaucaucgggccgggccugcaggccaaggccacccgcgaggcgcagaagcggaccgccgccgggaucaugaagaaccccacgguggacggcaucguggccaucgaccuggaccccgucguguacgacgccaaguucgagaagcagcucggccagaucaugcugcugauccucugcaccucccagauccugcugaugcgcaccaccugggcgcucugcgagagcaucacgcuggccaccgggccccugaccacccucugggagggcuccccggggaaguucuggaacacgaccaucgccgugagcauggccaacaucuuccggggcuccuaccuggccggcgcggggcuggccuucagccucaugaagucccugggcgggggccgccgggggaccggcgcccagggcgagacccugggggagaaguggaagcgccagcucaaccagcuguccaagagcgaguucaacacguacaagcgguccggcaucauggaggucgaccgcagcgaggccaaggaggggcugaagcggggcgagaccaccaagcacgcggugucccgcgggaccgccaagcuccggugguucguggagcgcaaccuggucaagcccgagggcaaggugaucgaccugggcugcgggcggggcggguggagcuacuacugcgccggccugaagaaggugacggaggucaagggguacaccaagggcggccccgggcacgaggagcccaucccgauggccaccuacggcuggaaccucgugaagcugcacuccgggaaggacguguucuucaucccgcccgagaagugcgacacccugcucugcgacaucggcgagagcucccccaacccgacgaucgaggaggggcgcacccugcggguccugaagaugguggagcccuggcuccgcggcaaccaguucugcaucaagauccugaaccccuacaugcccagcguggucgagacccuggagcagaugcagcggaagcacggcgggaugcucgugcgcaacccgcugucccggaacagcacccacgagauguacuggguguccugcggcaccgggaacaucgucagcgccgugaacaugacgucccgcaugcugcucaaccgcuucaccauggcgcaccggaagcccaccuacgagcgcgacguggaccugggcgccggcacccggcacgucgccguggagcccgagguggccaaccuggacaucaucgggcagcgcaucgagaacaucaagcacgagcacaagagcacguggcacuacgacgaggacaaccccuacaagaccugggccuaccacggcuccuacgaggucaagccgagcggguccgcgagcagcauggugaacggcgucgugaagcuccugaccaagcccugggacgugauccccauggucacccagaucgccaugacggacaccacccccuucgggcagcagcggguguucaaggagaagguggacacccgcacgccgaaggccaagcggggcaccgcccagaucauggaggucaccgccaaguggcuguggggcuuccucucccgcaacaagaagccccggaucugcacccgcgaggaguucacgcggaaggugcgcagcaacgcggccaucggggccguguucgucgacgagaaccaguggaacuccgccaaggaggcgguggaggacgagcgguucugggaccuggugcaccgcgagcgggagcugcacaagcagggcaagugcgcgaccugcgucuacaacaugauggggaagcgcgagaagaagcucggcgaguucgggaaggccaagggcagccgggccaucugguacauguggcugggcgcccgcuuccuggaguucgaggcgcucggguucaugaacgaggaccacugguucucccgggagaacagccuguccggcguggagggggagggccugcacaagcucggguacauccugcgcgacaucagcaacauccccggcggcaacauguacgccgacgacaccgccgggugggacacccggaucacggaggacgaccugcagaacgaggcccgcaucaccgacaucauggagccggagcacgcccuccuggcgaaguccaucuucaagcugaccuaccagaacaaggugguccgcgugcagcggcccaccaagaacggcacggugauggacgucaucagccgccgggaccagcgcggguccggccaggugggcaccuacgggcucaacaccuucaccaacauggaggcccagcugauccggcagauggagagcgagggcaucuucucccccagcgagcuggagacgcccaaccucgccgagcgcgugcuggacuggcuggagaaguacggggucgagcggcucaagcgcauggccaucuccggcgacgacugcguggugaagccggucgacgaccgguucgccaccgcgcugaccgcccugaacgacauggggaaggugcgcaaggacaucccccagugggagcccagcaagggcuggaacgacuggcagcagguccccuucugcucccaccacuuccaccagcucaucaugaaggacggccgggagaucgucgugccgugccgcaaccaggacgagcugguggggcgggcccgcgucagccagggcgccggguggagccugcgggagaccgccugccucggcaaguccuacgcgcagauguggcagcugauguacuuccaccgccgggaccugcgccucgccgccaacgccaucugcagcgcggugcccguggacuggauccccacgucccggaccaccuggagcauccacgcccaccaccaguggaugaccacggaggacaugcuguccgucuggaaccgcguguggaucgaggagaaccccuggauggaggacaagacccacaucagcuccuggggcgacgugccguaccugggcaagcgcgaggaccaguggugcggcagccucaucgggcugaccgcccgggccaccugggccaccaacauccaggucgcgaucaaccaggugcgccggcugaucggcaacgagaacuaccucgacuacaugacguccaugaagcgcuucaagaacgagagcgaccccgagggggcccugugguga

SEQ ID NO: 8334 - RNA, 9879 nt, Artificial Sequence
  derived and/or modified CDS sequence (opt1) from DENV-1__FJ373297__SS-prME
uccgugaccaugcugcucaugcugaugcccaccgcccuggccuuccaccucaccacccggggcggggagccccacaugaucguguccaagcaggagcggggcaagagccugcuguucaagaccuccgccggggugaacaugugcacccucaucgccauggaccugggcgagcugugcgaggacaccaugaccuacaagugcccccggaucaccgagguggagcccgacgacguggacugcuggugcaacaccaccgacaccugggugaccuacgggaccugcagccagacgggcgagcaccggcgcgacaagcgguccguggcccucgcgccccacgucggccuggggcuggagacccgggccgagaccuggaugagcuccgagggcgcguggaagcagauccagaagguggagaccugggcccuccggcaccccggguucacggugaucgcccuguuccuggcccacgcgaucggcaccagcaucacccagaaggggaucaucuucauccuccugaugcuggucacccccuccauggccaugcgcugcgugggcaucggcagccgggacuucguggaggggcucuccggcgccacgugggucgacguggugcuggagcacgggagcugcgucaccaccauggccaaggacaagcccacccuggacaucgagcuccugaagacggaggugaccaaccccgccgugcugcgcaagcucugcaucgaggcgaagaucuccaacaccaccacggacagccggugcccgacccagggcgaggccacccuggucgaggagcaggacgccaacuucgugugccgccggaccuucguggaccgcggcugggggaacggcugcgggcuguucggcaaggggucccucaucacgugcgccaaguucaagugcgucaccaagcuggagggcaagaucgugcaguacgagaaccugaaguacagcgugaucgucaccgugcacaccggcgaccagcaccaggucgggaacgaguccacggagcacggcaccaccgccaccaucacgccccaggcgcccacgagcgagauccagcucaccgacuacggggcccugacccuggacugcagcccccggaccggccucgacuucaacgagauggugcugcugacgaugaaggagaaguccuggcucgugcacaagcagugguuccuggaccugccccuccccuggaccagcggggccuccaccagccaggagaccuggaaccgccaggaccugcuggucacguucaagaccgcccacgccaagaagcaggagguggugguccucggcucccaggagggcgcgaugcacaccgcccugaccggggccacggagauccagaccagcggcaccaccacgaucuucgccgggcaccugaagugccggcucaagauggacaagcugacccugaagggcauguccuacgugaugugcaccgggcuguucaagcuggagaaggagguggccgagacccagcacggcacgguccuggugcagaucaaguacgagggcaccgacgcgcccugcaagauccccuucagcacccaggacgagaagggggugacccagaacggccgccugaucacggccaacccgaucgucaccgacaaggagaagcccgugaacaucgaggccgagccgcccuucggggaguccuacaucgugaucggcgccggcgagaaggcgcucaagcugagcugguucaagaagggguccagcaucggcaagauguucgaggccaccgcccgcggggcccgccggauggccauccugggcgacaccgcgugggacuucggguccaucggcggcgucuucacgagcguggggaagcucgugcaccagaucuucggcaccgccuacgggguccuguucuccggcgugagcuggaccaugaagaucgggaucggcgugcugcucaccuggcugggccugaacucccgcagcacgucccucagcaugaccugcaucgccgucgggcuggugacccuguaccucggcgugaugguccaggccgacuccgggugcgugaucaacuggaagggccgcgagcugaagugcgggagcggcaucuucgugaccaacgagguccacacguggaccgagcaguacaaguuccaggccgacagcccgaagcggcuguccgcggccaucggcaaggccugggaggagggggugugcggcauccgcagcgccacccggcucgagaacaucauguggcgccagaucuccaacgagcugaaccacauccugcucgagaacgacaugaaguucaccguggucgugggggacguggucggcauccuggcccaggggaagaagaugauccggccccagcccauggagcacaaguacagcuggaaguccuggggcaaggcgaagaucaucggcgccgacgugcagaacaccacguucaucaucgacgggcccaacaccccggagugccccgacgaccagcgcgccuggaacaucugggagguggaggacuacggcuucgggaucuucaccaccaacaucuggcugaagcuccgggacagcuacacgcaggucugcgaccaccgccugauguccgccgcgaucaaggacagcaaggccgugcacgccgacaugggcuacuggaucgaguccgagaagaacgagaccuggaagcuggcccgggccagcuucaucgaggugaagaccugcaucuggcccaagucccacacccucuggagcaacggcguccuggaguccgagaugaucauccccaagaucuacgggggcccgaucagccagcacaacuaccgccccggguacuucacgcagaccgcgggccccuggcaccuggggaagcucgagcuggacuucgaccugugcgagggcaccaccgugguggucgacgagcacugcggcaaccgggggccgucccuccgcacgaccaccgugaccggcaagaucauccacgaguggugcugccggagcugcacgcugccgccccugcgcuucaagggggaggacggcugcugguacgggauggagauccggcccgugaaggagaaggaggagaaccucgucaaguccauggugagcgccggcagcggcgagguggacuccuucagccuggggcugcucugcaucuccaucaugaucgaggaggucaugcgcagccgguggucccgcaagaugcugaugaccggcacccuggccguguucuuccuccugaucauggggcagcugaccuggaacgaccucauccggagcugcaucauggugggcgccaacgccuccgaccgcauggggaugggcacgaccuaccuggcgcugauggccaccuucaagaugcgcccgauguucgccgucggccuccuguuccggcgccugaccagccgggaggugcuccugcugacgaucgggcucucccuggucgccagcguggagcugcccaacucccucgaggagcugggcgacgggcuggccaugggcaucaugauccucaagcugcugaccgacuuccagagcuaccagcucugggcgacccugcugucccucaccuucaucaagacgaccuucagccugcacuacgccuggaagaccauggccauggugcuguccaucgucagccuccugccccugugccucuccaccacgagccagaagaccaccuggcugcccgugcugcucggcucccuggggugcaagccgcugaccauguuccucaucgccgagaacaagaucuggggccgcaagagcuggccccugaacgaggggaucauggcggugggcaucgucagcauccugcucuccagccugcugaagaacgacgugccccucgccgggccccugaucgccggcggcaugcugaucgccugcuacgugaucuccgggagcuccgccgaccucagccuggagaaggcggccgaggucuccugggaggaggaggccgagcacagcggcgccucccacaacauccugguggaggugcaggacgacgggacgaugaagaucaaggacgaggagcgggacgacacccucaccauccugcugaaggccacccuccuggcggucagcggcguguacccgcuguccauccccgccacccucuucgugugguacuucuggcagaagaagaagcagcgcagcgggguccugugggacacgcccagcccgcccgagguggagcgggccgugcuggacgacggcaucuaccgcaucaugcagcggggccugcucgggcgcagccaggucggcguggggguguuccaggagaacgucuuccacaccauguggcacgugacccggggcgccgugcugauguaccaggggaagcgccuggagcccuccugggccagcgucaagaaggaccucaucuccuacggcggcggguggcggcugcagggcagcuggaacaccggggaggagguccaggugaucgcggucgagcccggcaagaaccccaagaacgugcagacggcccccgggaccuucaagacccccgagggcgaggugggcgccaucgcccuggacuucaagcccgggaccuccggcagccccaucgucaaccgcgaggggaagaucgugggccucuacggcaacgggguggucacgaccagcggcaccuacguguccgccaucgcgcaggccaaggccagccaggaggggccgcugcccgagaucgaggacgagguguuccggaagcgcaaccugaccaucauggaccuccaccccggcuccgggaagacgcggcgcuaccugccggccaucguccgggaggcgaucaagcgcaagcugcggacccucauccuggcccccacccgcgugguggccagcgagauggccgaggcccugaagggcaugcccauccgcuaccagaccacggcggucaaguccgagcacaccggccgggagaucguggaccucaugugccacgccaccuucaccaugcgccugcugagccccgugcgggucccgaacuacaacaugaucaucauggacgaggcccacuucacggaccccuccagcaucgccgcccgcggguacaucuccacccgggugggcaugggggaggcggccgccaucuucaugaccgccacgccgcccggcagcguggaggccuucccgcaguccaacgcggucauccaggacgaggagcgcgacauccccgagcggagcuggaacuccggguacgaguggaucacggacuuccccggcaagaccgugugguucgugcccagcaucaaguccggcaacgacaucgccaacugccuccgcaagaacgggaagcgggucauccagcugagccgcaagaccuucgacaccgaguaccagaagacgaagaacaacgacugggacuacguggugaccaccgacaucuccgagaugggcgccaacuuccgggccgaccgcgucaucgacccgcggcgcugccugaagcccgugauccucaaggacgggcccgagcgggucauccuggcgggccccaugccggugaccguggccagcgccgcccagcgccgggggcgcaucggccggaaccacaacaaggagggcgaccaguacaucuacauggggcagccccugaacaacgacgaggaccacgcccacuggacggaggcgaagaugcuccuggacaacaucaacacccccgagggcaucauccccgcccuguucgagccggagcgcgagaaguccgccgccaucgacggggaguaccgccuccggggcgaggcccgcaagaccuucgucgagcugaugcggcgcggggaccugcccguguggcucagcuacaagguggcgagcgagggcuuccaguacuccgaccggcgcuggugcuucgacggcgagcggaacaaccagguccuggaggagaacauggacguggagaucuggaccaaggagggggagcgcaagaagcugcggccccgcuggcucgacgcccggacguacagcgacccccuggcccugcgcgaguucaaggaguucgccgccggccggcgcuccgugagcggggaccucauccuggagaucggcaagcugccgcagcaccucacccagcgggcgcagaacgcccuggacaaccuggucaugcuccacaacuccgagcagggcgggcgcgccuaccggcacgccauggaggagcugcccgacaccaucgagacccugaugcuccuggcgcugaucgccgugcucacgggcggggugacccuguucuuccugagcggccgcgggcucggcaagaccuccaucggccugcugugcgucauggccagcuccgcccuccuguggauggccagcguggagccccacuggaucgcggccuccaucauccuggaguucuuccucauggugcugcugauccccgagccggaccggcagcgcacgccccaggacaaccagcucgccuacgucgugaucgggcugcuguucaugauccucaccguggccgccaacgagaugggccugcuggagacgaccaagaaggaccucgggaucggccacgucgcgguggagaaccaccaccacgccaccaugcuggacguggaccugcaccccgccagcgccuggacccucuacgccgucgcgacgaccaucaucaccccgaugaugcggcacaccaucgagaacacgaccgccaacaucucccugaccgccaucgccaaccaggccgcgauccugauggggcucgacaagggcuggcccaucagcaagauggacaucggcgugccccugcuggcccucgggugcuacucccaggugaacccccugacccugacggccgccguccucaugcugguggcgcacuacgccaucaucggcccggggcugcaggccaaggccacccgcgaggcccagaagcgcaccgcggccggcaucaugaagaaccccaccguggacgggaucgucgccaucgaccucgaccccgugguguacgacgccaaguucgagaagcagcugggccagaucaugcugcucauccugugcacgagccagauccugcucaugcggaccaccugggcccugugcgaguccaucacccuggcgacgggcccccucaccacccugugggaggggagcccgggcaaguucuggaacaccacgaucgccgucuccauggccaacaucuuccgcgggagcuaccuggccggcgccggccucgcguucagccugaugaagucccucgggggcgggcggcgcgggaccggggcccagggcgagacccucggcgagaaguggaagcggcagcugaaccagcugagcaaguccgaguucaacaccuacaagcgcagcgggaucauggagguggaccgguccgaggccaaggagggccuccgccgcggggagacgaccaagcacgccgugagccgcggcaccgcgaagcugcggugguucgucgagcgcaaccuggugaagcccgaggggaaggugaucgaccugggcugcggccgcggcgggugguccuacuacugcgccgggcucaagaaggucaccgaggugaagggguacacgaagggcggccccggccacgaggagcccaucccgauggccaccuacggguggaaccuggugaagcugcacagcggcaaggacgucuucuucaucccgcccgagaagugcgacacccuccugugcgacaucggggaguccagccccaacccgaccaucgaggagggccgcacgcugcgggugcucaagaugguggagcccuggcugcgcgggaaccaguucugcaucaagauccugaaccccuacaugcccuccgucguggagacccucgagcagaugcagcggaagcacggcggcaugcuggugcgcaacccgcugagccggaacuccacccacgagauguacugggucagcugcgggaccggcaacaucguguccgccgugaacaugaccagccgcaugcuccugaaccgcuucacgauggcccaccggaagcccaccuacgagcgcgacgucgaccugggggcgggcacccggcacguggccguggagcccgaggucgccaaccucgacaucaucggccagcgcaucgagaacaucaagcacgagcacaaguccaccuggcacuacgacgaggacaaccccuacaagacgugggccuaccacgggagcuacgaggugaagccguccggcagcgccagcuccauggucaacgggguggugaagcugcugaccaagcccugggacgucauccccauggugacccagaucgcgaugaccgacacgacccccuucggccagcagcggguguucaaggagaaggucgacacccgcaccccgaaggccaagcgggggacggcccagaucauggaggugaccgcccgcuggcucuggggcuuccugagccggaacaagaagccccgcaucugcacccgggaggaguucacccgcaaggugcgguccaacgccgcgaucggcgccgucuucguggacgagaaccaguggaacagcgccaaggaggccguggaggacgagcgcuucugggaccugguccaccgggagcgcgagcuccacaagcaggggaagugcgcgacgugcguguacaacaugaugggcaagcgggagaagaagcugggggaguucggcaaggccaaggggucccgcgccaucugguacauguggcugggcgcccgguuccucgaguucgaggcccugggcuucaugaacgaggaccacugguucagccgcgagaacucccugagcgggguggagggcgaggggcuccacaagcugggcuacauccugcgggacaucuccaagauccccgggggcaacauguacgcggacgacaccgccggcugggacacccgcaucaccgaggacgaccuccagaacgaggccaagaucacggacaucauggagccggagcacgcccugcuggccaccagcaucuucaagcucaccuaccagaacaaggucgugcgcgugcagcggcccgcgcgcaacgggaccgucauggacgugaucucccggcgcgaccagcggggcagcggccaggugggcacguacggccugaacaccuucaccaacauggaggcccagcugauccgccagauggaguccgaggggaucuucagccccuccgagcucgagacccccaaccuggccgagcggguccuggacuggcucgagaagcacggcguggagcgccugaagcggauggccaucagcggggacgacugcguggucaagccgaucgacgaccgcuucgccacggcgcuguccgcccucaacgacaugggcaaggugcggaaggacaucccccagugggagcccagcaagggguggaacgacuggcagcagguccccuucugcagccaccacuuccaccagcugaucaugaaggacggccgcgagaucgucgugccgugccggaaccaggacgagcuggugggccgcgcccgggucucccagggggccggcuggagccuccgcgagaccgccugccuggggaaguccuacgcgcagauguggcagcugauguacuuccaccggcgcgaccuccggcuggccgccaacgccaucugcagcgcggugcccguggacuggguccccaccaaccgcaccacgugguccauccacgcccaccaccaguggaugaccaccgaggacaugcugagcguguggaaccgcguguggaucgaggagaaccccuggauggaggacaagacccacaucuccagcuggggcgacgucccguaccucgggaagcgggaggaccaguggugcggcucccugaucggccugacggcccgcgccaccugggccaccaacauccagguggcgaucaaccaggugcggcgccucaucgggaacgagaacuaccuggacuacaugaccagcaugaagcgguucaagaacgacuccgaccccgagggcgcccugugguga

SEQ ID NO: 8335 - RNA, 9879 nt, Artificial Sequence
  derived and/or modified CDS sequence (opt1) from DENV-1__FJ024448__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaucaccuacaagugcccccgcaucaccgagaccgagcccgacgacguggacugcuggugcaacgccacggacaccugggucaccuacgggaccugcagccagacgggcgagcaccggcgcgacaagcgguccguggcccucgcgccccacgugggccuggggcuggagacccgcaccgagaccuggaugagcuccgagggcgccuggaagcagauccagcgggucgagacgugggcccuccgccaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugcggggcaugagcuacgucaugugcacgggguccuucaagcucgagaaggagguggccgagacccagcacggcaccgugcugguccagaucaaguacgagggcaccgacgcgcccugcaagauccccuucagcacgcaggacgagaagggggugacccagaacggccgccugaucaccgccaacccgaucgugaccgacaaggagaagcccgucaacaucgaggccgagccgcccuucggggaguccuacaucgugaucggcgccggcgagaaggcgcugaagcucagcugguucaagaagggguccagcaucggcaagauguucgaggccacggcccgcggggcccgccgcauggccauccugggcgacaccgcgugggacuucggguccaucggcggcguguucaccagcgucgggaagcuggugcaccagaucuucggcaccgccuacggggugcuguucuccggcgucagcuggacgaugaagaucgggaucggcgugcugcugaccuggcucggccugaacucccggagcaccucccugagcaugaccugcaucgccguggggcucgucacgcuguaccugggcgugauggugcaggccgacuccgggugcgucaucaacuggaagggccgcgagcucaagugcgggagcggcaucuucgugaccaacgaggugcacaccuggaccgagcaguacaaguuccaggccgacagcccgaagcggcuguccgcggccaucggcaaggccugggaggagggggucugcggcauccgcagcgccacccggcuggagaacaucauguggaagcagaucuccaacgagcucaaccacauccugcuggagaacgacaugaaguucacggugguggucggggacguggccggcauccucgcgcaggggaagaagaugauccgcccccagcccauggagcacaaguacagcuggaaguccuggggcaaggccaagaucaucggcgccgacgugcagaacaccaccuucaucaucgacgggcccaacaccccggagugccccgacgaccagcgggccuggaacaucugggaggucgaggacuacggcuucgggaucuucacgaccaacaucuggcugaagcugcgcgacagcuacacccaggugugcgaccaccggcucauguccgcggccaucaaggacagcaaggccgugcacgccgacaugggcuacuggaucgaguccgagaagaacgagaccuggaagcuggcccgcgcgagcuucaucgaggucaagacgugcaucuggcccaagucccacacccuguggagcaacggcgugcucgaguccgagaugaucauccccaagaucuacgggggcccgaucagccagcacaacuaccggcccggguacuucacccagaccgccggccccuggcaccuggggaagcuggagcucgacuucgaccugugcgagggcacgaccguggucguggacgagcacugcggcaaccgcgggccgucccugcggaccaccacggugaccggcaagaucauccacgaguggugcugccgcagcugcacccugccgccccuccgguuccgcggggaggacggcugcugguacgggauggagauccggcccgucaaggagaaggaggagaaccuggugaaguccauggugagcgccggcagcggcgaggucgacuccuucagccucgggcugcugugcaucuccaucaugaucgaggaggugaugcgcagccgguggucccgcaagaugcucaugaccggcacgcuggccguguucuuccugcucaucauggggcagcugaccuggaacgaccugauccgccucugcaucauggucggcgccaacgcgagcgaccggauggggaugggcaccaccuaccuggcccugauggccacguucaagaugcgcccgauguucgccgugggccuccuguuccggcgccugaccucccgggaggugcuccugcugaccaucgggcucagccuggucgccuccguggagcugcccaacagccucgaggagcugggcgacgggcuggcgaugggcaucaugauccucaagcugcugaccgacuuccagucccaccagcucugggccacgcugcugagccucaccuucaucaagaccaccuucucccugcacuacgccuggaagacgauggccaugguccugagcaucgugucccucuucccccugugccugagcaccaccucccagaagaccacguggcuccccgugcugcugggcagccucgggugcaagccgcugaccauguuccugaucgcggagaacaagaucuggggccgccgguccuggccccucaacgaggggaucauggccgucggcaucgugagcauccugcugagcucccuccugaagaacgacgugccccuggccgggccccucaucgccggcggcaugcugaucgccugcuacgucaucagcggguccagcgcggaccugucccucgagaaggccgccgaggugagcugggaggaggaggccgagcacuccggcgccagccacaacauccugguggagguccaggacgacgggaccaugaagaucaaggacgaggagcgcgacgacacccugaccauccuccugaaggcgacgcugcucgccgccuccggcguguacccgcugagcauccccgccacccuguucgugugguacuucuggcagaagaagaagcagcgguccgggguccucugggacacccccagcccgcccgagguggagcgcgccgugcuggacgacggcaucuaccggaucaugcagcgcggccugcuggggcggucccaggucggcguggggguguuccaggagaacgucuuccacaccauguggcacgugacgcgcggcgcggugcucauguaccaggggaagcggcuggagcccagcugggccuccgucaagaaggaccugaucagcuacggcggcggguggcgccuccagggcuccuggaacaccggggaggagguccaggugaucgccgucgagcccggcaagaaccccaagaacgugcagaccgcccccgggaccuucaagacgcccgagggcgaggugggcgccaucgcgcuggacuucaagcccgggaccagcggcucccccaucgucaaccgggaggggaagaucgugggccuguacggcaacgggguggucaccaccagcggcacguacgugagcgccaucgcccaggccaaggcgucccaggaggggccgcuccccgagaucgaggacgagguguuccgcaagcggaaccugaccaucauggaccugcaccccggcagcgggaagacccgccgguaccucccggccaucguccgcgaggccaucaagcgcaagcugcggacccugauccucgcccccacgcgcgugguggccuccgagauggcggaggcccugaagggcaugcccauccgguaccagaccaccgccgucaagagcgagcacaccggcaaggagaucguggaccugaugugccacgccacguucaccaugcgccuccugucccccgugcgggucccgaacuacaacaugaucaucauggacgaggcccacuucaccgaccccagcuccaucgcggcccgcggguacaucagcacccgggugggcaugggggaggccgccgccaucuucaugacggcgacgccgcccggcuccguggaggccuucccgcagagcaacgccgucauccaggacgaggagcgcgacauccccgagcgguccuggaacagcggguacgaguggaucaccgacuuccccggcaagaccgugugguucgugcccuccaucaagagcggcaacgacaucgccaacugccugcgcaagaacgggaagcgggucauccagcucucccgcaagacguucgacaccgaguaccagaagaccaagaacaacgacugggacuacguggugaccacggacaucagcgagaugggcgcgaacuuccgggccgaccgcgucaucgacccgcggcgcugccugaagcccgugauccugaaggacgggcccgagcgggugauccucgccggccccaugccggucaccguggccuccgccgcgcagcgccgggggcgcaucggccgcaaccacaacaaggagggcgaccaguacaucuacauggggcagccccugaacaacgacgaggaccacgcccacuggaccgaggccaagaugcugcucgacaacaucaacacccccgagggcaucauccccgcccuguucgagccggagcgggagaaguccgccgcgaucgacggggaguaccgccugcggggcgaggcccgcaagacguucgucgagcucaugcggcgcggggaccugcccguguggcuguccuacaagguggccagcgagggcuuccaguacagcgaccggcgcuggugcuucgacggcgagcggaacaaccagguccucgaggagaacauggacguggagaucuggaccaaggagggggagcgcaagaagcugcggccccgcuggcuggacgcccggaccuacuccgacccccucgcccugcgcgaguucaaggaguucgcggccggccggcgcagcguguccggggaccugauccucgagaucggcaagcugccgcagcaccugacccagcgggcccagaacgcccucgacaaccuggucaugcugcacaacagcgagcagggcgggcgcgcguaccggcacgccauggaggagcuccccgacacgaucgagacccugaugcugcucgcccugaucgccgugcugaccggcggggugacccucuucuuccuguccggccgcgggcugggcaagaccagcaucggccuccugugcgucauggccuccagcgugcugcucuggauggcguccguggagccccacuggaucgccgccagcaucauccuggaguucuuccugaugguccuccugauccccgagccggaccggcagcgcacgccccaggacaaccagcuggccuacguggugaucgggcuccuguucaugauccugaccgucgccgcgaacgagaugggccuccuggagaccaccaagaaggaccuggggaucggccacguggccguggagaaccaccaccacgccgccaugcucgacgucgaccugcaccccgccuccgcguggacgcuguacgccguggccaccaccaucaucaccccgaugaugcgccacacgaucgagaacaccaccgccaacaucagccucaccgccaucgcgaaccaggccgccauccugauggggcuggacaagggcuggcccaucuccaagauggacaucggcgugccccuccuggcccuggggugcuacagccaggucaacccccucacgcugaccgcggccgugcugaugcucguggcccacuacgccaucaucggcccggggcugcaggccaaggcgacccgggaggcccagaagcgcaccgccgccggcaucaugaagaaccccacggucgacgggaucguggccaucgaccuggaccccguggucuacgacgcgaaguucgagaagcagcucggccagaucaugcugcugauccucugcaccucccagauccugcugaugcggaccaccugggcccucugcgagagcaucacgcuggccaccggcccccugaccacccucugggagggguccccgggcaaguucuggaacacgaccaucgccgugagcauggccaacaucuuccgcggguccuaccuggcgggcgccggccuggccuucagccucaugaagucccucgggggcgggcggcgcgggaccggggcccagggcgagacccugggcgagaaguggaagcggcagcucaaccagcuguccaagagcgaguucaacacguacaagcgcuccgggaucauggagguggaccggagcgaggcgaaggagggccugaagcgcggggagaccaccaagcacgccgucucccggggcaccgccaagcuccgcugguucguggagcggaaccuggugaagcccgaggggaaggucaucgaccugggcugcggccgcgggggcuggagcuacuacugcgccgggcugaagaaggugacggaggugaagggcuacaccaagggcggccccggccacgaggagcccaucccgauggccaccuacggguggaaccucgucaagcugcacuccggcaaggacguguucuucaucccgcccgagaagugcgacacccugcucugcgacaucggggagagcucccccaacccgacgaucgaggagggccggacccugcgcgugcugaagauggucgagcccuggcuccgggggaaccaguucugcaucaagauccugaaccccuacaugcccagcgugguggagacccuggagcagaugcagcgcaagcacggcggcaugcucguccggaacccgcugucccgcaacagcacccacgagauguacuggguguccugcgggaccggcaacaucgugagcgcggucaacaugacgucccgcaugcugcucaaccgguucaccauggcccaccgcaagcccaccuacgagcgggacguggaccugggggccggcacccgccacguggccgucgagcccgagguggccaaccuggacaucaucggccagcggaucgagaacaucaagcacgagcacaagagcacguggcacuacgacgaggacaaccccuacaagaccugggcguaccacggguccuacgaggugaagccgagcggcuccgccagcagcauggucaacgggguggucaagcuccugaccaagcccugggacgugauccccauggugacccagaucgccaugacggacaccacccccuucggccagcagcgcgucuucaaggagaagguggacacccggacgccgaaggccaagcgcgggaccgcccagaucauggaggugaccgcgaaguggcuguggggcuuccucucccggaacaagaagccccgcaucugcacccgggaggaguucacgcgcaagguccggagcaacgccgccaucggcgccguguucguggacgagaaccaguggaacuccgcgaaggaggccgucgaggacgagcgcuucugggaccuggugcaccgggagcgcgagcugcacaagcaggggaagugcgcgaccugcguguacaacaugaugggcaagcgggagaagaagcucggggaguucggcaaggccaaggggagccgcgccaucugguacauguggcugggcgcgcgguuccuggaguucgaggcccucggcuucaugaacgaggaccacugguucucccgcgagaacagccuguccggggucgagggcgaggggcugcacaagcucggcuacauccugcgggacaucagcaagauccccgggggcaacauguacgccgacgacaccgccggcugggacacccgcaucacggaggacgaccugcagaacgaggcccgcaucaccgacaucauggagccggagcacgcgcuccuggccaaguccaucuucaagcugaccuaccagaacaagguggugcggguccagcgccccgccaagaacgggaccgugauggacgugaucagccggcgcgaccagcggggcuccgggcaggucggcacguacggccucaacaccuucaccaacauggaggcccagcugauccgccagauggagagcgaggggaucuucucccccagcgagcuggagacccccaaccucgccgagcgggugcuggacuggcuggagaaguacggcguggagcgccucaagcggauggcgaucuccggggacgacugcgucgugaagccgaucgacgaccgcuucgccacggcccugaccgcccugaacgacaugggcaaggugcggaaggacaucccccagugggagcccagcaagggguggaacgacuggcagcagguccccuucugcucccaccacuuccaccagcucaucaugaaggacggccgcgagaucguggugccgugccggaaccaggacgagcuggucggccgcgcccgggugagccagggggcgggcuggagccugcgcgagaccgccugccucgggaaguccuacgcccagauguggcagcugauguacuuccaccggcgcgaccugcggcucgccgcgaacgccaucugcagcgccgugcccgucgacuggauccccaccucccgcacgaccuggagcauccacgcccaccaccaguggaugaccaccgaggacaugcuguccguguggaaccgcguguggaucgaggagaaccccuggauggaggacaagacgcacaucagcuccuggggcgacgucccguaccuggggaagcgggaggaccaguggugcggcagccucaucggccugaccgcccgcgcgaccugggccaccaacauccagguggccaucaaccaggugcggcgccugaucgggaacgagaacuaccucgacuacaugaccuccaugaagcgguucaagaacgagagcgaccccgagggcgcccugugguga

SEQ ID NO: 8336 - RNA, 9879 nt, Artificial Sequence
  derived and/or modified CDS sequence (opt1) from DENV-1__FJ182026__SS-prME
agcgugaccaugcugcugaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgagaccgagcccgacgacguggacugcuggugcaacgccacggacaccugggucaccuacgggaccugcagccagacgggcgagcaccggcgggacaagcgguccguggcccucgcgccccacgugggccuggggcuggagacccgcaccgagaccuggaugagcuccgagggcgcguggaagcagauccagcgggucgagacgugggcccuccggcaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagcuggccgagacccagcacggcaccgugcuggugcagaucaaguacgagggcaccgacgcgcccugcaagauccccuucagcacgcagaacgagaagggggucacccagaacggccggcugaucaccgccaacccgaucgugaccgacaaggagaagcccgugaacaucgaggccgagccgcccuucggggaguccuacaucgucaucggcgccggcgagaaggcgcucaagcugagcugguucaagaagggguccagcaucggcaagauguucgaggccacggcccgcggggcccggcgcauggccauccugggcgacaccgcgugggacuucggguccaucggcggcguguucaccagcguggggaagcucguccaccagaucuucggcaccgccuacggggugcuguucuccggcgugagcuggacgaugaagaucgggaucggcguccugcucaccuggcugggccugaacucccgcagcaccucccucagcaugaccugcaucgccguggggcuggugacgcuguaccucggcgucauggugcaggccgacuccgggugcgugaucaacuggaagggccgggagcugaagugcgggagcggcaucuucgucaccaacgaggugcacaccuggaccgagcaguacaaguuccaggccgacagcccgaagcgccuguccgcggccaucggcaaggccugggaggagggggugugcggcauccggagcgccacccgccucgagaacaucauguggaagcagaucuccaacgagcugaaccacauccugcucgagaacgacaugaaguucacggucguggugggggacgucgccggcauccuggcgcaggggaagaagaugauccggccccagcccauggaguacaaguacagcuggaaguccuggggcaaggccaagaucaucggcgccgacgugcagaacaccaccuucaucaucgacgggcccaacaccccggagugccccgacgaccagcgcgccuggaacaucugggagguggaggacuacggcuucgggaucuucacgaccaacaucuggcugaagcuccgggacagcuacacccaggucugcgaccaccgccugauguccgcggccaucaaggacagcaaggccgugcacgccgacaugggcuacuggaucgaguccgagaagaacgagaccuggaagcuggcccgggcgagcuucaucgaggugaagacgugcaucuggcccaagucccacacccucuggagcaacggcguccuggaguccgagaugaucauccccaagaucuacgggggcccgaucagccagcacaacuaccgccccggguacuucacccagaccgccggccccuggcaccuggggaagcucgagcuggacuucgaccugugcgagggcacgaccgugguggucgacgagcacugcggcaaccgggggccgucccuccgcaccaccacggugaccggcaagaucauccacgaguggugcugccggagcugcacccugccgccccugcgcuuccgcggggaggacggcugcugguacgggauggagauccgccccgugaaggagaaggaggagaaccucgucaaguccauggugagcgccggcagcggcgagguggacuccuucagccuggggcugcucugcaucuccaucaugaucgaggaggucaugcggagccgcuggucccggaagaugcugaugaccggcacgcuggccguguucuuccuccugaucauggggcagcugaccuggaacgaccucauccgccugugcaucauggugggcgccaacgcgagcgaccgcauggggaugggcaccaccuaccuggcccucauggccacguucaagaugcggccgauguucgccgucggccugcuguuccgccggcucaccucccgcgaggugcugcugcucaccaucgggcugagccugguggccuccgucgagcuccccaacagccuggaggagcugggcgacgggcucgcgaugggcaucaugauccugaagcugcucaccgacuuccagucccaccagcugugggccacgcugcucagccugaccuucaucaagaccaccuucucccugcacuacgccuggaagacgauggccauggugcucagcaucgucucccuguucccccugugccucagcaccaccucccagaagaccacguggcugcccgugcugcucggcagccuggggugcaagccgcugaccauguuccucaucgcggagaacaagaucuggggccggcgcuccuggccccugaacgaggggaucauggccgugggcaucgucagcauccugcucagcucccugcugaagaacgacgugccccucgccgggccccugaucgccggcggcaugcugaucgccugcuacgugaucagcggguccagcgcggaccucucccuggagaaggccgccgaggucagcugggaggaggaggccgagcacuccggcgccagccacaacauccugguggaggugcaggacgacgggaccaugaagaucaaggacgaggagcgggacgacacccucaccauccugcugaaggcgacgcuccuggccgucuccggcguguacccgcugagcauccccgccacccucuucgugugguacuucuggcagaagaagaagcagcgcuccgggguccugugggacacccccagcccgcccgagguggagcgggccgugcuggacgacggcaucuaccgcaucaugcagcggggccugcucgggcgcucccaggucggcguggggguguuccaggagaacgucuuccacaccauguggcacgugacgcggggcgccgugcugauguaccaggggaagcgccuggagcccagcugggcguccgucaagaaggaccucaucagcuacggcggcggguggcggcugcagggcuccuggaacgccggggaggagguccaggugaucgccgucgagcccggcaagaaccccaagaacgugcagaccgcccccgggaccuucaagacccccgagggcgaggugggcgccaucgcgcuggacuucaagcccgggacgagcggcucccccaucgucaaccgcgaggggaagaucgugggccucuacggcaacgggguggucaccaccagcggcaccuacgugagcgccaucgcccaggccaaggcgucccaggaggggccgcugcccgagaucgaggacgagguguuccggaagcgcaaccugacgaucauggaccuccaccccggcagcgggaagacccggcgcuaccugccggccaucguccgggaggccaucaagcgcaagcugcgcacccucauccuggcccccacccgggugguggccuccgagauggcggaggcccugaagggcaugcccauccgcuaccagacgaccgccgucaagagcgagcacaccggcaaggagaucguggaccucaugugccacgccaccuucacgaugcggcugcugucccccgugcgcgucccgaacuacaacaugaucaucauggacgaggcccacuucaccgaccccagcuccaucgcggcccggggguacaucagcacccgcgugggcaugggggaggccgccgccaucuucaugaccgcgacgccgcccggcuccguggaggccuucccgcagagcaacgccgucauccaggacgaggagcgggacauccccgagcgcuccuggaacagcggguacgaguggaucaccgacuuccccggcaagaccgugugguucgugcccuccaucaagagcggcaacgacaucgccaacugccuccggaagaacgggaagcgcgucauccagcugucccggaagaccuucgacacggaguaccagaagaccaagaacaacgacugggacuacguggugaccaccgacaucagcgagaugggcgcgaacuuccgcgccgaccgggucaucgacccgcgccggugccugaagcccgugauccucaaggacgggcccgagcgcgugauccuggccggccccaugccggucacgguggccuccgccgcgcagcggcgcgggcggaucggccgcaaccacaacaaggagggcgaccaguacaucuacauggggcagccccugaacaacgacgaggaccacgcccacuggaccgaggccaagaugcuccuggacaacaucaacacccccgagggcaucauccccgcccuguucgagccggagcgcgagaaguccgccgcgaucgacggggaguaccggcuccgcggcgaggcccggaagaccuucgucgagcugaugcgccgcggggaccugcccguguggcucuccuacaagguggccagcgagggcuuccaguacagcgaccgccgguggugcuucgacggcgagcgcaacaaccagguccuggaggagaacauggacguggagaucuggacgaaggagggggagcggaagaagcugcgcccccgguggcucgacgcccgcaccuacuccgacccccuggcccugcgggaguucaaggaguucgcggccggccgccggagcguguccggggaccucauccuggagaucggcaagcugccgcagcaccucacccagcgcgcccagaacgcccuggacaaccuggucaugcuccacaacagcgagcagggcgggcgggcguaccgccacgccauggaggagcugcccgacaccaucgagacgcugaugcuccuggcccugaucgccgugcucaccggcggggugacccuguucuuccuguccggccgggggcucggcaagaccagcaucggccugcugugcgucauggccuccagcgugcuccuguggauggcguccguggagccccacuggaucgccgccagcaucauccuggaguucuuccucaugguccugcugauccccgagccggaccgccagcggacgccccaggacaaccagcucgccuacguggugaucgggcugcuguucaugauccucacggucgccgcgaacgagaugggccugcuggagaccaccaagaaggaccucgggaucggccacguggccguggagaaccaccaccacgccgccaugcuggacgucgaccugcaccccgccuccgcguggacccucuacgccguggccacgaccaucaucaccccgaugaugcgccacaccaucgagaacacgaccgccaacaucagccugaccgccaucgcgaaccaggccgccauccugauggggcucgacaagggcuggcccaucuccaagauggacaucggcgugccccugcuggcccucgggugcuacagccaggucaacccccugacccugacggcggccgugcucaugcugguggcccacuacgccaucaucggcccggggcugcaggccaaggcgacccgcgaggcccagaagcggaccgccgccggcaucaugaagaaccccaccgucgacgggaucguggccaucgaccucgaccccguggucuacgacgcgaaguucgagaagcagcugggccagaucaugcugcucauccugugcacgucccagauccugcucaugcgcaccaccugggcccugugcgagagcaucacccuggccacgggcccccucaccacccugugggagggguccccgggcaaguucuggaacaccacgaucgccgugagcauggccaacaucuuccggggguccuaccuggcgggcgccggccucgccuucagccugaugaagucccucgggggcgggcgccgggggaccggggcccagggcgagacccucggcgagaaguggaagcgccagcugaaccagcuguccaagagcgaguucaacaccuacaagcgguccgggaucauggagguggaccgcagcgaggcgaaggagggccucaagcgcggggagacgaccaagcacgccgucucccgcggcaccgccaagcugcggugguucguggagcgcaaccuggugaagcccgaggggaaggucaucgaccugggcugcggccgcgggggcuggagcuacuacugcgccgggcucaagaaggugaccgaggugaagggcuacacgaagggcggccccggccacgaggagcccaucccgauggccaccuacggguggaaccuggucaagcugcacuccggcaaggacguguucuucaucccgcccgagaagugcgacacccuccugugcgacaucggggagagcucccccaacccgaccaucgaggagggccgcacgcugcgggugcucaagauggucgagcccuggcugcgcgggaaccaguucugcaucaagauccugaaccccuacaugcccagcgugguggagacccucgagcagaugcagcggaagcacggcggcaugcugguccgcaacccgcugucccggaacagcacccacgagauguacuggguguccugcgggaccggcaacaucgugagcgcggucaacaugaccucccgcaugcuccugaaccgcuucacgauggcccaccggaagcccaccuacgagcgcgacguggaccugggggccggcacccggcacguggccgucgagcccgagguggccaaccucgacaucaucggccagcgcaucgagaacaucaagcacgagcacaagagcaccuggcacuacgacgaggacaaccccuacaagacgugggcguaccacggguccuacgaggugaagccgagcggcuccgccagcagcauggucaacgggguggucaagcugcugaccaagcccugggacgugauccccauggugacccagaucgccaugaccgacacgacccccuucggccagcagcgggucuucaaggagaagguggacacccgcaccccgaaggccaagcgggggacggcccagaucauggaggugaccgcgaaguggcucuggggcuuccugucccgcaacaagaagccccggaucugcacccgcgaggaguucacccggaagguccgcagcaacgccgccaucggcgccguguucguggacgagaaccaguggaacuccgcgaaggaggccgucgaggacgagcgguucugggaccuggugcaccgcgagcgggagcuccacaagcaggggaagugcgccacgugcguguacaacaugaugggcaagcgcgagaagaagcugggggaguucggcaaggccaaggggagccgggccaucugguacauguggcugggcgcgcgcuuccucgaguucgaggcccugggcuucaugaacgaggaccacugguucucccgggagaacagccuguccggggucgagggcgaggggcuccacaagcugggcuacauccugcgcgacaucagcaagauccccgggggcaacauguacgccgacgacaccgccggcugggacacccggaucaccgaggacgaccuccagaacgaggcccgcaucacggacaucauggagccggagcacgcgcugcuggccaaguccaucuucaagcucaccuaccagaacaagguggugcgcguccagcggcccgccaagaacgggaccgugauggacgugaucagccgccgggaccagcgcggcuccgggcaggucggcaccuacggccugaacacguucaccaacauggaggcccagcugauccggcagauggagagcgaggggaucuucucccccagcgagcucgagacccccaaccuggccgagcgcgugcuggacuggcucgagaaguacggcguggagcggcugaagcgcauggcgaucuccggggacgacugcgucgugaagccgaucgacgaccgguucgccaccgcccugacggcccucaacgacaugggcaaggugcgcaaggacaucccccagugggagcccagcaagggguggaacgacuggcagcagguccccuucugcucccaccacuuccaccagcugaucaugaaggacggccgggagaucguggugccgugccgcaaccaggacgagcuggucggccgggcccgcgugagccagggggcgggcuggagccuccgggagaccgccugccuggggaaguccuacgcccagauguggcagcugauguacuuccaccgccgggaccuccgccuggccgcgaacgccaucugcagcgccgugcccgucgacuggauccccaccucccggaccacguggagcauccacgcccaccaccaguggaugaccaccgaggacaugcuguccguguggaaccgcguguggaucgaggagaaccccuggauggaggacaagacccacaucagcuccuggggcgacgucccguaccucgggaagcgcgaggaccaguggugcggcagccugaucggccugacggcccgggcgaccugggccaccaacauccagguggccaucaaccaggugcgccggcucaucgggaacgagaacuaccuggacuacaugaccuccaugaagcgcuucaagaacgagagcgaccccgagggcgcccugugguga

SEQ ID NO: 8337 - RNA, 9879 nt, Artificial Sequence
  derived and/or modified CDS sequence (opt1) from DENV-1__FJ182027__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaucaccuacaagugcccccgcaucaccgagaccgagcccgacgacguggacugcuggugcaacgccacggacaccugggugaccuacgggaccugcagccagacgggcgagcaccggcgcgacaagcgguccguggcccucgcgccccacgugggccuggggcuggagacccgcaccgagaccuggaugagcuccgagggcgccuggaagcagauccagcgggucgagacgugggcccuccgccaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugcggggcaugagcuacgucaugugcacgggguccuucaagcucgagaaggagguggccgagacccagcacggcaccgugcugguccagaucaaguacgagggcaccgacgcgcccugcaagauccccuucagcacgcaggacgagaagggggugacccagaacggccgccugaucaccgccaacccgaucgugaccgacaaggagaagcccgucaacaucgaggccgagccgcccuucggggaguccuacaucgugaucggcgccggcgagaaggcgcugaagcucagcugguucaagaagggguccagcaucggcaagauguucgaggccacggcccgcggggcccgccgcauggccauccugggcgacaccgcgugggacuucggguccaucggcggcguguucaccagcgucgggaagcuggugcaccagaucuucggcaccgccuacggggugcuguucuccggcgucagcuggacgaugaagaucgggaucggcgugcugcugaccuggcucggccugaacucccggagcaccucccugagcaugaccugcaucgccguggggcucgucacgcuguaccugggcgugauggugcaggccgacuccgggugcgucaucaacuggaagggccgcgagcucaagugcgggagcggcaucuucgugaccaacgaggugcacaccuggaccgagcaguacaaguuccaggccgacagcccgaagcggcuguccgcggccaucggcaaggccugggaggagggggucugcggcauccgcagcgccacccggcuggagaacaucauguggaagcagaucuccaacgagcucaaccacauccugcuggagaacgacaugaaguucacggugguggucggggacguggccggcauccucgcgcaggggaagaagaugauccgcccccagcccauggagcacaaguacagcuggaaguccuggggcaaggccaagaucaucggcgccgacgugcagaacaccaccuucaucaucgacgggcccaacaccccggagugccccgacgaccagcgggccuggaacaucugggaggucgaggacuacggcuucgggaucuucacgaccaacaucuggcugaagcugcgcgacagcuacacccaggugugcgaccaccggcucauguccgcggccaucaaggacagcaaggccgugcacgccgacaugggcuacuggaucgaguccgagaagaacgagaccuggaagcuggcccgcgcgagcuucaucgaggucaagacgugcaucuggcccaagucccacacccuguggagcaacggcgugcucgaguccgagaugaucauccccaagaucuacgggggcccgaucagccagcacaacuaccggcccggguacuucacccagaccgccggccccuggcaccuggggaagcuggagcucgacuucgaccugugcgagggcacgaccguggucguggacgagcacugcggcaaccgcgggccgucccugcggaccaccacggugaccggcaagaucauccacgaguggugcugccgcagcugcacccugccgccccuccgguuccgcggggaggacggcugcugguacgggauggagauccggcccgucaaggagaaggaggagaaccuggugaaguccauggugagcgccggcagcggcgaggucgacuccuucagccucgggcugcugugcaucuccaucaugaucgaggaggugaugcgcagccgguggucccgcaagaugcucaugaccggcacgcuggccguguucuuccugcucaucauggggcagcugaccuggaacgaccugauccgccucugcaucauggucggcgccaacgcgagcgaccggauggggaugggcaccaccuaccuggcccugauggccacguucaagaugcgcccgauguucgccgugggccuccuguuccggcgccugaccucccgggaggugcuccugcugaccaucgggcucagccuggucgccuccguggagcugcccaacagccucgaggagcugggcgacgggcuggcgaugggcaucaugauccucaagcugcugaccgacuuccagucccaccagcucugggccacgcugcugagccucaccuucaucaagaccaccuucucccugcacuacgccuggaagacgauggccaugguccugagcaucgugucccucuucccccugugccugagcaccaccucccagaagaccacguggcuccccgugcugcugggcagccucgggugcaagccgcugaccauguuccugaucgcggagaacaagaucuggggccgccgguccuggccccucaacgaggggaucauggccgucggcaucgugagcauccugcugagcucccuccugaagaacgacgugccccuggccgggccccucaucgccggcggcaugcugaucgccugcuacgucaucagcggguccagcgcggaccugucccucgagaaggccgccgaggugagcugggaggaggaggccgagcacuccggcgccagccacaacauccugguggagguccaggacgacgggaccaugaagaucaaggacgaggagcgcgacgacacccugaccauccuccugaaggcgacgcugcucgccguguccggcguguacccgcugagcauccccgccacccuguucgucugguacuucuggcagaagaagaagcagcgguccggggugcucugggacacccccagcccgcccgagguggagcgcgccguccuggacgacggcaucuaccggaucaugcagcgcggccugcuggggcggucccaggugggcgugggggucuuccaggagaacguguuccacaccauguggcacgugacgcgcggcgccguccucauguaccaggggaagcggcuggagcccagcugggcguccgugaagaaggaccugaucagcuacggcggcggguggcgccuccagggcuccuggaacaccggggaggaggugcaggucaucgccguggagcccggcaagaaccccaagaacgugcagaccgcccccgggaccuucaagacgcccgagggcgaggucggcgccaucgcccuggacuucaagcccgggaccagcggcucccccaucgugaaccgggaggggaagaucgugggccuguacggcaacggggucgugaccaccagcggcacguacgugagcgcgaucgcccaggccaaggccucccaggaggggccgcuccccgagaucgaggacgaggucuuccgcaagcggaaccugaccaucauggaccugcaccccggcagcgggaagacccgccgguaccucccggcgaucgugcgcgaggccaucaagcgcaagcugcggacccugauccucgcccccacgcgcguggucgccuccgagauggccgaggcgcugaagggcaugcccauccgguaccagaccaccgccgucaagagcgagcacaccggcaaggagaucguggaccugaugugccacgccacguucaccaugcgccuccugucccccguccgggugccgaacuacaacaugaucaucauggacgaggcccacuucaccgaccccagcuccaucgccgcgcgcggguacaucagcacccgggugggcaugggggaggccgccgccaucuucaugacggccacgccgcccggcuccgucgaggcguucccgcagagcaacgccgugauccaggacgaggagcgcgacauccccgagcgguccuggaacagcggguacgaguggaucaccgacuuccccggcaagaccgugugguucguccccuccaucaagagcggcaacgacaucgccaacugccugcgcaagaacgggaagcgggugauccagcucucccgcaagacguucgacaccgaguaccagaagaccaagaacaacgacugggacuacguggucaccacggacaucagcgagaugggcgccaacuuccgggcggaccgcgugaucgacccgcggcgcugccugaagcccgugauccugaaggacgggcccgagcgggucauccucgccggccccaugccggugaccgucgccuccgccgcccagcgccgggggcgcaucggccgcaaccacaacaaggagggcgaccaguacaucuacauggggcagccccugaacaacgacgaggaccacgcgcacuggaccgaggccaagaugcugcucgacaacaucaacacccccgagggcaucauccccgcccuguucgagccggagcgggagaaguccgccgccaucgacggggaguaccgccugcggggcgaggcgcgcaagacguucguggagcucaugcggcgcggggaccugcccguguggcuguccuacaaggucgccagcgagggcuuccaguacagcgaccggcgcuggugcuucgacggcgagcggaacaaccaggugcucgaggagaacauggacguggagaucuggaccaaggagggggagcgcaagaagcugcggccccgcuggcuggacgcccggaccuacuccgacccccucgcccugcgcgaguucaaggaguucgccgcgggccggcgcagcgucuccggggaccugauccucgagaucggcaagcugccgcagcaccugacccagcgggcccagaacgcccucgacaaccuggugaugcugcacaacagcgagcagggcgggcgcgccuaccggcacgcgauggaggagcuccccgacacgaucgagacccugaugcugcucgcccugaucgccgugcugaccggcggggucacccucuucuuccuguccggccgcgggcugggcaagaccagcaucggccuccugugcgugauggccuccagcgugcugcucuggauggccuccgucgagccccacuggaucgcggccagcaucauccuggaguucuuccugauggugcuccugauccccgagccggaccggcagcgcacgccccaggacaaccagcuggccuacguggucaucgggcuccuguucaugauccugaccguggccgccaacgagaugggccuccuggagaccaccaagaaggaccuggggaucggccacguggcggucgagaaccaccaccacgccgccaugcucgacguggaccugcaccccgccuccgccuggacgcuguacgcgguggccaccaccaucaucaccccgaugaugcgccacacgaucgagaacaccaccgccaacaucagccucaccgccaucgccaaccaggcggccauccugauggggcuggacaagggcuggcccaucuccaagauggacaucggcgucccccuccuggcccuggggugcuacagccaggugaacccccucacgcugaccgccgcggugcugaugcucgucgcccacuacgccaucaucggcccggggcugcaggccaaggccacccgggaggcgcagaagcgcaccgccgccggcaucaugaagaaccccacgguggacgggaucguggccaucgaccuggaccccgucguguacgacgccaaguucgagaagcagcucggccagaucaugcugcugauccucugcaccucccagauccugcugaugcggaccaccugggcgcucugcgagagcaucacgcuggccaccggcccccugaccacccucugggagggguccccgggcaaguucuggaacacgaccaucgccgugagcauggccaacaucuuccgcggguccuaccuggccggcgcgggccuggccuucagccucaugaagucccucgggggcgggcggcgcgggaccggggcccagggcgagacccugggcgagaaguggaagcggcagcucaaccagcuguccaagagcgaguucaacacguacaagcgcuccgggaucauggaggucgaccggagcgaggccaaggagggccugaagcgcggggagaccaccaagcacgcggugucccggggcaccgccaagcuccgcugguucguggagcggaaccuggucaagcccgaggggaaggugaucgaccugggcugcggccgcgggggcuggagcuacuacugcgccgggcugaagaaggugacggaggucaagggcuacaccaagggcgggcccggccacgaggagcccaucccgauggccaccuacggguggaaccucgugaagcugcacuccggcaaggacguguucuucaucccgcccgagaagugcgacacccugcucugcgacaucggggagagcucccccaacccgacgaucgaggagggccggacccugcgcguccugaagaugguggagcccuggcuccgggggaaccaguucugcaucaagauccugaaccccuacaugcccagcguggucgagacccuggagcagaugcagcgcaagcacggcggcaugcucgugcggaacccgcugucccgcaacagcacccacgagauguacuggguguccugcgggaccggcaacaucgucagcgccgugaacaugacgucccgcaugcugcucaaccgguucaccauggcgcaccgcaagcccaccuacgagcgggacguggaccugggggccggcacccgccacgucgccguggagcccgagguggccaaccuggacaucaucggccagcggaucgagaacaucaagcacgagcacaagagcacguggcacuacgacgaggacaaccccuacaagaccugggccuaccacggguccuacgaggucaagccgagcggcuccgcgagcagcauggugaacggggucgugaagcuccugaccaagcccugggacgugauccccauggucacccagaucgccaugacggacaccacccccuucggccagcagcgcguguucaaggagaagguggacacccggacgccgaaggccaagcgcgggaccgcccagaucauggaggucaccgccaaguggcuguggggcuuccucucccggaacaagaagccccgcaucugcacccgggaggaguucacgcgcaaggugcggagcaacgcggccaucggcgccguguucgucgacgagaaccaguggaacuccgccaaggaggcgguggaggacgagcgcuucugggaccuggugcaccgggagcgcgagcugcacaagcaggggaagugcgcgaccugcgucuacaacaugaugggcaagcgggagaagaagcucggggaguucggcaaggccaaggggagccgcgccaucugguacauguggcugggcgcccgguuccuggaguucgaggcgcucggcuucaugaacgaggaccacugguucucccgcgagaacagccuguccgggguggagggcgaggggcugcacaagcucggcuacauccugcgggacaucagcaagauccccgggggcaacauguacgccgacgacaccgccggcugggacacccgcaucacggaggacgaccugcagaacgaggcccgcaucaccgacaucauggagccggagcacgcccuccuggcgaaguccaucuucaagcugaccuaccagaacaaggugguccgggugcagcgccccgccaagaacgggaccgugauggacgucaucagccggcgcgaccagcggggcuccggccaggugggcacguacggccucaacaccuucaccaacauggaggcccagcugauccgccagauggagagcgaggggaucuucucccccagcgagcuggagacccccaaccucgccgagcgggugcuggacuggcuggagaaguacggcgucgagcgccucaagcggauggccaucuccggggacgacugcguggugaagccgaucgacgaccgcuucgcgacggcccugaccgcccugaacgacaugggcaagguccggaaggacaucccccagugggagcccagcaagggguggaacgacuggcagcagguccccuucugcucccaccacuuccaccagcucaucaugaaggacggccgcgagaucguggucccgugccggaaccaggacgagcuggugggccgcgcccgggugagccagggggccggcuggagccugcgcgagaccgcgugccucgggaaguccuacgcccagauguggcagcugauguacuuccaccggcgcgaccugcggcucgccgccaacgcgaucugcagcgccguccccguggacuggauccccaccucccgcacgaccuggagcauccacgcccaccaccaguggaugaccaccgaggacaugcuguccguguggaaccgcgucuggaucgaggagaaccccuggauggaggacaagacgcacaucagcuccuggggcgacgugccguaccuggggaagcgggaggaccaguggugcggcagccucaucggccugaccgcccgcgccaccugggcgaccaacauccagguggccaucaaccagguccggcgccugaucgggaacgagaacuaccucgacuacaugaccuccaugaagcgguucaagaacgagagcgaccccgagggcgcccugugguga

SEQ ID NO: 8338 - RNA, 9879 nt, Artificial Sequence
  derived and/or modified CDS sequence (opt1) from DENV-1__FJ024449__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgagaccgagcccgacgacguggacugcuggugcaacgccacggacaccugggucaccuacgggaccugcagccagacgggcgagcaccggcgggacaagcgguccguggcccucgcgccccacgugggccuggggcuggagacccgcaccgagaccuggaugagcuccgagggcgccuggaagcagauccagcgggucgagacgugggcccuccggcaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagguggccgagacccagcacggcaccgugcugguccagaucaaguacgagggcaccgacgcgcccugcaagauccccuucagcacgcaggacgagaagggggugacccagaacggccggcugaucaccgccaacccgaucgugaccgacaaggagaagcccgucaacaucgaggccgagccgcccuucggggaguccuacaucaucaucggcgccggcgagaaggcgcugaagcucagcugguucaagaagggguccagcaucggcaagauguucgaggccacggcccgcggggcccggcgcauggccauccugggcgacaccgcgugggacuucggguccaucggcggcguguucaccagcguggggaagcugguccaccagaucuucggcaccgccuacggggugcuguucuccggcgugagcuggacgaugaagaucgggaucggcguccugcugaccuggcucggccugaacucccgcagcaccucccugagcaugaccugcaucgccguggggcucgugacgcuguaccugggcgucauggugcaggccgacuccgggugcgugaucaacuggaagggccgggagcucaagugcgggagcggcaucuucgucaccaacgaggugcacaccuggaccgagcaguacaaguuccaggccgacagcccgaagcgccuguccgcggccaucggcaaggccugggaggagggggugugcggcauccggagcgccacccgccuggagaacaucauguggaagcagaucuccaacgagcucaaccacauccugcuggagaacgacaugaaguucacggucguggugggggacgucgccggcauccucgcgcaggggaagaagaugauccggccccagcccauggaguacaaguacagcuggaaguccuggggcaaggccaagaucaucggcgccgacgugcagaacaccaccuucaucaucgacgggcccaacaccccggagugccccgacgaccagcgcgccuggaacaucugggagguggaggacuacggcuucgggaucuucacgaccaacaucuggcugaagcugcgggacagccacacccaggucugcgaccaccgccucauguccgcggccaucaaggacagcaaggccgugcacgccgacaugggcuacuggaucgaguccgagaagaacgagaccuggaagcuggcccgggcgagcuucaucgaggugaagacgugcaucuggcccaagucccacacccuguggagcaacggcguccucgaguccgagaugaucauccccaagaucuacgggggcccgaucagccagcacaacuaccgccccggguacuucacccagaccgccggccccuggcaccuggggaagcuggagcucgacuucgaccugugcgagggcacgaccgugguggucgacgagcacugcggcaaccgggggccgucccugcgcaccaccacggugaccggcaagaucauccacgaguggugcugccggagcugcacccugccgccccuccgcuuccgcggggaggacggcugcugguacgggauggagauccgccccgugaaggagaaggaggagaaccuggucaaguccauggugagcgccggcagcggcgagguggacuccuucagccucgggcugcugugcaucuccaucaugaucgaggaggucaugcggagccgcuggucccggaagaugcucaugaccggcacgcuggccguguucuuccugcucaucauggggcagcugaccuggaacgaccugauccgccucugcaucauggugggcgccaacgcgagcgaccgcauggggaugggcaccaccuaccuggcccugauggccacguucaagaugcggccgauguucgccgucggccuccuguuccgccggcugaccucccgcgaggugcuccugcugaccaucgggcucagccugguggccuccgucgagcugcccaacagccucgaggagcugggcgacgggcuggcgaugggcaucaugauccucaagcugcugaccgacuuccagucccaccagcucugggccacgcugcugagccucaccuucaucaagaccaccuucucccugcacuacgccuggaagacgauggccauggugcugagcaucgucucccucuucccccugugccugagcaccaccucccagaagaccacguggcuccccgugcugcugggcagccucgggugcaagccgcugaccauguuccugaucgcggagaacaagaucuggggccggcgcuccuggccccucaacgaggggaucauggccgugggcaucgucagcauccugcugagcucccuccugaagaacgacgugccccuggccgggccccucaucgccggcggcaugcugaucgccugcuacgugaucagcggguccagcgcggaccugucccucgagaaggccgccgaggucagcugggaggaggaggccgagcacuccggcgccagccacaacauccugguggaggugcaggacgacgggaccaugaagaucaaggacgaggagcgggacgacacccugaccauccuccugaaggcgacgcugcucgccgucuccggcguguacccgcugagcauccccgccacccuguucgugugguacuucuggcagaagaagaagcagcgcuccgggguccucugggacacccccagcccgcccgagguggagcgggccgugcuggacgacggcaucuaccgcaucaugcagcggggccugcuggggcgcucccaggucggcguggggguguuccaggagaacgucuuccacaccauguggcacgugacgcggggcgccgugcucauguaccaggggaagcgccuggagcccagcugggcguccgucaagaaggaccugaucagcuacggcggcggguggcggcuccagggcuccuggaacaccggggaggagguccaggugaucgccgucgagcccggcaagaaccccaagaacgugcagaccgcccccgggaccuucaagacgcccgagggcgaggugggcgccaucgcccuggacuucaagcccgggaccagcggcucccccaucgucaaccgcgaggggaagaucgugggccuguacggcaacgggguggucaccaccagcggcacguacgugagcgcgaucgcccaggccaaggccucccaggaggggccgcuccccgagaucgaggacgagguguuccggaagcgcaaccugaccaucauggaccugcaccccggcagcgggaagacccggcgcuaccucccggcgaucguccgggaggccaucaagcgcaagcugcgcacccugauccucgcccccacgcgggugguggccuccgagauggccgaggcgcugaagggcaugcccauccgcuaccagaccaccgccgucaagagcgagcacaccggcaaggagaucguggaccugaugugccacgccacguucaccaugcggcuccugucccccgugcgcgucccgaacuacaacaugaucaucauggacgaggcccacuucaccgaccccagcuccaucgccgcgcggggguacaucagcacccgcgugggcaugggggaggccgccgccaucuucaugacggccacgccgcccggcuccguggaggcguucccgcagagcaacgccgucauccaggacgaggagcgggacauccccgagcgcuccuggaacagcggguacgaguggaucaccgacuuccccggcaagaccgugugguucgugcccuccaucaagagcggcaacgacaucgccaacugccugcggaagaacgggaagcgcgucauccagcucucccggaagacguucgacaccgaguaccagaagaccaagaacaacgacugggacuacguggugaccacggacaucagcgagaugggcgccaacuuccgcgcggaccgggucaucgacccgcgccggugccugaagcccgugauccugaaggacgggcccgagcgcgugauccucgccggccccaugccggucaccguggccuccgccgcccagcggcgcgggcggaucggccgcaaccacaacaaggagggcgaccaguacaucuacauggggcagccccugaacaacgacgaggaccacgcgcacuggaccgaggccaagaugcugcucgacaacaucaacacccccgagggcaucauccccgcccuguucgagccggagcgcgagaaguccgccgccaucgacggggaguaccggcugcgcggcgaggcgcggaagacguucgucgagcucaugcgccgcggggaccugcccguguggcuguccuacaagguggccagcgagggcuuccaguacagcgaccgccgguggugcuucgacggcgagcgcaacaaccagguccucgaggagaacauggacguggagaucuggaccaaggagggggagcggaagaagcugcgcccccgguggcuggacgcccgcaccuacuccgacccccucgcccugcgggaguucaaggaguucgccgcgggccgccggagcguguccggggaccugauccucgagaucggcaagcugccgcagcaccugacccagcgcgcccagaacgcccucgacaaccuggucaugcugcacaacagcgagcagggcgggcgggccuaccgccacgcgauggaggagcuccccgacacgaucgagacccugaugcugcucgcccugaucgccgugcugaccggcggggugacccucuucuuccuguccggccgggggcugggcaagaccagcaucggccuccugugcgucauggccuccagcgugcugcucuggauggccuccguggagccccacuggaucgcggccagcaucauccuggaguucuuccugaugguccuccugauccccgagccggaccgccagcggacgccccaggacaaccagcuggccuacguggugaucgggcuccuguucaugauccugaccgucgccgccaacgagaugggccuccuggagaccaccaagaaggaccuggggaucggccacguggcgguggagaaccaccaccacgccgccaugcucgacgucgaccugcaccccgccuccgccuggacgcuguacgcgguggccaccaccaucaucaccccgaugaugcgccacacgaucgagaacaccaccgccaacaucagccucaccgccaucgccaaccaggcggccauccugauggggcuggacaagggcuggcccaucuccaagauggacaucggcgugccccuccuggcccuggggugcuacagccaggucaacccccucacgcugaccgccgcggugcugaugcucguggcccacuacgccaucaucggcccggggcugcaggccaaggccacccgcgaggcgcagaagcggaccgccgccggcaucaugaagaaccccacggucgacgggaucguggccaucgaccuggaccccguggucuacgacgccaaguucgagaagcagcucggccagaucaugcugcugauccucugcaccucccagauccugcugaugcgcaccaccugggcgcucugcgagagcaucacgcuggccaccggcccccugaccacccucugggagggguccccgggcaaguucuggaacacgaccaucgccgugagcauggccaacaucuuccggggguccuaccuggccggcgcgggccuggccuucagccucaugaagucccucgggggcgggcgccgggggaccggggcccagggcgagacccugggcgagaaguggaagcgccagcucaaccagcuguccaagagcgaguucaacacguacaagcgguccgggaucauggagguggaccgcagcgaggccaaggagggccugaagcgcggggagaccaccaagcacgcggucucccgcggcaccgccaagcuccggugguucguggagcgcaaccuggugaagcccgaggggaaggucaucgaccugggcugcggccgcgggggcuggagcuacuacugcgccgggcugaagaaggugacggaggugaagggcuacaccaagggcggccccggccacgaggagcccaucccgauggccaccuacggguggaaccucgucaagcugcacuccggcaaggacguguucuucaucccgcccgagaagugcgacacccugcucugcgacaucggggagagcucccccaacccgacgaucgaggagggccgcacccugcgggugcugaagauggucgagcccuggcuccgcgggaaccaguucugcaucaagauccugaaccccuacaugcccagcgugguggagacccuggagcagaugcagcggaagcacggcggcaugcucguccgcaacccgcugucccggaacagcacccacgagauguacuggguguccugcgggaccggcaacaucgugagcgccgucaacaugacgucccgcaugcugcucaaccgcuucaccauggcgcaccggaagcccaccuacgagcgcgacguggaccugggggccggcacccggcacguggccgucgagcccgagguggccaaccuggacaucaucggccagcgcaucgagaacaucaagcacgagcacaagagcacguggcacuacgacgaggacaaccccuacaagaccugggccuaccacggguccuacgacgugaagccgagcggcuccgcgagcagcauggucaacgggguggucaagcuccugaccaagcccugggacgugauccccauggugacccagaucgccaugacggacaccacccccuucggccagcagcgggucuucaaggagaagguggacacccgcacgccgaaggccaagcgggggaccgcccagaucauggaggugaccgccaaguggcuguggggcuuccucucccgcaacaagaagccccggaucugcacccgcgaggaguucacgcggaagguccgcagcaacgcggccaucggcgccguguucguggacgagaaccaguggaacuccgccaaggaggcggucgaggacgagcgguucugggaccuggugcaccgcgagcgggagcugcacaagcaggggaagugcgcgaccugcguguacaacaugaugggcaagcgcgagaagaagcucggggaguucggcaaggccaaggggagccgggccaucugguacauguggcugggcgcccgcuuccuggaguucgaggcgcucggcuucaugaacgaggaccacugguucucccgggagaacagccuguccggggucgagggcgaggggcugcacaagcucggcuacauccugcgcgacaucagcaagauccccgggggcaacauguacgccgacgacaccgccggcugggacacccggaucacggaggacgaccugcagaacgaggcccgcaucaccgacaucauggagccggagcacgcccuccuggcgaaguccaucuucaagcugaccuaccagaacaagguggugcgcguccagcggcccgccaagaacgggaccgugauggacgugaucagccgccgggaccagcgcggcuccgggcaggucggcacguacggccucaacaccuucaccaacauggaggcccagcugauccggcagauggagagcgaggggaucuucucccccagcgagcuggagacccccaaccucgccgagcgcgugcuggacuggcugaagaaguacggcguggagcggcucaagcgcauggccaucuccggggacgacugcgucgugaagccgaucgacgaccgguucgcgacggcccugaccgcccugaacgacaugggcaaggugcgcaaggacaucccccagugggagcccagcaagggguggaacgacuggcagcagguccccuucugcucccaccacuuccaccagcucaucaugaaggacggccgggagaucguggugccgugccgcaaccaggacgagcuggucggccgggcccgcgugagccagggggccggcuggagccugcgggagaccgcgugccucgggaaguccuacgcccagauguggcagcugauguacuuccaccgccgggaccugcgccucgccgccaacgcgaucugcagcgccgugcccgucgacuggauccccaccucccggacgaccuggagcauccacgcccaccaccaguggaugaccaccgaggacaugcuguccguguggaaccgcguguggaucgaggagaaccccuggauggaggacaagacgcacaucagcuccuggggcgacgucccguaccuggggaagcgcgaggaccaguggugcggcagccucaucggccugaccgcccgggccaccugggcgaccaacauccagguggccaucaaccaggugcgccggcugaucgggaacgagaacuaccucgacuacaugaccuccaugaagcgcuucaagaacgagggcgaccccgagggggcccugugguga

SEQ ID NO: 8339 - RNA, 9879 nt, Artificial Sequence
  derived and/or modified CDS sequence (opt1) from DENV-1__FJ390383__SS-prME
agcgugaccaugcugcugaugcugaugcccaccgcccuggccuuccaccucaccacccggggcggggagccccacaugaucgugagcaagcaggagcggggcaagagccugcuguucaagaccuccgccggggugaacaugugcacccucaucgccauggaccugggcgagcugugcgaggacaccaugaccuacaagugcccccggaucaccgagaccgagcccgacgacguggacugcuggugcaacgccacggacaccugggucaccuacgggaccugcagccagacgggcgagcaccggcgggacaagcgguccguggcccucgcgccccacgugggccuggggcuggagacccgcaccgagaccuggaugagcuccgagggcgcguggaagcagauccagcgggucgagacgugggcccuccggcaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagguggccgagacccagcacggcaccgugcugguccagaucaaguacgagggcaccgacgcgcccugcaagauccccuuccugacgcaggacgagaagggggugacccagaacggccggcugaucaccgccaacccgaucgugaccgacaaggagaagcccgucaacaucgaggccgagccgcccuucggggagagcuacaucaucaucggcgccggcgagaaggcgcucaagcuguccugguucaagaaggggagcuccaucggcaagauguucgaggccacggcccgcggggcccggcgcauggccauccugggcgacaccgcgugggacuucgggagcaucggcggcguguucaccuccguggggaagcucguccaccagaucuucggcaccgccuacggggugcuguucagcggcguguccuggacgaugaagaucgggaucggcguccugcucaccuggcugggccugaacagccgcuccaccagccucuccaugaccugcaucgccguggggcuggugacgcuguaccucggcgucauggugcaggccgacagcgggugcgugaucaacuggaagggccgggagcugaagugcggguccggcaucuucgucaccaacgaggugcacaccuggaccgagcaguacaaguuccaggccgacagcccgaagcgccugagcgcggccaucggcaaggccugggaggagggggugugcggcauccgguccgccacccgccucgagaacaucauguggaagcagaucagcaacgagcugaaccacauccugcucgagaacgacaugaaguucacggucguggugggggacgucgccggcauccuggcgcaggggaagaagaugauccggccccagcccauggaguacaaguacuccuggaaguccuggggcaaggccaagaucaucggcgccgacgugcagaacaccaccuucaucaucgacgggcccaacaccccggagugccccgacgaccagcgcgccuggaacaucugggagguggaggacuacggcuucgggaucuucacgaccaacaucuggcugaagcuccgggacuccuacacccaggucugcgaccaccgccugaugagcgcggccaucaaggacuccaaggccgugcacgccgacaugggcuacuggaucgagagcgagaagaacgagaccuggaagcuggcccgggcguccuucaucgaggugaagacgugcaucuggcccaagagccacacccucugguccaacggcguccuggagagcgagaugaucauccccaagaucuacgggggcccgaucucccagcacaacuaccgccccggguacuucacccagaccgccggccccuggcaccuggggaagcucgagcuggacuucgaccugugcgagggcacgaccgugguggucgacgagcacugcggcaaccgggggccgagccuccgcaccaccacggugaccggcaagaucauccacgaguggugcugccgguccugcacccugccgccccugcgcuuccgcggggaggacggcugcugguacgggauggagauccgccccgugaaggagaaggaggagaaccucgucaagagcaugguguccgccggcagcggcgagguggacagcuucucccuggggcugcucugcaucagcaucaucaucgaggaggucaugcggucccgcuggagccggaagaugcugaugaccggcacgcuggccguguucuuccuccugaucauggggcagcugaccuggaacgaccucauccgccugugcaucauggugggcgccaacgcguccgaccgcauggggaugggcaccaccuaccuggcccucauggccacguucaagaugcggccgauguucgccgucggccugcuguuccgccggcucaccagccgcgaggugcugcugcucaccaucgggcugucccugguggccagcgucgagcuccccaacucccuggaggagcugggcgacgggcucgcgaugggcaucaugauccugaagcugcucaccgacuuccagagccaccagcugugggccacgcugcucucccugaccuucaucaagaccaccuucagccugcacuacgccuggaagacgauggccauggugcucuccaucgucagccuguucccccugugccucuccaccaccagccagaagaccacguggcugcccgugcugcucggcucccuggggugcaagccgcugaccauguuccucaucgcggagaacaagaucuggggccggcgcagcuggccccugaacgaggggaucauggccgugggcaucgucuccauccugcucagcagccugcugaagaacgacgagccccucgccgggccccugaucgccggcggcaugcugaucgccugcuacgugaucuccgggagcuccgcggaccucagccuggagaaggccgccgagguguccugggaggaggaggccgagcacagcggcgccucccacaacauccuggucgaggugcaggacgacgggaccaugaagaucaaggacgaggagcgggacgacacccucaccauccugcugaaggcgacgcuccuggccgugagcggcgucuacccgcuguccauccccgccacccucuucgugugguacuucuggcagaagaagaagcagcgcagcggggugcugugggacacccccagcccgcccgaggucgagcgggccgugcuggacgacggcaucuaccgcaucaugcagcggggccugcucgggcgcagccaggugggcgucgggguguuccaggagaacguguuccacaccauguggcacgucacgcggggcgccgugcugauguaccaggggaagcgccuggagcccuccugggcgagcgugaagaaggaccucaucuccuacggcggcggguggcggcugcagggcagcuggaacaccggggaggagguccaggugaucgccguggagcccggcaagaaccccaagaacguccagaccgcccccgggaccuucaagacgcccgagggcgaggugggcgccaucgcccuggacuucaagcccgggaccuccggcagccccaucgugaaccgcgaggggaagaucgucggccucuacggcaacgggguggugaccaccuccggcacguacgucagcgcgaucgcccaggccaaggccagccaggaggggccgcugcccgagaucgaggacgagguguuccggaagcgcaaccugaccaucauggaccuccaccccggcuccgggaagacccggcgcuaccugccggcgaucgugcgggaggccaucaagcgcaagcugcgcacccucauccuggcccccacgcgggucguggccagcgagauggccgaggcgcugaagggcaugcccauccgcuaccagaccaccgccgugaaguccgagcacaccggcaaggagaucgucgaccucaugugccacgccacguucaccaugcggcugcugagccccgugcgcgugccgaacuacaacaugaucaucauggacgaggcccacuucaccgaccccuccagcaucgccgcgcggggguacaucuccacccgcgucggcaugggggaggccgccgccaucuucaugacggccacgccgcccggcagcguggaggcguucccgcaguccaacgccgugauccaggacgaggagcgggacauccccgagcgcagcuggaacuccggguacgaguggaucaccgacuuccccggcaagaccgucugguucgugcccagcaucaaguccggcaacgacaucgccaacugccuccggaagaacgggaagcgcgugauccagcugagccggaagacguucgacaccgaguaccagaagaccaagaacaacgacugggacuacgucgugaccacggacaucuccgagaugggcgccaacuuccgcgcggaccgggugaucgacccgcgccggugccugaagcccgucauccucaaggacgggcccgagcgcgugauccuggccggccccaugccggugaccgucgccagcgccgcccagcggcgcgggcggaucggccgcaaccacaacaaggagggcgaccaguacaucuacauggggcagccccugaacaacgacgaggaccacgcgcacuggaccgaggccaagaugcuccuggacaacaucaacacccccgagggcaucauccccgcccuguucgagccggagcgcgagaaguccgccgccaucgacggggaguaccggcuccgcggcgaggcgcggaagacguucguggagcugaugcgccgcggggaccugcccgucuggcucagcuacaagguggccuccgagggcuuccaguacagcgaccgccgguggugcuucgacggcgagcgcaacaaccaggugcuggaggagaacauggacgucgagaucuggaccaaggagggggagcggaagaagcugcgcccccgguggcucgacgcccgcaccuacagcgacccccuggcccugcgggaguucaaggaguucgccgcgggccgccgguccgugagcggggaccucauccuggagaucggcaagcugccgcagcaccucacccagcgcgcccagaacgcccuggacaaccuggugaugcuccacaacuccgagcagggcgggcgggccuaccgccacgcgauggaggagcugcccgacacgaucgagacccugaugcuccuggcccugaucgccguccucaccggcggggugacccuguucuuccugagcggccgggggcucggcaagaccuccaucggccugcugugcgugauggccagcuccguccuccuguggauggccagcguggagccccacuggaucgcggccuccaucauccuggaguucuuccucauggugcugcugauccccgagccggaccgccagcggacgccccaggacaaccagcucgccuacgucgugaucgggcugcuguucaugauccucaccguggccgccaacgagaugggccugcuggagaccaccaagaaggaccucgggaucggccacgucgcgguggagaaccaccaccacgccgccaugcuggacguggaccugcaccccgccagcgccuggacgcucuacgcggucgccaccaccaucaucaccccgaugaugcgccacacgaucgagaacaccaccgccaacaucucccugaccgccaucgccaaccaggcggccauccugauggggcucgacaagggcuggcccaucagcaagauggacaucggcgugccccugcuggcccucgggugcuacucccaggugaacccccugacgcugaccgccgcgguccucaugcugguggcccacuacgccaucaucggcccggggcugcaggccaaggccacccgcgaggcgcagaagcggaccgccgccggcaucaugaagaaccccacgguggacgggaucgucgccaucgaccucgaccccgugguguacgacgccaaguucgagaagcagcugggccagaucaugcugcucauccugugcaccagccagauccugcucaugcgcaccaccugggcgcugugcgaguccaucacgcuggccaccggcccccucaccacccugugggaggggagcccgggcaaguucuggaacacgaccaucgccgucuccauggccaacaucuuccgggggagcuaccuggccggcgcgggccucgccuucucccugaugaagucccucgggggcgggcgccgggggaccggggcccagggcgagacccucggcgagaaguggaagcgccagcugaaccagcugagcaaguccgaguucaacacguacaagcggagcgggaucauggagguggaccgcuccgaggccaaggagggccucaagcgcggggagaccaccaagcacgcggugagccgcggcaccgccaagcugcggugguucgucgagcgcaaccuggugaagcccgaggggaaggugaucgaccugggcugcggccgcggcgggugguccuacuacugcgccgggcucaagaaggucacggaggugaagggguacaccaagggcggccccggccacgaggagcccaucccgauggccaccuacggguggaaccuggugaagcugcacagcggcaaggacgucuucuucaucccgcccgagaagugcgacacccuccugugcgacaucggggaguccagccccaacccgacgaucgaggagggccgcacccugcgggugcucaagaugguggagcccuggcugcgcgggaaccaguucugcaucaagauccugaaccccuacaugcccuccgucguggagacccucgagcagaugcagcggaagcacggcggcaugcuggugcgcaacccgcugagccggaacuccacccacgagauguacugggucagcugcgggaccggcaacaucguguccgccgugaacaugacgagccgcaugcuccugaaccgcuucaccauggcgcaccggaagcccaccuacgagcgcgacgucgaccugggggccggcacccggcacguggccguggagcccgaggucgccaaccucgacaucaucggccagcgcaucgagaacaucaagcacgagcacaaguccacguggcacuacgacgaggacaaccccuacaagaccugggccuaccacgggagcuacgaggugaagccguccggcagcgcguccagcauggugaacggggucgugaagcugcugaccaagcccugggacgucauccccauggugacccagaucgccaugacggacaccacccccuucggccagcagcggguguucaaggagaaggucgacacccgcacgccgaaggccaagcgggggaccgcccagaucauggaggugaccgccaaguggcucuggggcuuccugagccgcaacaagaagccccggaucugcacccgcgaggaguucacgcggaaggugcgcuccaacgcggccaucggcgccgucuucguggacgagaaccaguggaacagcgccaaggaggcgguggaggacgagcgguucugggaccugguccaccgcgagcgggagcuccacaagcaggggaagugcgcgaccugcguguacaacaugaugggcaagcgcgagaagaagcugggggaguucggcaaggccaaggggucccgggccaucugguacauguggcugggcgcccgcuuccucgaguucgaggcgcugggcuucaugaacgaggaccacugguucagccgggagaacucccugagcgggguggagggcgaggggcuccacaagcugggcuacauccugcgcgacaucuccaagauccccgggggcaacauguacgccgacgacaccgccggcugggacacccggaucacggaggacgaccuccagaacgaggcccgcaucaccgacaucauggagccggagcacgcccugcuggccaagagcaucuucaagcucaccuaccagaacaaggucgugcgcgugcagcggcccgccaagaacgggaccgucauggacgugaucucccgccgggaccagcgcggcagcggccagguggggacguacggccugaacaccuucaccaacauggaggcccagcugauccggcagauggaguccgaggggaucuucagccccuccgagcucgagauccccaaccuggccgagcgcguccuggacuggcucgagaaguacggcguggagcggcugaagcgcauggccaucagcggggacgacugcguggucaagccgaucgacgaccgguucgcgaccgcccugacggcccucaacgacaugggcaaggugcgcaaggacaucccccagugggagcccuccaagggguggaacgacuggcagcagguccccuucugcagccaccacuuccaccagcugaucaugaaggacggccgggagaucgucgugccgugccgcaaccaggacgagcuggugggccgggcccgcgucucccagggggccggcuggagccuccgggagaccgcgugccugggcaagagcuacgcccagauguggcagcugauguacuuccaccgccgggaccuccgccuggccgccaacgcgaucugcuccgccgugcccguggacuggauccccaccagccggaccacgugguccauccacgcccaccaccaguggaugaccaccgaggacaugcugagcgucuggaaccgcguguggaucgaggagaaccccuggauggaggacaagacccacaucuccagcuggggcgacgugccguaccucgggaagcgcgaggaccaguggugcggcucccugaucggccugacggcccgggccaccugggcgaccaacauccaggucgccaucaaccaggugcgccggcucaucgggaacgagaacuaccuggacuacaugaccagcaugaagcgcuucaagaacgagggcgaccccgagggggcccugugguga

SEQ ID NO: 8340 - RNA, 9879 nt, Artificial Sequence
  derived and/or modified CDS sequence (opt1) from DENV-1__FJ182033__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgagguggagcccgacgacguggacugcuggugcaacaccacggacaccugggugaccuacgggaccugcagccagacgggcgagcaccggcgcgacaagcggagcguggcccucgcgccccacgugggccuggggcuggagacccgggccgagaccuggaugagcuccgagggcgcguggaagcagauccagaagguggagaccugggcccuccggcaccccggguucacggugaucgcccuguuccuggcccacgcgaucggcaccagcaucacccagaaggggaucaucuucauccuccugaugcuggucacccccuccauggccaugcgcugcgugggcaucggcagccgggacuucguggaggggcucuccggcgccacgugggucgacguggugcuggagcacgggagcugcgucaccaccauggccaaggacaagcccacccuggacaucgagcuccugaagacggaggugaccaaccccgccgugcugcgcaagcucugcaucgaggcgaagaucuccaacaccaccacggacagccggugcccgacccagggcgaggccacccuggucgaggagcaggacgccaacuucgugugccgccggaccuucguggaccgcggcugggggaacggcugcgggcuguucggcaaggggucccucaucacgugcgccaaguucaagugcgucaccaagcuggagggcaagaucgugcaguacgagaaccugaaguacagcgugaucgucaccgugcacaccggcgaccagcaccaggucgggaacgaguccacggagcacggcaccaccgccaccaucacgccccaggcgcccacgagcgagauccagcucaccgacuacggggcccugacccuggacugcagcccccggaccggccucgacuucaacgagauggugcugcugacgaugaaggagaaguccuggcucgugcacaagcagugguuccuggaccugccgcuccccuggaccagcggggccuccaccagccaggagaccuggaaccgccaggaccugcuggucacguucaagaccgcccacgccaagaagcaggagguggugguccucggcucccaggagggcgcgaugcacaccgcccugaccggggccacggagauccagaccagcggcaccaccacgaucuucgccgggcaccugaagugccggcucaagauggacaagcugacccugaagggcauguccuacgugaugugcaccgggagcuucaagcucgagaaggagguggccgagacccagcacggcacgguccuggugcagaucaaguacgagggcaccgacgcgcccugcaagauccccuucuccacccaggacgagaagggggugacccagaacggccgccugaucacggccaacccgaucgucaccgacaaggagaagcccgugaacaucgaggccgagccgcccuucggggagagcuacaucgugaucggcgccggcgagaaggcgcugaagcucuccugguucaagaaggggagcuccaucggcaagauguucgaggccaccgcccgcggggcccgccggauggccauccugggcgacaccgcgugggacuucgggagcaucggcggcgucuucacguccaucgggaagcuggugcaccagaucuucggcaccgccuacggggugcuguucagcggcgucuccuggaccaugaagaucgggaucggcgugcugcugaccuggcucggccugaacagccgcuccacgagccuguccaugaccugcaucgccguggggcucgucacccuguaccugggcgugauggugcaggccgacagcgggugcgucaucaacuggaagggccgcgagcucaagugcgggagcggcaucuucgugaccaacgaggugcacacguggaccgagcaguacaaguuccaggccgacuccccgaagcggcugagcgcggccaucggcaaggccugggaggagggggucugcggcauccgcuccgccacccggcuggagaacaucauguggcgccagaucagcaacgagcucaaccacauccugcuggagaacgacaugaaguucaccgugguggucggggacguggugggcauccucgcccaggggaagaagaugauccggccccagcccauggagcacaaguacuccuggaaguccuggggcaaggcgaagaucaucggcgccgacguccagaacaccacguucaucaucgacgggcccaacaccccggagugccccgacgaccagcgcgccuggaacaucugggagguggaggacuacggcuucgggaucuucaccaccaacaucuggcugaagcugcgggacuccuacacccaggugugcgaccaccgccucaugagcgccgcgaucaaggacuccaaggccguccacgccgacaugggcuacuggaucgagagcgagaagaacgagaccuggaagcuggcccgggccuccuucaucgaggugaagaccugcaucuggcccaagagccacacccugugguccaacggcgugcucgagagcgagaugaucauccccaagaucuacgggggcccgaucucccagcacaacuaccgccccggguacuucacgcagaccgcgggccccuggcaccuggggaagcuggagcucgacuucgaccugugcgagggcaccaccgucgugguggacgagcacugcggcaaccgggggccgagccugcgcacgaccaccgucaccggcaagaucauccacgaguggugcugccgguccugcacgcugccgccccuccgcuucaagggggaggacggcugcugguacgggauggagauccggcccgugaaggagaaggaggagaaccuggucaagagcauggucagcgccggcuccggcgagguggacagcuucucccucgggcugcugugcaucagcaucaugaucgaggaggugaugcgcucccgguggagccgcaagaugcucaugaccggcacccuggccgucuucuuccugcucaucauggggcagcugaccuggaacgaccugauccgguccugcaucauggugggcgccaacgccagcgaccgcauggggaugggcacgaccuaccucgcgcugauggccaccuucaagaugcgcccgauguucgccgugggccuccuguuccggcgccugaccucccgggagguccugcuccugacgaucgggcugagccucguggccuccgucgagcugcccaacagccuggaggagcucggcgacgggcuggccaugggcaucaugauccugaagcuccugaccgacuuccaguccuaccagcugugggcgacccuccugagccugaccuucaucaagacgaccuucucccuccacuacgccuggaagaccauggccauggugcugagcaucgugucccugcucccccugugccugagcaccacgucccagaagaccaccuggcuccccguccugcugggcagccucgggugcaagccgcugaccauguuccugaucgccgagaacaagaucuggggccgcaagagcuggccccucaacgaggggaucauggcggugggcaucguguccauccugcugagcucccuccugaagaacgacgucccccuggccgggccccucaucgccggcggcaugcugaucgccugcuacgugaucagcggguccagcgccgaccugucccucgagaaggcggccgaggugagcugggaggaggaggccgagcacuccggcgccagccacaacauccuggucgaggugcaggacgacgggacgaugaagaucaaggacgaggagcgggacgacacccugaccauccuccugaaggccacccugcucgcgguguccggcgucuacccgcugagcauccccgccacccuguucgugugguacuucuggcagaagaagaagcagcgcuccggggugcucugggacacgcccagcccgcccgaggucgagcgggccgugcuggacgacggcaucuaccgcaucaugcagcggggccugcuggggcgcucccaggugggcgucgggguguuccaggagaacguguuccacaccauguggcacgucacccggggcgccgugcucauguaccaggggaagcgccuggagcccagcugggccuccgugaagaaggaccugaucagcuacggcggcggguggcggcuccagggcuccuggaacaccggggaggagguccaggugaucgcgguggagcccggcaagaaccccaagaacguccagacggcccccgggaccuucaagacccccgagggcgaggugggcgccaucgcccuggacuucaagcccgggaccagcggcagccccaucgugaaccgcgaggggaagaucgucggccuguacggcaacgggguggugacgaccuccggcaccuacgucagcgccaucgcgcaggccaaggccucccaggaggggccgcuccccgagaucgaggacgagguguuccggaagcgcaaccugaccaucauggaccugcaccccggcagcgggaagacgcggcgcuaccucccggccaucgugcgggaggcgaucaagcgcaagcugcggacccugauccucgcccccacccgcgucguggccuccgagauggccgaggcccugaagggcaugcccauccgcuaccagaccacggcggucaagagcgagcacaccggccgggagaucgucgaccugaugugccacgccaccuucaccaugcgccuccugucccccgugcgggugccgaacuacaacaugaucaucauggacgaggcccacuucacggaccccagcuccaucgccgcccgcggguacaucagcacccgggucggcaugggggaggcggccgccaucuucaugaccgccacgccgcccggcuccguggaggccuucccgcagagcaacgcggugauccaggacgaggagcgcgacauccccgagcgguccuggaacagcggguacgaguggaucacggacuuccccggcaagaccgucugguucgugcccuccaucaagagcggcaacgacaucgccaacugccugcgcaagaacgggaagcgggugauccagcucucccgcaagaccuucgacaccgaguaccagaagacgaagaacaacgacugggacuacgucgugaccaccgacaucagcgagaugggcgccaacuuccgggccgaccgcgugaucgacccgcggcgcugccugaagcccgucauccugaaggacgggcccgagcgggugauccucgcgggccccaugccggucaccguggccuccgccgcccagcgccgggggcgcaucggccggaaccacaacaaggagggcgaccaguacaucuacauggggcagccccugaacaacgacgaggaccacgcccacuggacggaggcgaagaugcugcucgacaacaucaacacccccgagggcaucauccccgcccuguucgagccggagcgcgagaaguccgccgccaucgacggggaguaccgccugcggggcgaggcccgcaagaccuucguggagcucaugcggcgcggggaccugcccgucuggcugagcuacaagguggcguccgagggcuuccaguacagcgaccggcgcuggugcuucgacggcgagcggaacaaccaggugcucgaggagaacauggacgucgagaucuggaccaaggagggggagcgcaagaagcugcggccccgcuggcuggacgcccggacguacuccgacccccucgcccugcgcgaguucaaggaguucgccgccggccggcgcagcguguccggggaccugauccucgagaucggcaagcugccgcagcaccugacccagcgggcgcagaacgcccucgacaaccuggugaugcugcacaacagcgagcagggcgggcgcgccuaccggcacgccauggaggagcuccccgacaccaucgagacccugaugcugcucgcgcugaucgccguccugacgggcggggugacccucuucuuccuguccggccgcgggcugggcaagaccagcaucggccuccugugcgugauggccuccagcgcccugcucuggauggccuccgucgagccccacuggaucgcggccagcaucauccuggaguucuuccugauggugcuccugauccccgagccggaccggcagcgcacgccccaggacaaccagcuggccuacguggucaucgggcuccuguucaugauccugaccguggccgccaacgagaugggccuccuggagacgaccaagaaggaccuggggaucggccacguggcggucgagaaccaccaccacgccaccaugcucgacguggaccugcaccccgccuccgccuggacccuguacgccguggcgacgaccaucaucaccccgaugaugcggcacaccaucgagaacacgaccgccaacaucagccucaccgccaucgccaaccaggccgcgauccugauggggcuggacaagggcuggcccaucuccaagauggacaucggcgucccccuccuggcccuggggugcuacagccaggugaacccccucacccugacggccgccgugcugaugcucgucgcgcacuacgccaucaucggcccggggcugcaggccaaggccacccgcgaggcccagaagcgcaccgcggccggcaucaugaagaaccccaccguggacgggaucguggccaucgaccuggaccccgucguguacgacgccaaguucgagaagcagcucggccagaucaugcugcugauccucugcacgucccagauccugcugaugcggaccaccugggcccucugcgagagcaucacccuggcgacgggcccccugaccacccucugggagggguccccgggcaaguucuggaacaccacgaucgccgugagcauggccaacaucuuccgcgggagcuaccuggccggcgccggccuggcguucucccucaugaagucccucgggggcgggcggcgcgggaccggggcccagggcgagacccugggcgagaaguggaagcggcagcucaaccagcuguccaagagcgaguucaacaccuacaagcgcuccgggaucauggaggucgaccggagcgaggccaaggagggccugcgccgcggggagacgaccaagcacgccgugucccgcggcaccgcgaagcuccggugguucguggagcgcaaccuggucaagcccgaggggaaggugaucgaccugggcugcggccgcggcggguggagcuacuacugcgccgggcugaagaaggugaccgaggucaagggguacacgaagggcgggcucggccacgaggagcccauccccauggccaccuacggguggaaccuggugaagcugcacuccggcaaggacguguucuucaucccgcccgagaagugcgacacccuccugugcgacaucggggagagcucccccaaccccaccaucgaggagggccgcacgcugcggguccucaagaugguggagccguggcugcgcgggaaccaguucugcaucaagauccugaaccccuacaugcccagcguggucgagacccucgagcagaugcagcggaagcacggcggcaugcuggugcgcaacccccugucccggaacagcacccacgagauguacuggguguccugcgggaccggcaacaucgucagcgccgugaacaugaccucccgcaugcuccugaaccgcuucacgauggcccaccggaagccgaccuacgagcgcgacguggaccugggggcgggcacccggcacgucgccguggagcccgagguggccaaccucgacaucaucggccagcgcaucgagaacaucaagcacgagcacaagagcaccuggcacuacgacgaggacaaccccuacaagacgugggccuaccacggguccuacgaggucaagcccagcggcagcgccuccagcauggugaacggggucgugaagcugcugaccaagccgugggacgugauccccauggucacccagaucgcgaugaccgacacgacccccuucggccagcagcggguguucaaggagaagguggacacccgcacccccaaggccaagcgggggacggcccagaucauggaggucaccgcccgcuggcucuggggcuuccugucccggaacaagaagccgcgcaucugcacccgggaggaguucacccgcaaggugcggagcaacgccgcgaucggcgccguguucgucgacgagaaccaguggaacuccgccaaggaggccguggaggacgagcgcuucugggaccuggugcaccgggagcgcgagcuccacaagcaggggaagugcgcgacgugcgucuacaacaugaugggcaagcgggagaagaagcugggggaguucggcaaggccaaggggagccgcgccaucugguacauguggcugggcgcccgguuccucgaguucgaggcccugggcuucaugaacgaggaccacugguucucccgcgagaacagccuguccgggguggagggcgaggggcuccacaagcugggcuacauccugcgggacaucagcaagauccccgggggcaacauguacgcggacgacaccgccggcugggacacccgcaucaccgaggacgaccuccagaacgaggccaagaucacggacaucauggagcccgagcacgcccugcuggccaccuccaucuucaagcucaccuaccagaacaaggugguccgcgugcagcggccggcgcgcaacgggaccgugauggacgucaucagccggcgcgaccagcggggcuccggccaggugggcacguacggccugaacaccuucaccaacauggaggcccagcugauccgccagauggagagcgaggggaucuuccuccccuccgagcuggagacccccaaccuggccgagcgggugcucgacuggcuggagaagcacggcgucgagcgccugaagcggauggccaucagcggggacgacugcguggugaagcccaucgacgaccgcuucgccacggcgcucaccgcccugaacgacaugggcaagguccggaaggacaucccgcagugggagcccuccaagggguggaacgacuggcagcagguccccuucugcagccaccacuuccaccagcugaucaugaaggacggccgcgagaucgugguccccugccggaaccaggacgagcucgugggccgcgcccgggugagccagggggccggcuggucccugcgcgagaccgccugccugggcaagagcuacgcgcagauguggcagcucauguacuuccaccggcgcgaccugcggcuggccgccaacgccaucugcuccgcggucccgguggacugggugcccaccagccgcacgaccugguccauccacgcccaccaccaguggaugaccaccgaggacaugcucagcgucuggaaccgcguguggaucgaggagaaccccuggauggaggacaagacgcacaucuccagcuggggcgacgugcccuaccuggggaagcgggaggaccaguggugcggcucccugaucggccucaccgcccgcgccaccugggccaccaacauccaggucgcgaucaaccaggugcggcgccugaucgggaacgagaacuaccuggacuacaugaccagcaugaagcgguucaagaacgaguccgacccggagggcgcccucugguga

SEQ ID NO: 8341 - RNA, 9879 nt, Artificial Sequence
  derived and/or modified CDS sequence (opt1) from DENV-1__FJ182034__SS-prME
agcgugaccaugcugcucaugcugaugcccaccgcccuggccuuccaccucacgacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccgcaucaccgaggccgagcccgacgacguggacugcuggugcaacgccaccgacacgugggugaccuacgggaccugcagccagaccggcgagcaccggcgggacaagcgguccguggcccucgcgccccacgugggccuggggcuggagacgcgcaccgagaccuggaugagcuccgagggcgccuggaagcagauccagcggguggagaccugggcccuccgccaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcggugcugcggaagcucugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacaccggcgaccagcaccagguggggaacgaguccacggagcacggcaccaccgcgaccaucacgccccaggcccccagcacggagauccagcucaccgacuacggggcccugacccuggacugcagcccccggaccggccucgacuucaacgagaugguccugcugacgaugaaggagaaguccuggcucgugcacaagcagugguuccuggaccugccgcuccccuggaccagcggggccuccaccagccaggagaccuggaaccggcaggaccugcuggugacguucaagaccgcccacgcgaagaagcaggaggucguggugcucggcucccaggagggcgccaugcacaccgcccugaccggggccacggagauccagaccagcggcaccaccacgaucuucgccgggcaccugaagugccgccucaagauggacaagcugacccugaagggcauguccuacgucaugugcaccgggagcuucaagcucgagaaggagguggcggagacccagcacggcacggugcugguccagaucaaguacgagggcaccgacgcccccugcaagauccccuucuccacccaggacgagaagggggugacccagaacggccggcugaucacggccaacccgaucgugaccgacaaggagaagcccgucaacaucgaggccgagccgcccuucggggagagcuacaucgugaucggcgcgggcgagaaggcccugaagcucuccugguucaagaaggggagcuccaucggcaagauguucgaggccaccgcccgcggggcccggcgcauggcgauccugggcgacaccgccugggacuucgggagcaucggcggcguguucacguccgucgggaagcuggugcaccagaucuucggcaccgccuacggggugcuguucagcggcgucuccuggaccaugaagaucgggaucggcgugcugcugaccuggcucggccugaacagccgcuccacgagccuguccaugaccugcaucgccguggggcucgucacccuguaccugggcgugauggugcaggccgacagcgggugcgucaucaacuggaagggccgggagcucaagugcgggagcggcaucuucgugaccaacgaggugcacacguggaccgagcaguacaaguuccaggcggacuccccgaagcgccugagcgccgccaucggcaaggccugggaggagggggucugcggcauccgguccgccacccgccuggagaacaucauguggaagcagaucagcaacgagcucaaccacauccugcuggagaacgacaugaaguucaccgugguggucggggacguggcgggcauccucgcccaggggaagaagaugauccggccccagcccauggaguacaaguacuccuggaaguccuggggcaaggccaagaucaucggcgccgacgugcagaacaccacguucaucaucgacgggcccaacaccccggagugccccgacgaccagcgcgcguggaacaucugggaggucgaggacuacggcuucgggaucuucaccaccaacaucuggcugaagcugcgggacuccuacacccaggugugcgaccaccgccucaugagcgccgccaucaaggacuccaaggccgugcacgccgacaugggcuacuggaucgagagcgagaagaacgagaccuggaagcuggcgcgggccuccuucaucgaggucaagaccugcaucuggcccaagagccacacccugugguccaacggcgugcucgagagcgagaugaucauccccaagaucuacgggggcccgaucucccagcacaacuaccgccccggguacuucacgcagaccgccggccccuggcaccuggggaagcuggagcucgacuucaaccugugcgagggcaccaccguggucguggacgagcacugcggcaaccgggggccgagccugcgcacgaccaccgugaccggcaagaucauccacgaguggugcugccgguccugcacgcugccgccccuccgcuucaagggggaggacggcugcugguacgggauggagauccggcccgucaaggagaaggaggagaaccuggucaagagcauggugagcgccggcuccggcgaggucgacagcuucucccucgggcugcugugcaucagcaucaugaucgaggaggugaugcgcucccgguggagccgcaagaugcucaugaccggcacccuggccguguucuuccugcucaucauggggcagcugaccuggaacgaccugauccggcucugcaucauggucggcgcgaacgccuccgaccgcauggggaugggcaugacguaccuggcccugauggccaccuucaagaugcgcccgaugcucgccgugggccugcuguuccggcgccucaccagccgggaggugcugcugcucaccaucgggcugucccuggucgcgagcguggagcuccccaacucccuggaggagcugggcgacgggcucgccaugggcaucaugauccugaagcugcucacggacuuccagagccaccagcugugggccacccugcucucccugaccuucaucaagaccacguacagccugcacuacgccuggaagaccauggcgaugguccucuccaucgugagccuguucccccugugccucuccaccaccagccagaagacgaccuggcugcccgugcugcucggcucccuggggugcaagccgcugaccauguuccucaucgccgagaacaagaucuggggccgcaagagcuggccccugaacgaggggaucauggccgucggcaucgugagcauccugcucuccagccugcugaagaacgacgugccccucgccgggccccugaucgccggcggcaugcugaucgcgugcuacgucaucuccgggagcuccgccgaccucagccuggagaaggccgccgagguguccugggaggaggaggccgagcacagcggcgcgucccacaacauccugguggagguccaggacgacgggaccaugaagaucaaggacgaggagcgggacgacacgcucaccauccugcugaaggccacccuccuggccgugagcggcguguacccgcuguccauccccgccacccucuucgucugguacuucuggcagaagaagaagcagcgcagcggggugcugugggacacccccagcccgcccgagguggagcgggccguccuggacgacggcaucuaccgcaucaugcagcggggccugcucgggcgcagccaggugggcgugggggucuuccaggagaacguguuccacacgauguggcacgugacccggggcgcgguccugauguaccaggggaagcgccuggagcccuccugggccagcgugaagaaggaccucaucuccuacggcggcggguggcggcugcagggcagcuggaacaccggggaggaggugcaggucaucgccguggagcccggcaagaaccccaagaacgugcagaccgcccccgggacguucaagaccuccgagggcgaggucggcgccaucgcgcuggacuucaagcccgggaccagcggcagccccaucgugaaccgcgaggggaagaucgugggccucuacggcaacggggucgugaccacguccggcaccuacgugagcgccaucgcccaggccaaggcgucccaggaggggccccugccggagaucgagaacgaggucuuccggaagcgcaaccugaccaucauggaccuccaccccggcagcgggaagacccggcgcuaccugcccgccaucgugcgggaggccaucaagcgcaagcugcggacgcucauccuggccccgacccgcguggucgccuccgagauggcggaggcccugaagggcaugcccauccgcuaccagaccaccgccgucaagagcgagcacacgggcaaggagaucguggaccucaugugccacgccaccuucaccaugcggcugcugucccccguccgcgugcccaacuacaacaugaucaucauggacgaggcccacuucaccgacccgagcuccaucgcggcccggggguacaucagcacgcgcgugggcaugggggaggccgccgccaucuucaugaccgcgacgccgcccggcuccgucgaggccuucccccagagcaacgccgugauccaggacgaggagcgggacaucccggagcgcuccuggaacagcggguacgaguggaucaccgacuuccccggcaagacggugugguucguccccuccaucaagagcggcaacgacaucgccaacugccuccggaagaacgggaagcgcgugauccagcugucccggaagaccuucgacaccgaguaccagaagaccaagaacaacgacugggacuacguggucacgaccgacaucagcgagaugggcgcgaacuuccgcgccgaccgggugaucgacccccgccggugccugaagccggugauccucaaggacgggcccgagcgcgucauccuggccggccccaugcccgugaccgucgccuccgccgcgcagcggcgcgggcggaucggccgcaaccacaacaaggagggcgaccaguacaucuacauggggcagccgcugaacaacgacgaggaccacgcccacuggaccgaggccaagaugcuccuggacaacaucaacacgcccgagggcaucauccccgcccuguucgagcccgagcgggagaaguccgccgcgaucgacggggaguaccgccuccgcggcgaggcccggaagaccuucguggagcugaugcgccgcggggaccugccgguguggcucagcuacaaggucgccuccgagggcuuccaguacagcgaccgccgguggugcuucgacggcgagcgcaacaaccaggugcuggaggagaacauggacguggagaucuggaccaaggagggggagcggaagaagcugcgcccccgguggcucgacgcccgcaccuacuccgacccccuggcccugcgggaguucaaggaguucgcggccggccgccggagcgucuccggggaccucauccuggagaucggcaagcugccccagcaccucacgcagcgcgcccagaacgcccuggacaaccuggugaugcuccacaacagcgagcagggcgggcgggcguaccgccacgccauggaggagcugccggacaccaucgagacccugaugcuccuggcccugaucgccgugcucaccggcggggucacgcuguucuuccuguccggccgggggcucggcaagaccagcaucggccugcugugcgugauggccuccagcgugcuccuguggauggcguccgucgagccccacuggaucgccgccagcaucauccuggaguucuuccucauggugcugcugauccccgagcccgaccgccagcggaccccgcaggacaaccagcucgccuacguggucaucgggcugcuguucaugauccucaccguggccgcgaacgagaugggccugcuggagaccacgaagaaggaccucgggaucggccacguggccgucgagaaccaccaccacgccgccaugcuggacguggaccugcaccccgccuccgcguggacccucuacgccguggccaccaccaucaucacgcccaugaugcgccacaccaucgagaacaccaccgccaacaucagccugacggccaucgcgaaccaggccgccauccugauggggcucgacaagggcuggccgaucuccaagauggacaucggcgucccccugcuggcccucgggugcuacagccaggugaacccccugacccugaccgcggccgugcucaugcuggucgcccacuacgccaucaucggccccgggcugcaggccaaggcgacccgggaggcccagaagcgcacggccgccggcaucaugaagaacccgaccguggacgggaucguggccaucgaccucgaccccgucguguacgacgcgaaguucgagaagcagcugggccagaucaugcugcucauccugugcaccucccagauccugcucaugcgcaccacgugggcccugugcgagagcaucacccuggccaccggcccccucaccacgcugugggaggggucccccggcaaguucuggaacaccaccaucgccgugagcauggccaacaucuuccgggggagcuaccuggcgggcgccggccucgccuucucccugaugaagucccucgggggcgggcgccgggggaccggggcccagggcgagacgcucggcgagaaguggaagcgccagcugaaccagcuguccaagagcgaguucaacaccuacaagcgguccgggaucauggaggucgaccgcagcgaggcgaaggagggccucaagcgcggggagaccaccaagcacgccgugucccgcggcacggccaagcugcggugguucguggagcgcaaccuggucaagccggaggggaaggugaucgaccugggcugcggccgcggcggguggagcuacuacugcgccgggcucaagaaggugaccgaggucaagggguacaccaagggcgggcccggccacgaggagcccauccccauggccaccuacggguggaaccuggugaagcugcacuccggcaaggacguguucuucaucccgcccgagaagugcgacacgcuccugugcgacaucggggagagcucccccaaccccaccaucgaggagggccgcacccugcggguccucaagaugguggagccguggcugcgcgggaaccaguucugcaucaagauccugaaccccuacaugcccagcguggucgagacccucgagcagaugcagcggaagcacggcggcaugcuggugcgcaacccccugucccggaacagcacgcacgagauguacuggguguccugcgggaccggcaacaucgucagcgcggugaacaugaccucccgcaugcuccugaaccgguucaccauggcccaccgcaagccgaccuacgagcgcgacguggaccugggggccggcacgcggcacgucgccguggagcccgagguggccaaccucgacaucaucggccagcgcaucgagaacaucaagcacgagcacaagagcaccuggcacuacgacgaggacaaccccuacaagaccugggcguaccacggguccuacgaggucaagcccagcggcagcgccuccagcauggugaacggggucgugaagcugcugaccaagccgugggacgugauccccauggucacgcagaucgccaugaccgacaccacccccuucggccagcagcggguguucaaggagaagguggacacgcgcacccccaaggccaagcgggggaccgcccagaucauggaggucaccgcgaaguggcucuggggcuuccugucccgcaacaagaagccgcggaucugcacgcgcgaggaguucacccggaaggugcgcagcaacgccgccaucggcgccguguucgucgacgagaaccaguggaacuccgcgaaggaggccguggaggacgagcgguucugggaccuggugcaccgcgagcgggagcuccacaagcaggggaagugcgcgaccugcgucuacaacaugaugggcaagcgcgagaagaagcugggggaguucggcaaggccaaggggagccgggccaucugguacauguggcugggcgcgcgcuuccucgaguucgaggcccugggcuucaugaacgaggaccacugguucucccgggagaacagccuguccgggguggagggcgaggggcuccacaagcugggcuacauccugcgcgacaucagcaagauccccgggggcaacauguacgccgacgacaccgccggcugggacacgcggaucaccgaggacgaccuccagaacgaggccaagaucaccgacaucauggagcccgagcacgcgcugcuggccaaguccaucuucaagcucaccuaccagaacaaggugguccgcgugcagcggccggccaagaacgggacggugauggacgucaucagccgccgcgaccagcggggcuccggccaggugggcaccuacggccugaacaccuucaccaacauggaggcccagcugauccgccagauggagagcgaggggaucuucucccccagcgagcucgagacgcccaaccuggccggccgggugcuggacuggcucgagaagcacggggucgagcgccugaagcggauggcgaucuccggcgacgacugcguggugaagcccaucgacgaccgcuucgccaccgcccugaccgcccucaacgacauggggaagguccggaaggacaucccgcagugggagcccagcaagggcuggaacgacuggcagcagguccccuucugcagccaccacuuccaccagcugaucaugaaggacggccgcgagaucgugguccccugccggaaccaggacgagcugguggggcgcgcccgggugucccagggcgcgggguggagccuccgcgagaccgccugccugggcaaguccuacgcccagauguggcagcugauguacuuccaccggcgcgaccuccggcuggccgcgaacgccaucugcagcgccgucccgguggacugggugcccacgucccgcaccaccuggagcauccacgcccaccaccaguggaugaccacggaggacaugcuguccgucuggaaccggguguggaucgaggagaaccccuggauggaggacaagacccacaucagcuccuggggcgacgugcccuaccucggcaagcgcgaggaccaguggugcggcagccugaucgggcugaccgcccgggcgaccugggccacgaacauccaggucgccaucaaccaggugcgccgccucaucggcaacgagaacuaccuggacuacaugaccuccaugaagcgguucaagaacgagagcgacccggagggggcccugugguga

SEQ ID NO: 8342 - RNA, 9879 nt, Artificial Sequence
  derived and/or modified CDS sequence (opt1) from DENV-1__FJ182036__SS-prME
agcgugaccaugcugcugaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgagaccgagcccgacgacguggacugcuggugcaacgccacggacaccugggugaccuacgggaccugcagccagacgggcgagcaccggcgggacaagcgguccguggcccucgcgccccacgugggccuggggcuggagacccgcaccgagaccuggaugagcuccgagggcgccuggaagcagauccagcgggucgagacgugggcccuccggcaccccggguucaccgugaucgcccuguuccuggcccacgcgaucggcaccagcaucacccagaaggggaucaucuucauccuccugaugcuggccacgcccuccauggccaugcggugcgugggcaucggcagccgcgacuucgucgaggggcucuccggcgccaccuggguggacgugguccuggagcacgggagcugcgugaccaccauggccaaggacaagcccacgcuggacaucgagcuccugaagaccgaggugaccaaccccgcgguccugcggaagcucugcaucgaggccaagaucuccaacaccacgaccgacagccgcugcccgacccagggcgaggccacccugguggaggagcaggacgccaacuucgugugccggcgcacguucgucgaccggggcugggggaacggcugcgggcuguucggcaaggggucccucaucacgugcgccaaguucaagugcgugaccaagcuggagggcaagaucgugcaguacgagaaccugaaguacagcgucaucgugaccgugcacacgggcgaccagcaccaggucgggaacgaguccaccgagcacggcaccaccgcgaccaucacgccccaggcccccaccaccgagauccagcucaccgacuacggggcccugacgcuggacugcagcccccgcaccggccucgacuucaacgagauggugcugcugaccaugaaggagaaguccuggcucguccacaagcagugguuccuggaccugccccuccccuggaccagcggggccagcacgucccaggagaccuggaaccggcaggaccugcuggugaccuucaagaccgcccacgcgaagaagcaggagguggucgugcucggcagccaggagggcgccaugcacacggcccugaccggggccaccgagauccagaccuccggcacgaccaccaucuucgccgggcaccugaagugccgccucaagauggacaagcugacccugaagggcaugagcuacgugaugugcacgggguccuucaagcucgagaaggagcuggcggagacccagcacggcaccguccuggugcagaucaaguacgagggcaccgacgcccccugcaagauccccuucagcacgcaggacgagaagggggugacccagaacggccggcugaucaccgccaacccgaucgucaccgacaaggagaagcccgugaacaucgaggccgagccgcccuucggggaguccuacaucgugaucggcgcgggcgagaaggcccucaagcugagcugguucaagaagggguccagcaucggcaagauguucgaggccacggcccgcggggcccggcgcauggcgauccugggcgacaccgccugggacuucggguccaucggcggcgucuucaccagcguggggaagcucgugcaccagaucuucggcaccgccuacgggguccuguucuccggcgugagcuggacgaugaagaucgggaucggcgugcugcucaccuggcugggccugaacucccgcagcaccucccucagcaugaccugcaucgccgucgggcuggugacgcuguaccucggcgugaugguccaggccgacuccgggugcgugaucaacuggaagggccgggagcugaagugcgggagcggcaucuucgugaccaacgagguccacaccuggaccgagcaguacaaguuccaggcggacagcccgaagcgccuguccgccgccaucggcaaggccugggaggagggggugugcggcauccggagcgccacccgccucgagaacaucauguggaagcagaucuccaacgagcugaaccacauccugcucgagaacgacaugaaguucacgguggucgugggggacguggcgggcauccuggcccaggggaagaagaugauccggccccagcccauggaguacaaguacagcuggaaguccuggggcaaggccaagaucaucggcgccgacguccagaacaccaccuucaucaucgacgggcccaacaccccggagugccccgacgaccagcgcgcguggaacaucugggagguggaggacuacggcuucgggaucuucacgaccaacaucuggcugaagcuccgggacagcuacacccaggugugcgaccaccgccugauguccgccgccaucaaggacagcaaggccguccacgccgacaugggcuacuggaucgaguccgagaagaacgagaccuggaagcuggcgcgggccagcuucaucgaggugaagacgugcaucuggcccaagucccacacccucuggagcaacggcgugcuggaguccgagaugaucauccccaagaucuacgggggcccgaugagccagcacaacuaccgccccggguacuucacccagaccgccggccccuggcaccuggggaagcucgagcuggacuucgaccugugcgagggcacgaccgucgugguggacgagcacugcggcaaccgggggccgucccuccgcaccaccacggucaccggcaagaucauccacgaguggugcugccggagcugcacccugccgccccugcgcuuccgcggggaggacggcugcugguacgggauggagauccgccccgugaaggagaaggaggagaaccucgugaaguccauggucagcgccggcagcggcgagguggacuccuucagccuggggcugcucugcaucuccaucaugaucgaggaggugaugcggagccgcuggucccggaagaugcugaugaccggcacgcuggccgucuucuuccuccugaucauggggcagcugaccuggaacgaccucauccgccugugcaucauggugggcgcgaacgccagcgaccgcauggggaugggcaccaccuaccuggcccucauggccacguucaagaugcggccgauguucgccgugggccugcuguuccgccggcucaccucccgcgagguccugcugcucaccaucgggcugagccugguggcguccguggagcuccccaacagccuggaggagcugggcgacgggcucgccaugggcaucaugauccugaagcugcucaccgacuuccagucccaccagcugugggccacgcugcucagccugaccuucaucaagaccaccuucucccugcacuacgccuggaagacgauggcgaugguccucagcaucgugucccuguucccccugugccucagcaccaccucccagaagaccacguggcugcccguccugcucggcagccuggggugcaagccgcugaccauguuccucaucgccgagaacaagaucuggggccggcgcuccuggccccugaacgaggggaucauggccgugggcaucgugagcauccugcucagcucccugcugaagaacgacgucccccucgccgggccccugaucgccggcggcaugcugaucgcgugcuacgugaucagcggguccagcgccgaccucucccuggagaaggccgccgaggugagcugggaggaggaggccgagcacuccggcgcgagccacaacauccuggucgaggugcaggacgacgggaccaugaagaucaaggacgaggagcgggacgacacccucaccauccugcugaaggccacgcuccuggccguguccggcgucuacccgcugagcauccccgccacccucuucgugugguacuucuggcagaagaagaagcagcgcuccggggugcugugggacacccccagcccgcccgaggucgagcgggccgugcuggacgacggcaucuaccgcaucaugcagcggggccugcucgggcgcucccaggugggcgucgggguguuccaggagaacguguuccacaccauguggcacgucacgcggggcgcggugcugauguaccaggggaagcgccuggagcccagcugggccuccgugaagaaggaccucaucagcuacggcggcggguggcggcugcagggcuccuggaacaccggggaggagguccaggugaucgccguggagcccggcaagaaccccaagaacguccagaccgcccccgggaccuucaagacgcccgagggcgaggugggcgccaucgcgcuggacuucaagcccgggaccagcggcucccccaucgugaaccgcgaggggaagaucgucggccucuacggcaacgggguggugaccaccagcggcacguacgucagcgccaucgcccaggccaaggcgucccaggaggggccgcugcccgagaucgaggacgagguguuccggaagcgcaaccugaccaucauggaccuccaccccggcagcgggaagacccggcgcuaccugccggccaucgugcgggaggccaucaagcgcaagcugcgcacccucauccuggcccccacgcgggucguggccuccgagauggcggaggcccugaagggcaugcccauccgcuaccagaccaccgccgucaagagcgagcacaccggcaaggagaucgucgaccucaugugccacgccacguucaccaugcggcugcugucccccgugcgcgugccgaacuacaacaugaucaucauggacgaggcccacuucaccgaccccagcuccaucgcggcccggggguacaucagcacccgcgucggcaugggggaggccgccgccaucuucaugacggcgacgccgcccggcuccguggaggccuucccgcagagcaacgccgugauccaggacgaggagcgggacauccccgagcgcuccuggaacagcggguacgaguggaucaccgacuuccccggcaagaccgucugguucgugcccuccaucaagagcggcaacgacaucgccaacugccuccggaagaacgggaagcgcgugauccagcugucccggaagacguucgacaccgaguaccagaagaccaagaacaacgacugggacuacgucgugaccacggacaucagcgagaugggcgcgaacuuccgcgccgaccgggugaucgacccgcgccggugccugaagcccgucauccucaaggacgggcccgagcgcgugauccuggccggccccaugccggugaccgucgccuccgccgcgcagcggcgcgggcggaucggccgcaaccacaacaaggagggcgaccaguacaucuacauggggcagccccugaacaacgacgaggaccacgcccacuggaccgaggccaagaugcuccuggacaacaucaacacccccgagggcaucauccccgcccuguucgagccggagcgcgagaaguccgccgcgaucgacggggaguaccggcuccgcggcgaggcccggaagacguucguggagcugaugcgccgcggggaccugcccgucuggcucuccuacaagguggccagcgagggcuuccaguacagcgaccgccgguggugcuucgacggcgagcgcaacaaccaggugcuggaggagaacauggacgucgagaucuggaccaaggagggggagcggaagaagcugcgcccccgguggcucgacgcccgcaccuacuccgacccccuggcccugcgggaguucaaggaguucgcggccggccgccggagcguguccggggaccucauccuggagaucggcaagcugccgcagcaccucacccagcgcgcccagaacgcccuggacaaccuggugaugcuccacaacagcgagcagggcgggcgggcguaccgccacgccauggaggagcugcccgacacgaucgagacccugaugcuccuggcccugaucgccguccucaccggcggggugacccuguucuuccuguccggccgggggcucggcaagaccagcaucggccugcugugcgugauggccuccagcguccuccuguggauggcguccguggagccccacuggaucgccgccagcaucauccuggaguucuuccucauggugcugcugauccccgagccggaccgccagcggacgccccaggacaaccagcucgccuacgucgugaucgggcugcuguucaugauccucaccguggccgcgaacgagaugggccugcuggagaccaccaagaaggaccucgggaucggccacgucgccguggagaaccaccaccacgccgccaugcuggacguggaccugcaccccgccuccgcguggacgcucuacgccgucgccaccaccaucaucaccccgaugaugcgccacacgaucgagaacaccaccgccaacaucagccugaccgccaucgcgaaccaggccgccauccugauggggcucgacaagggcuggcccaucuccaagauggacaucggcgugccccugcuggcccucgggugcuacagccaggugaacccccugacgcugaccgcggccguccucaugcugguggcccacuacgccaucaucggcccggggcugcaggccaaggcgacccgcgaggcccagaagcggaccgccgccggcaucaugaagaaccccacgguggacgggaucgucgccaucgaccucgaccccgugguguacgacgcgaaguucgagaagcagcugggccagaucaugcugcucauccugugcaccucccagauccugcucaugcgcaccaccugggcccugugcgagagcaucacgcuggccaccggcccccucaccacccugugggagggguccccgggcaaguucuggaacacgaccaucgccgucagcauggccaacaucuuccggggguccuaccuggcgggcgccggccucgccuucagccugaugaagucccucgggggcgggcgccgggggaccggggcccagggcgagacccucggcgagaaguggaagcgccagcugaaccagcuguccaagagcgaguucaacacguacaagcgguccgggaucauggagguggaccgcagcgaggcgaaggagggccucaagcgcggggagaccaccaagcacgccgugucccgcggcaccgccaagcugcggugguucgucgagcgcaaccuggugaagcccgaggggaaggugaucgaccugggcugcggccgcgggggcuggagcuacuacugcgccgggcucaagaaggucacggaggugaagggcuacaccaagggcggccccggccacgaggagcccaucccgauggccaccuacggguggaaccuggugaagcugcacuccggcaaggacgucuucuucaucccgcccgagaagugcgacacccuccugugcgacaucggggagagcucccccaacccgacgaucgaggagggccgcacccugcgggugcucaagaugguggagcccuggcugcgcgggaaccaguucugcaucaagauccugaaccccuacaugcccagcgucguggagacccucgagcagaugcagcggaagcacggcggcaugcuggugcgcaacccgcugucccggaacagcacccacgagauguacugggucuccugcgggaccggcaacaucgugagcgcggugaacaugacgucccgcaugcuccugaaccgcuucaccauggcccaccggaagcccaccuacgagcgcgacgucgaccugggggccggcacccggcacguggccguggagcccgaggucgccaaccucgacaucaucggccagcgcaucgagaacaucaagcacgagcacaagagcacguggcacuacgacgaggacaaccccuacaagaccugggcguaccacggguccuacgaggugaagccgagcggcuccgccagcagcauggugaacggggucgugaagcugcugaccaagcccugggacgucauccccauggugacccagaucgccaugacggacaccacccccuucggccagcagcggguguucaaggagaaggucgacacccgcacgccgaaggccaagcgggggaccgcccagaucauggaggugaccgcgaaguggcucuggggcuuccugucccgcaacaagaagccccggaucugcacccgcgaggaguucacgcggaaggugcgcagcaacgccgccaucggcgccgucuucguggacgagaaccaguggaacuccgcgaaggaggccguggaggacgagcgguucugggaccugguccaccgcgagcgggagcuccacaagcaggggaagugcgcgaccugcguguacaacaugaugggcaagcgcgagaagaagcugggggaguucggcaaggccaaggggagccgggccaucugguacauguggcugggcgcgcgcuuccucgaguucgaggcccugggcuucaugaacgaggaccacugguucucccgggagaacagccuguccgggguggagggcgaggggcuccacaagcugggcuacauccugcgcgacaucagcaagauccccgggggcaacauguacgccgacgacaccgccggcugggacacccggaucacggaggacgaccuccagaacgaggcccgcaucaccgacaucauggagccggagcacgcgcugcuggccaaguccaucuucaagcucaccuaccagaacaaggucgugcgcgugcagcggcccgccaagaacgggaccgucauggacgugaucagccgccgggaccagcgcggcuccggccagguggggacguacggccugaacaccuucaccaacauggaggcccagcugauccggcagauggagagcgaggggaucuucucccccagcgagcucgagacccccaaccuggccaagcgcguccuggacuggcucgagaaguacggcguggagcggcugaagcgcauggcgaucuccggggacgacugcguggucaagccgaucgacgaccgguucgccacggcccugaccgcccucaacgacaugggcaaggugcgcaaggacaucccccagugggagcccagcaagggguggaacgacuggcagcagguccccuucugcucccaccacuuccaccagcugaucaugaaggacggccgggagaucgucgugccgugccgcaaccaggacgagcuggugggccgggcccgcgucagccagggggcgggcuggagccuccgggagaccgccugccuggggaaguccuacgcccagauguggcagcugauguacuuccaccgccgggaccuccgccuggccgcgaacgccaucugcagcgccgugcccguggacuggauccccaccucccggacgaccuggagcauccacgcccaccaccaguggaugaccaccgaggacaugcuguccgucuggaaccgcguguggaucgaggagaaccccuggauggaggacaagacgcacaucagcuccuggggcgacgugccguaccucgggaagcgcgaggaccaguggugcggcagccugaucggccugaccgcccgggcgaccugggccaccaacauccaggucgccaucaaccaggugcgccggcucaucgggaacgagaacuaccuggacuacaugaccuccaugaagcgcuucaagaacgagagcgaccccgagggcgcccugugguga

SEQ ID NO: 8343 - RNA, 9879 nt, Artificial Sequence
  derived and/or modified CDS sequence (opt1) from DENV-1__FJ205876__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgagaccgagcccgacgacguggacugcuggugcaacgccacggacaccugggugaccuacgggaccugcagccagacgggcgagcaccggcgggacaagcgguccguggcccucgcgccccacgugggccuggggcuggagacccgcaccgagaccuggaugagcuccgagggcgccuggaagcagauccagcgggucgagacgugggcccuccggcaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagguggccgagacccagcacggcaccgugcugguccagaucaaguacgagggcaccgacgcgcccugcaagauccccuucagcacgcaggacgagaagggggugacccagaacggccggcugaucaccgccaacccgaucgugaccgacaaggagaagcccgucaacaucgaggccgagccgcccuucggggaguccuacaucgugaucggcgccggcgagaaggcgcugaagcucagcugguucaagaagggguccagcaucggcaagauguucgaggccacggcccgcggggcccggcgcauggccauccugggcgacaccgcgugggacuucggguccaucggcggcguguucaccagcgucgggaagcuggugcaccagaucuucggcaccgccuacggggugcuguucuccggcgucagcuggacgaugaagaucgggaucggcgugcugcugaccuggcucggccugaacucccgcagcaccucccugagcaugaccugcaucgccguggggcucgucacgcuguaccugggcgugauggugcaggccgacuccgggugcgucaucaacuggaagggccgggagcucaagugcgggagcggcaucuucgugaccaacgaggugcacaccuggaccgagcaguacaaguuccaggccgacagcccgaagcgccuguccgcggccaucggcaaggccugggaggagggggucugcggcauccggagcgccacccgccuggagaacaucauguggaagcagaucuccaacgagcucaaccacauccugcuggagaacgacaugaaguucacggugguggucggggacguggccggcauccucgcgcaggggaagaagaugauccggccccagcccauggaguacaaguacagcuggaaguccuggggcaaggccaagaucaucggcgccgacgugcagaacaccaccuucaucaucgacgggcccaacaccccggagugccccgacgaccagcgcgccuggaacaucugggaggucgaggacuacggcuucgggaucuucacgaccaacaucuggcugaagcugcgggacagcuacacccaggugugcgaccaccgccucauguccgcggccaucaaggacagcaaggccgugcacgccgacaugggcuacuggaucgaguccgagaagaacgagaccuggaagcuggcccgggcgagcuucaucgaggucaagacgugcaucuggcccaagucccacacccuguggagcaacggcgugcucgaguccgagaugaucauccccaagaucuacgggggcccgaucagccagcacaacuaccgccccggguacuucacccagaccgccggccccuggcaccuggggaagcuggagcucgacuucgaccugugcgagggcacgaccguggucguggacgagcacugcggcaaccgggggccgucccugcgcaccaccacggugaccggcaagaucauccacgaguggugcugccggagcugcacccugccgccccuccgcuuccgcggggaggacggcugcugguacgggauggagauccgccccgucaaggagaaggaggagaaccuggugaaguccauggugagcgccggcagcggcgaggucgacuccuucagccucgggcugcugugcaucuccaucaugaucgaggaggugaugcggagccgcuggucccggaagaugcucaugaccggcacgcuggccguguucuuccugcucaucauggggcagcugaccuggaacgaccugauccgccucugcaucauggucggcgccaacgcgagcgaccgcauggggaugggcaccaccuaccuggcccugauggccacguucaagaugcggccgauguucgccgugggccuccuguuccgccggcugaccucccgcgaggugcuccugcugaccaucgggcucagccuggucgccuccguggagcugcccaacagccucgaggagcugggcgacgggcuggcgaugggcaucaugauccucaagcugcugaccgacuuccagucccaccagcucugggccacgcugcugagccucaccuucaucaagaccaccuucucccugcacuacgccuggaagacgauggccaugguccugagcaucgugucccucuucccccugugccugagcaccaccucccagaagaccacguggcuccccgugcugcugggcagccucgggugcaagccgcugaccauguuccugaucgcggagaacaagaucuggggccggcgcuccuggccccucaacgaggggaucauggccgucggcaucgugagcauccugcugagcucccuccugaagaacgacgugccccuggccgggccccucaucgccggcggcaugcugaucgccugcuacgucaucagcggguccagcgcggaccugucccucgagaaggccgccgaggugagcugggaggaggaggccgagcacuccggcgccagccacaacauccugguggagguccaggacgacgggaccaugaagaucaaggacgaggagcgggacgacacccugaccauccuccugaaggcgacgcugcucgccguguccggcguguacccgcugagcauccccgccacccuguucgucugguacuucuggcagaagaagaagcagcgcuccggggugcucugggacacccccagcccgcccgagguggagcgggccguccuggacgacggcaucuaccgcaucaugcagcggggccugcuggggcgcucccaggugggcgugggggucuuccaggagaacguguuccacaccauguggcacgugacgcggggcgccguccucauguaccaggggaagcgccuggagcccagcugggcguccgugaagaaggaccugaucagcuacggcggcggguggcggcuccagggcuccuggaacaccggggaggaggugcaggucaucgccguggagcccggcaagaaccccaagaacgugcagaccgcccccgggaccuucaagacgcccgagggcgaggucggcgccaucgcccuggacuucaagcccgggaccagcggcucccccaucgugaaccgcgaggggaagaucgugggccuguacggcaacggggucgugaccaccagcggcacguacgugagcgcgaucgcccaggccaaggccucccaggaggggccgcuccccgagaucgaggacgaggucuuccggaagcgcaaccugaccaucauggaccugcaccccggcagcgggaagacccggcgcuaccucccggcgaucgugcgggaggccaucaagcgcaagcugcgcacccugauccucgcccccacgcggguggucgccuccgagauggccgaggcgcugaagggcaugcccauccgcuaccagaccaccgccgucaagagcgagcacaccggcaaggagaucguggaccugaugugccacgccacguucaccaugcggcuccugucccccguccgcgugccgaacuacaacaugaucaucauggacgaggcccacuucaccgaccccagcuccaucgccgcgcggggguacaucagcacccgcgugggcaugggggaggccgccgccaucuucaugacggccacgccgcccggcuccgucgaggcguucccgcagagcaacgccgugauccaggacgaggagcgggacauccccgagcgcuccuggaacagcggguacgaguggaucaccgacuuccccggcaagaccgugugguucguccccuccaucaagagcggcaacgacaucgccaacugccugcggaagaacgggaagcgcgugauccagcucucccggaagacguucgacaccgaguaccagaagaccaagaacaacgacugggacuacguggucaccacggacaucagcgagaugggcgccaacuuccgcgcggaccgggugaucgacccgcgccggugccugaagcccgugauccugaaggacgggcccgagcgcgucauccucgccggccccaugccggugaccgucgccuccgccgcccagcggcgcgggcggaucggccgcaaccacaacaaggagggcgaccaguacaucuacauggggcagccccugaacaacgacgaggaccacgcgcacuggaccgaggccaagaugcugcucgacaacaucaacacccccgagggcaucauccccgcccuguucgagccggagcgcgagaaguccgccgccaucgacggggaguaccggcugcgcggcgaggcgcggaagacguucguggagcucaugcgccgcggggaccugcccguguggcuguccuacaaggucgccagcgagggcuuccaguacagcgaccgccgguggugcuucgacggcgagcgcaacaaccaggugcucgaggagaacauggacguggagaucuggaccaaggagggggagcggaagaagcugcgcccccgguggcuggacgcccgcaccuacuccgacccccucgcccugcgggaguucaaggaguucgccgcgggccgccggagcgucuccggggaccugauccucgagaucggcaagcugccgcagcaccugacccagcgcgcccagaacgcccucgacaaccuggugaugcugcacaacagcgagcagggcgggcgggccuaccgccacgcgauggaggagcuccccgacacgaucgagacccugaugcugcucgcccugaucgccgugcugaccggcggggucacccucuucuuccuguccggccgggggcugggcaagaccagcaucggccuccugugcgugauggccuccagcgugcugcucuggauggccuccgucgagccccacuggaucgcggccagcaucauccuggaguucuuccugauggugcuccugauccccgagccggaccgccagcggacgccccaggacaaccagcuggccuacguggucaucgggcuccuguucaugauccugaccguggccgccaacgagaugggccuccuggagaccaccaagaaggaccuggggaucggccacguggcggucgagaaccaccaccacgccgccaugcucgacguggaccugcaccccgccuccgccuggacgcuguacgcgguggccaccaccaucaucaccccgaugaugcgccacacgaucgagaacaccaccgccaacaucagccucaccgccaucgccaaccaggcggccauccugauggggcuggacaagggcuggcccaucuccaagauggacaucggcgucccccuccuggcccuggggugcuacagccaggugaacccccucacgcugaccgccgcggugcugaugcucgucgcccacuacgccaucaucggcccggggcugcaggccaaggccacccgcgaggcgcagaagcggaccgccgccggcaucaugaagaaccccacgguggacgggaucguggccaucgaccuggaccccgucguguacgacgccaaguucgagaagcagcucggccagaucaugcugcugauccucugcaccucccagauccugcugaugcgcaccaccugggcgcucugcgagagcaucacgcuggccaccggcccccugaccacccucugggagggguccccgggcaaguucuggaacacgaccaucgccgugagcauggccaacaucuuccggggguccuaccuggccggcgcgggccuggccuucagccucaugaagucccucgggggcgggcgccgggggaccggggcccagggcgagacccugggcgagaaguggaagcgccagcucaaccagcuguccaagagcgaguucaacacguacaagcgguccgggaucauggaggucgaccgcagcgaggccaaggagggccugaagcgcggggagaccaccaagcacgcggugucccgcggcaccgccaagcuccggugguucguggagcgcaaccuggucaagcccgaggggaaggugaucgaccugggcugcggccgcggcggguggagcuacuacugcgccgggcugaagaaggugacggaggucaagggguacaccaagggcggccccggccacgaggagcccaucccgauggccaccuacggguggaaccucgugaagcugcacuccggcaaggacguguucuucaucccgcccgagaagugcgacacccugcucugcgacaucggggagagcucccccaacccgacgaucgaggagggccgcacccugcggguccugaagaugguggagcccuggcuccgcgggaaccaguucugcaucaagauccugaaccccuacaugcccagcguggucgagacccuggagcagaugcagcggaagcacggcggcaugcucgugcgcaacccgcugucccggaacagcacccacgagauguacuggguguccugcgggaccggcaacaucgucagcgccgugaacaugacgucccgcaugcugcucaaccgcuucaccauggcgcaccggaagcccaccuacgagcgcgacguggaccugggggccggcacccggcacgucgccguggagcccgagguggccaaccuggacaucaucggccagcgcaucgagaacaucaagcacgagcacaagagcacguggcacuacgacgaggacaaccccuacaagaccugggccuaccacggguccuacgaggucaagccgagcggcuccgcgagcagcauggugaacggggucgugaagcuccugaccaagcccugggacgugauccccauggucacccagaucgccaugacggacaccacccccuucggccagcagcggguguucaaggagaagguggacacccgcacgccgaaggccaagcgggggaccgcccagaucauggaggucaccgccaaguggcuguggggcuuccucucccgcaacaagaagccccggaucugcacccgcgaggaguucacgcggaaggugcgcagcaacgcggccaucggcgccguguucgucgacgagaaccaguggaacuccgccaaggaggcgguggaggacgagcgguucugggaccuggugcaccgcgagcgggagcugcacaagcaggggaagugcgcgaccugcgucuacaacaugaugggcaagcgcgagaagaagcucggggaguucggcaaggccaaggggagccgggccaucugguacauguggcugggcgcccgcuuccuggaguucgaggcgcucggcuucaugaacgaggaccacugguucaaccgggagaacucccugagcgggguggagggcgaggggcugcacaagcucggcuacauccugcgcgacaucuccaagauccccgggggcaacauguacgccgacgacaccgccggcugggacacccggaucacggaggacgaccugcagaacgaggcccgcaucaccgacaucauggagccggagcacgcccuccuggcgcgcagcaucuucaagcugaccuaccagaacaaggugguccgggugcagcgccccgccaagaacgggaccgugauggacgucaucucccggcgcgaccagcggggcagcggccagguggggacguacggccucaacaccuucaccaacauggaggcccagcugauccgccagauggaguccgaggggaucuucagccccuccgagcuggagacccccaaccucgccgagcgggugcuggacuggcuggagaaguacggcgucgagcgccucaagcggauggccaucagcggggacgacugcguggugaagccgaucgacgaccgcuucgcgacggcccugaccgcccugaacgacaugggcaagguccggaaggacaucccccagugggagcccuccaagggguggaacgacuggcagcagguccccuucugcagccaccacuuccaccagcucaucaugaaggacggccgcgagaucguggucccgugccggaaccaggacgagcuggugggccgcgcccgggugucccagggggccggcuggagccugcgcgagaccgcgugccucggcaagagcuacgcccagauguggcagcugauguacuuccaccggcgcgaccugcggcucgccgccaacgcgaucugcuccgccguccccguggacuggauccccaccagccgcacgaccugguccauccacgcccaccaccaguggaugaccaccgaggacaugcugagcguguggaaccgcgucuggaucgaggagaaccccuggauggaggacaagacgcacaucuccagcuggggcgacgugccguaccuggggaagcgggaggaccaguggugcggcucccucaucggccugaccgcccgcgccaccugggcgaccaacauccagguggccaucaaccagguccggcgccugaucgggaacgagaacuaccucgacuacaugaccagcaugaagcgguucaagaacgaguccgaccccgagggcgcccugugguga

SEQ ID NO: 8344 - RNA, 9879 nt, Artificial Sequence
  derived and/or modified CDS sequence (opt1) from DENV-1__FJ024455__SS-prME
agcgugaccaugcugcugaugcugaugcccaccgcccuggccuuccaccucaccacccggggcggggagccgcacaugaucgugagcaagcaggagcggggcaagagccugcuguucaagaccagcgugggggugaacaugugcacccucaucgccauggaccugggcgagcugugcgaggacaccaugaccuacaagugcccccggaucaccgagaccgagcccgacgacguggacugcuggugcaacgccacggacaccugggugaccuacgggaccugcagccagacgggcgagcaccggcgggacaagcgguccguggcccucgcgccccacgucggccuggggcuggagacccgcaccgagaccuggaugagcuccgagggcgccuggaagcagauccagcggguggagacgugggcgcuccggcaccccggguucaccgugaucgcccuguuccuggcccacgccaucggcaccagcaucacccagaaggggaucaucuucauccuccugaugcuggucacgcccuccauggcgaugcggugcgugggcaucggcagccgcgacuucguggaggggcucuccggcgccaccugggucgacguggugcuggagcacgggagcugcgucaccaccauggccaaggacaagcccacgcuggacaucgagcuccugaagaccgaggugaccaaccccgccgugcugcggaagcucugcaucgaggccaagaucuccaacaccacgaccgacagccgcugcccgacccagggcgaggcgacccuggucgaggagcaggacgccaacuucgugugccggcgcacguucguggaccggggcugggggaacggcugcgggcuguucggcaaggggucccucaucacgugcgccaaguucaagugcgucaccaagcuggagggcaagaucgugcaguacgagaaccugaaguacagcgugaucgucaccgugcacacgggcgaccagcaccaggucgggaacgaguccaccgagcacggcaccaccgccaccaucacgccccaggcccccaccaccgagauccagcucaccgacuacggggcgcugacgcuggacugcagcccccgcaccggccucgacuucaacgagauggugcugcugaccaugaaggagaaguccuggcucgugcacaagcagugguuccuggaccugccgcuccccuggaccagcggggccagcacgucccaggagaccuggaaccggcaggaccugcuggucaccuucaagaccgcccacgccaagaagcaggagguggugguccucggcagccaggagggcgccaugcacacggcgcugaccggggccaccgagauccagaccuccggcacgaccaccaucuucgccgggcaccugaagugccgccucaagauggacaagcugacccugaagggcaugagcuacgugaugugcacgggguccuucaagcucgagaaggagcuggccgagacccagcacggcaccgugcugguccagaucaaguacgagggcaccgacgcccccugcaagauccccuucagcacgcaggacgagaagggggugacccagaacggccggcugaucaccgcgaacccgaucgugaccgacaaggagaagcccgucaacaucgaggccgagccgcccuucggggaguccuacaucgugaucggcgccggcgagaaggcccucaagcugagcugguucaagaagggguccagcaucggcaagauguucgaggcgacggcccgcggggcccggcgcauggccauccugggcgacaccgccugggacuucggguccaucggcggcguguucaccagcgucgggaagcucgugcaccagaucuucggcaccgcguacggggugcuguucuccggcgucagcuggacgaugaagaucgggaucggcgugcugcucaccuggcugggccugaacucccgcagcaccucccucagcaugaccugcaucgccguggggcuggucacgcuguaccucggcgugauggugcaggccgacuccgggugcgucaucaacuggaagggccgggagcugaagugcgggagcggcaucuucgugaccaacgaggugcacaccuggaccgagcaguacaaguuccaggccgacagcccgaagcgccuguccgccgcgaucggcaaggccugggaggagggggucugcggcauccggagcgccacccgccucgagaacaucauguggaagcagaucuccaacgagcugaaccacauccugcucgagaacgacaugaaguucacggugguggucggggacguggccggcauccuggcccaggggaagaagaugauccggccccagcccauggaguacaaguacagcuggaaguccuggggcaaggcgaagaucaucggcgccgacgugcagaacaccaccuucaucaucgacgggcccaacaccccggagugccccgacgaccagcgcgccuggaacaucugggaggucgaggacuacggcuucgggaucuucacgaccaacaucuggcugaagcuccgggacagcuacacccaggugugcgaccaccgccugauguccgccgcgaucaaggacagcaaggccgugcacgccgacaugggcuacuggaucgaguccgagaagaacgagaccuggaagcuggcccgggccagcuucaucgaggucaagacgugcaucuggcccaagucccacacccucuggagcaacggcgugcuggaguccgagaugaucauccccaagaucuacgggggcccgaucagccagcacaacuaccgccccggguacuucacccagaccgcgggccccuggcaccuggggaagcucgagcuggacuucgaccugugcgagggcacgaccguggucguggacgagcacugcggcaaccgggggccgucccuccgcaccaccacggugaccggcaagaucauccacgaguggugcugccggagcugcacccugccgccccugcgcuuccgcggggaggacggcugcugguacgggauggagauccgccccgucaaggagaaggaggagaaccucgugaaguccauggugagcgccggcagcggcgaggucgacuccuucagccuggggcugcucugcaucuccaucaugaucgaggaggugaugcggagccgcuggucccggaagaugcugaugaccggcacgcuggccguguucuuccuccugaucauggggcagcugaccuggaacgaccucauccgccugugcaucauggucggcgccaacgccagcgaccgcauggggaugggcaccaccuaccuggcgcucauggccacguucaagaugcggccgauguucgccgugggccugcuguuccgccggcucaccucccgcgaggugcugcugcucaccaucgggcugagccuggucgccuccguggagcuccccaacagccuggaggagcugggcgacgggcucgccaugggcaucaugauccugaagcugcucaccgacuuccagucccaccagcugugggcgacgcugcucagccugaccuucaucaagaccaccuucucccugcacuacgccuggaagacgauggccaugguccucagcaucgugucccuguucccccugugccucagcaccaccucccagaagaccacguggcugcccgugcugcucggcagccuggggugcaagccgcugaccauguuccucaucgccgagaacaagaucuggggccggcgcuccuggccccugaacgaggggaucauggcggucggcaucgugagcauccugcucagcucccugcugaagaacgacgugccccucgccgggccccugaucgccggcggcaugcugaucgccugcuacgucaucagcggguccagcgccgaccucucccuggagaaggcggccgaggugagcugggaggaggaggccgagcacuccggcgccagccacaacauccugguggagguccaggacgacgggaccaugaagaucaaggacgaggagcgggacgacacccucaccauccugcugaaggccacgcuccuggcgguguccggcguguacccgcugagcauccccgccacccucuucgucugguacuucuggcagaagaagaagcagcgcuccggggugcugugggacacccccagcccgcccgagguggagcgggccguccuggacgacggcaucuaccgcaucaugcagcggggccugcucgggcgcucccaggugggcgugggggucuuccaggagaacguguuccacaccauguggcacgugacgcggggcgccguccugauguaccaggggaagcgccuggagcccagcugggccuccgugaagaaggaccucaucagcuacggcggcggguggcggcugcagggcuccuggaacaccggggaggaggugcaggucaucgcgguggagcccggcaagaaccccaagaacgugcagaccgcccccgggaccuucaagacgcccgagggcgaggucggcgccaucgcccuggacuucaagcccgggaccagcggcucccccaucgugaaccgcgaggggaagaucgugggccucuacggcaacggggucgugaccaccagcggcacguacgugagcgccaucgcgcaggccaaggccucccaggaggggccgccgcccgagaucgaggacgaggucuuccggaagcgcaaccugaccaucauggaccugcacccgggcagcgggaagacccggcgcuaccuccccgccaucgugcgggaggcgaucaagcgcaagcugcgcacccugauccucgcccccacgcggguggucgccuccgagauggccgaggcccugaagggcaugcccauccgcuaccagaccaccgcggucaagagcgagcacaccggcaaggagaucguggaccugaugugccacgccacguucaccaugcggcuccuguccccgguccgcgugcccaacuacaacaugaucaucauggacgaggcccacuucaccgaccccagcuccaucgccgcccggggguacaucagcacccgcgugggcaugggggaggcggccgccaucuucaugacggccacgccgcccggcuccgucgaggccuucccccagagcaacgcggugauccaggacgaggagcgggacauccccgagcgcuccuggaacagcggguacgaguggaucaccgacuuccccggcaagaccgugugguucguccccuccaucaagagcggcaacgacaucgccaacugccugcggaagaacgggaagcgcgugauccagcucucccggaagacguucgacaccgaguaccagaagaccaagaacaacgacugggacuacguggucaccacggacaucagcgagaugggcgccaacuuccgcgccgaccgggugaucgacccccgccggugccugaagcccgugauccugaaggacgggcccgagcgcgucauccucgcgggcccgaugcccgugaccgucgccuccgccgcccagcggcgcgggcggaucggccgcaaccacaacaaggagggcgaccaguacaucuacauggggcagccccugaacaacgacgaggaccacgcccacuggaccgaggcgaagaugcugcucgacaacaucaacacccccgagggcaucaucccggcccuguucgagcccgagcgcgagaaguccgccgccaucgacggggaguaccggcugcgcggcgaggcccggaagacguucguggagcucaugcgccgcggggaccugcccguguggcuguccuacaaggucgcgagcgagggcuuccaguacagcgaccgccgguggugcuucgacggcgagcgcaacaaccaggugcucgaggagaacauggacguggagaucuggaccaaggagggggagcggaagaagcugcgcccccgguggcuggacgcccgcaccuacuccgacccgcucgcccugcgggaguucaaggaguucgccgccggccgccggagcgucuccggggaccugauccucgagaucggcaagcugccccagcaccugacccagcgcgcgcagaacgcccucgacaaccuggugaugcugcacaacagcgagcagggcgggcgggccuaccgccacgccauggaggagcuccccgacacgaucgagacccugaugcugcucgcgcugaucgccgugcugaccggcggggucacccucuucuuccuguccggccgggggcugggcaagaccagcaucggccuccugugcgugauggccuccagcgugcugcucuggauggccuccgucgagccccacuggaucgccgcgagcaucauccuggaguucuuccugauggugcuccugaucccggagcccgaccgccagcggacgccccaggacaaccagcuggccuacguggucaucgggcuccuguucaugauccugaccguggccgccaacgagaugggccuccuggagaccaccaagaaggaccuggggaucggccacguggccgucgagaaccaccaccacgcggccaugcucgacguggaccugcacccggccuccgccuggacgcuguacgccguggcgaccaccaucaucacccccaugaugcgccacacgaucgagaacaccaccgccaacaucagccucaccgccaucgccaaccaggccgcgauccugauggggcuggacaagggcuggcccaucuccaagauggacaucggcgucccccuccuggcccuggggugcuacagccaggugaacccgcucacgcugaccgccgccgugcugaugcucgucgcgcacuacgccaucaucggccccgggcugcaggccaaggccacccgcgaggcccagaagcggaccgcggccggcaucaugaagaaccccacgguggacgggaucguggccaucgaccuggaccccgucguguacgacgccaaguucgagaagcagcucggccagaucaugcugcugauccucugcaccucccagauccugcugaugcgcaccaccugggcccucugcgagagcaucacgcuggcgaccggcccgcugaccacccucugggaggggucccccggcaaguucuggaacacgaccaucgccgugagcauggccaacaucuuccggggguccuaccuggccggcgccggccuggcguucagccucaugaagucccucgggggcgggcgccgggggaccggggcccagggcgagacccugggcgagaaguggaagcgccagcucaaccagcuguccaagagcgaguucaacacguacaagcgguccgggaucauggaggucgaccgcagcgaggccaaggagggccugaagcgcggggagaccaccaagcacgccgugucccgcggcaccgcgaagcuccggugguucguggagcgcaaccuggucaagcccgaggggaaggugaucgaccugggcugcggccgcgggggcuggagcuacuacugcgccgggcugaagaaggugacggaggucaagggcuacaccaagggcggccccggccacgaggagccgauccccauggccaccuacggguggaaccucgugaagcugcacuccggcaaggacguguucuucaucccgcccgagaagugcgacacccugcucugcgacaucggggagagcuccccgaaccccacgaucgaggagggccgcacccugcggguccugaagaugguggagcccuggcuccgcgggaaccaguucugcaucaagauccugaaccccuacaugccgagcguggucgagacccuggagcagaugcagcggaagcacggcggcaugcucgugcgcaacccccugucccggaacagcacccacgagauguacuggguguccugcgggaccggcaacaucgucagcgccgugaacaugacgucccgcaugcugcucaaccgcuucaccauggcccaccggaagcccaccuacgagcgcgacguggaccugggggcgggcacccggcacgucgccguggagcccgagguggccaaccuggacaucaucggccagcgcaucgagaacaucaagcacgagcacaagagcacguggcacuacgacgaggacaacccguacaagaccugggccuaccacggguccuacgaggucaagcccagcggcuccgccagcagcauggugaacggggucgugaagcuccugaccaagcccugggacgugauccccauggucacccagaucgcgaugacggacaccaccccguucggccagcagcggguguucaaggagaagguggacacccgcacgcccaaggccaagcgggggaccgcccagaucauggaggucaccgccaaguggcuguggggcuuccucucccgcaacaagaagccccggaucugcacccgcgaggaguucacgcggaaggugcgcagcaacgccgcgaucggcgccguguucgucgacgagaaccaguggaacuccgccaaggaggccguggaggacgagcgguucugggaccuggugcaccgcgagcgggagcugcacaagcaggggaagugcgcgaccugcgucuacaacaugaugggcaagcgcgagaagaagcucggggaguucggcaaggccaaggggagccgggccaucugguacauguggcugggcgcccgcuuccuggaguucgaggcccucggcuucaugaacgaggaccacugguucucccgggagaacagccuguccgggguggagggcgaggggcugcacaagcucggcuacauccugcgcgacaucagcaagauccccgggggcaacauguacgcggacgacaccgccggcugggacacccggaucacggaggacgaccugcagaacgaggcccgcaucaccgacaucauggagcccgagcacgcccuccuggccaaguccaucuucaagcugaccuaccagaacaaggugguccgcgugcagcggcccgcgaagaacgggaccgugauggacgucaucagccgccgggaccagcgcggcuccggccagguggggacguacggccucaacaccuucaccaacauggaggcccagcugauccggcagauggagagcgaggggaucuucucccccagcgagcuggagaccccgaaccucgccgagcgcgugcuggacuggcuggagaaguacggcgucgagcggcucaagcgcauggccaucuccggggacgacugcguggugaagcccaucgacgaccgguucgccacggcgcugaccgcccugaacgacaugggcaagguccgcaaggacaucccccagugggagcccagcaagggguggaacgacuggcagcaggucccguucugcucccaccacuuccaccagcucaucaugaaggacggccgggagaucgugguccccugccgcaaccaggacgagcuggugggccgggcccgcgugagccagggggccggcuggagccugcgggagaccgccugccucgggaaguccuacgcgcagauguggcagcugauguacuuccaccgccgggaccugcgccucgccgccaacgccaucugcagcgcgguccccguggacuggauccccaccucccggacgaccuggagcauccacgcccaccaccaguggaugaccaccgaggacaugcuguccguguggaaccgcgucuggaucgaggagaacccguggauggaggacaagacgcacaucagcuccuggggcgacgugcccuaccuggggaagcgcgaggaccaguggugcggcagccucaucggccugaccgcccgggccaccugggccaccaacauccagguggcgaucaaccagguccgccggcugaucgggaacgagaacuaccucgacuacaugaccuccaugaagcgcuucaagaacgagagcgaccccgagggcgcccugugguga

SEQ ID NO: 8345 - RNA, 9879 nt, Artificial Sequence
  derived and/or modified CDS sequence (opt1) from DENV-1__FJ024456__SS-prME
agcgugaccaugcugcucaugcugaugcccaccgcccuggccuuccaccucaccacccggggcggggagccccacaugaucgugaccaagcaggagcggggcaagagccugcuguucaagaccagcgcgggggugaacaugugcauccucaucgccauggaccugggcgagcugugcgaggacaccaugaccuacaagugcccccggaucaccgaggccgagcccgacgacguggacugcuggugcaacgccaccgacaccugggugaccuacgggaccugcagccagaccggcgagcaccggcgcgacaagcggagcguggcccucgcgccccacgugggccuggggcuggagacgcgcaccgagaccuggauguccagcgagggcgccuggaagcagauccagcgggucgagaccugggcccuccgccaccccggguucacggugaucgcccuguuccuggcgcacgccaucggcaccuccaucacccagaaggggaucaucuucauccuccugaugcuggugacccccagcauggccaugcggugcgucggcaucggcucccgcgacuucguggaggggcucagcggcgccacguggguggacgucgugcuggagcacggguccugcgugaccaccauggccaaggacaagcccacccuggacaucgagcuccugaagacggaggucaccaaccccgcggugcugcggaagcucugcaucgaggccaagaucagcaacaccaccacggacucccgcugccccacccagggcgaggccacccugauggaggagcaggacgccaacuucgugugccggcgcaccuucgucgaccggggcugggggaacggcugcgggcuguucggcaaggggagccucaucacgugcgccaaguucaagugcgugaccaagcuggagggcaagaucgugcaguacgagaaccugaaguacuccgucaucgugaccgugcacaccggcgaccagcaccaggucgggaacgagagcacggagcacggcaccaccgcgaccaucacgccccaggcccccacguccgagauccagcucaccgacuacggggcccugacccuggacugcagcccccgcaccggccucgacuucaacgagauggugcugcugacgaugaaggagaaguccuggcucguccacaagcagugguuccuggaccugccgcuccccuggaccagcggggccagcaccucccaggagaccuggaaccggcaggaccugcuggugacguucaagaccgcccacgcgaagaagcaggagguggucgugcucggcagccaggagggcgccaugcacaccgcccugaccggggccacggagauccagaccuccggcaccaccacgaucuucgccgggcaccugaagugccgccucaagauggacaagcugacccugaagggcaugagcuacgugaugugcaccggguccuucaagcucgagaaggaggucgcggagacccagcacggcacggugcuggugcagaucaaguacgagggcaccgacgcccccugcaagauccccuucagcacccaggacgagaagggggucauccagaacggccggcugaucaccgccaacccgaucgugacggacaaggagaagcccgugaacaucgaggccgagccgcccuucggggaguccuacaucgucaucggcgugggcgagaaggcgcugaagcucagcugguucaagaagggguccagcaucggcaagauguucgaggccaccgcccgcggggcccggcgcauggccauccugggcgacaccgcgugggacuucggguccaucggcggcguguucaccagcgucgggaagcuggugcaccagaucuucggcacggccuacgggguccuguucuccggcgucagcuggaccaugaagaucgggaucggcgugcugcugaccuggcucggccugaacucccgcagcaccucccugagcaugacgugcaucgccguggggcucgucacccuguaccugggcgugauggugcaggccgacuccgggugcgucaucaacuggaagggccgggagcucaagugcgggagcggcaucuucgugaccaacgaggugcacaccuggacggagcaguacaaguuccaggccgacagcccgaagcgccuguccgcggccaucggcaaggccugggaggagggggucugcggcauccggagcgccacccgccuggagaacaucauguggaagcagaucuccaacgagcucaaccacauccugcuggagaacgacaugaaguucaccgugguggucggggacguggugggcauccucgcccaggggaagaagaugauccggccccagcccauggagcacaaguacagcuggaaguccuggggcaaggcgaagaucaucggcgccgacguccagaacaccaccuucaucaucgacgggcccaacacgccggagugccccgacgaccagcgcgccuggaacaucugggagguggaggacuacggcuucgggaucuucaccaccaacaucuggcugaagcugcgggacagcuacacccaggccugcgaccaccgccucauguccgcggccaucaaggacagcaaggccgugcacgccgacaugggcuacuggaucgaguccgagaagaacgagacguggaagcuggcccgggcgagcuucaucgaggucaagaccugcaucuggcccaagucccacacccuguggagcaacggcgugcucgaguccgagauggugauccccaagaucuacgggggcccgaucagccagcacaacuaccgccccggguacuucacccagacggccggccccuggcaccuggggaagcuggagcucgacuucgaccugugcgagggcaccaccgucgugguggacgagcacugcggcaaccgggggccgucccugcgcaccacgaccgucaccggcaagaucauccacgaguggugcugccggagcugcacccugccgccccuccgcuucaagggggaggacggcugcugguacgggauggagauccggcccgugaaggagaaggaggagaaccuggugaaguccauggucagcgccggcagcggcgagguggacuccuucagccucgggcugcugugcaucuccaucaugaucgaggaggugaugcgcagccgguggucccgcaagaugcucaugacgggcacccuggccgucuuccugcuccugaucauggggcagcugaccuggaacgaccucauccggcugugcaucauggugggcgccaacgcgagcgaccgcauggggaugggcaccacguaccuggcccucauggccaccuucaagaugcgcccgauguucgccguggggcugcuguuccggcgccucaccucccgggagguccugcugcucaccaucgggcugagccugguggccuccgucgagcuccccaacagccuggaggagcugggcgacgggcucgcgaugggcaucaugauccugaagcugcucacggacuuccagucccaccagcugugggccacccugcucagccugaccuucaucaagaccacgcugucccuccacuacgccuggaagaccauggccauggugcugagcaucgugucccuguucccccucugccugagcaccaccucccagaagacgaccuggcugcccguccuccugggcagccuggggugcaagccgcucaccauguuccugaucgcggagaacaagaucuggggccgcaaguccuggccccugaacgaggggaucauggccgugggcguggucagcauccuccugagcucccugcucaagaacgacgugccccuggccgggccccugaucgccggcggcaugcucaucgccugcuacgugaucagcggguccagcgcggaccugucccuggagaaggccgccgaggucagcugggaggaggaggccgagcacuccggcgccagccacaacauccucguggaggugcaggacgacgggaccaugaagaucaaggacgaggagcgggacgacacgcugaccauccugcucaaggcgacccugcuggccgucuccggcguguacccgcucagcauccccgccacccuguucgugugguacuucuggcagaagaagaagcagcgcuccgggguccugugggacacccccagcccgcccgagguggagcgggccgugcuggacgacggcaucuaccgcaucaugcagcggggccuccuggggcgcucccaggucggcguggggguguuccaggagaacgucuuccacacgauguggcacgugacccggggcgccgugcugauguaccaggggaagcgccucgagcccagcugggcguccgucaagaaggaccugaucagcuacggcggcggguggcggcugcagggcuccuggaacaccggggaggagguccaggugaucgccgucgagcccggcaagaaccccaagaacgugcagaccgcccccgggacguucaagacccccgagggcgaggugggcgccaucgcccucgacuucaagcccgggaccagcggcucccccaucgucaaccgcgaggggaagaucgugggccuguacggcaacgggguggucaccacgagcggcaccuacgugagcgcgaucgcccaggccaaggccucccaggaggggccgcugcccgagaucgaggacgagguguuccggaagcgcaaccucaccaucauggaccugcaccccggcagcgggaagacccggcgcuaccugccggcgaucguccgggaggccaucaagcgcaagcuccggacgcugauccuggcccccacccgcgugguggccuccgagauggccgaggcgcucaagggcaugcccauccgcuaccagaccaccgccgucaagagcgagcacacgggcaaggagaucguggaccugaugugccacgccaccuucaccaugcggcugcucucccccgugcgcgucccgaacuacaacaugaucaucauggacgaggcccacuucaccgaccccagcuccaucgccgcgcggggguacaucagcacgcgcgugggcaugggggaggccgccgccaucuucaugaccgccacgccgcccggcuccguggaggcguucccgcagagcaacgccgucauccaggacgaggagcgggacauccccgagcgcuccuggaacagcggguacgaguggaucaccgacuuccccggcaagacggugugguucgugcccuccaucaagagcggcaacgacaucgccaacugccugcggaagaacgggaagcgcgucauccagcugucccggaagaccuucgacaccgaguaccagaagaccaagaacaacgacugggacuacguggugacgaccgacaucagcgagaugggcgccaacuuccgcgcggaccgggucaucgacccgcgccggugccucaagcccgugauccugaaggacgggcccgagcgcgucauccuggccggccccaugccggugaccguggccuccgccgcccagcggcgcgggcggaucggccgcaaccacaacaaggagggcgaccaguacaucuacauggggcagccccucaacaacgacgaggaccacgcgcacuggaccgaggccaagaugcugcuggacaacaucaacacgcccgagggcaucauccccgcccucuucgagccggagcgggagaaguccgccgccaucgacggggaguaccgccugcgcggcgaggcgcggaagaccuucgucgagcugaugcgccgcggggaccuccccguguggcuguccuacaagguggccagcgagggcuuccaguacagcgaccgccgguggugcuucgacggcgagcgcaacaaccagguccuggaggagaacauggacguggagaucuggaccaaggagggggagcggaagaagcuccgcccccgguggcuggacgcccgcaccuacuccgacccccuggcccuccgggaguucaaggaguucgccgcgggccgccggagcguguccggggaccugauccuggagaucggcaagcucccgcagcaccugacgcagcgcgcccagaacgcccuggacaaccucgucaugcugcacaacagcgagcagggcgggcgggccuaccgccacgcgauggaggagcugcccgacaccaucgagacccucaugcugcuggcccucaucgccgugcugaccggcggggugacgcuguucuuccucuccggccgggggcugggcaagaccagcaucggccugcucugcgucauggccuccagcgugcugcuguggauggccuccguggagccccacuggaucgcggccagcaucauccucgaguucuuccugaugguccugcucauccccgagccggaccgccagcggacgccccaggacaaccagcuggccuacguggugaucgggcuccucuucaugauccugaccgucgccgccaacgagaugggccugcucgagaccacgaagaaggaccuggggaucggccacguggcgguggagaaccaccaccacgccaccaugcuggacgucgaccuccaccccgccuccgccuggacccuguacgccguggcgaccacgaucaucaccccgaugaugcgccacaccaucgagaacaccacggccaacaucagccugaccgccaucgccaaccaggccgcgauccucauggggcuggacaagggcuggcccaucuccaagauggacaucggcgugccccugcucgcccuggggugcuacagccaggucaacccccugacccucaccgccgccgugcugaugcugguggcgcacuacgccaucaucggcccggggcuccaggccaaggccacgcgggaggcccagaagcgcaccgcggccggcaucaugaagaaccccaccgucgacgggaucguggccaucgaccuggaccccguggucuacgacgccaaguucgagaagcagcugggccagaucaugcuccugauccugugcaccucccagauccuccugaugcgcacgaccugggcccugugcgagagcaucacccucgcgaccggcccccugacgacccugugggagggguccccgggcaaguucuggaacaccaccaucgccgugagcauggccaacaucuuccggggguccuaccucgccggcgccggccuggcguucagccugaugaagucccucgggggcgggcgccggggcacgggggcccagggcgagacccugggcgagaaguggaagcgccagcugaaccagcucuccaagagcgaguucaacaucuacaagcgguccgggaucauggagguggaccgcagcgaggccaaggagggccugaagcgcggggagaccacccgccacgccgucucccggggcacggcgaagcugcgcugguucguggagcggaaccuggugaagcccgaggggaaggucaucgaccucggcugcggccgcgggggcuggagcuacuacugcgccgggcugaagaaggugaccgaggugaagggcuacaccaagggcgggcccggcauggaggagcccaucccgauggccaccaacggguggaaccuggucaagcuccacuccggcaaggacguguucuucacgccgcccgagaagugcgacacccugcugugcgacaucggggagagcucccccaacccgaccaucgaggagggccggacccuccgcgugcugaagauggucgagcccuggcugcgggggaaccaguucugcaucaagauccucaaccccuacaugcccagcgugguggagacgcuggagcagaugcagcgcaagcacggcggcaugcugguccggaacccgcucucccgcaacagcacccacgagauguacuggguguccugcgggaccggcaacaucgugagcgccgucaacaugaccucccggaugcugcugaaccgcuucaccauggcccaccgcaagcccacguacgagcgggacguggaccucggggcgggcacccgccacguggccgucgagcccgagguggccaaccuggacaucaucggccagcggaucgagaacaucaagcacgagcacaagagcaccuggcacuacgacgaggacaaccccuacaagaccugggccuaccacggguccuacgaggucaagccgagcggcuccgccagcagcauggugaacgggguggucaagcugcucacgaagcccugggacgugauccccauggugacccagaucgcgaugaccgacaccacgcccuucggccagcagcgcgucuucaaggagaagguggacacccggaccccgaaggccaagcgcgggaccgcccagaucauggaggugacggcccgguggcuguggggcuuccugucccgcaacaagaagccccggaucugcacccgcgaggaguucacccggaagguccgcagcaacgccgcgaucggcgccguguucguggacgagaaccaguggaacuccgccaaggaggccgucgaggacgagcgguucugggaccucgugcagaaggagcgcgagcugcacaagcaggggaagugcgcgaccugcguguacaacaugaugggcaagcgggagaagaagcugggggaguucggcaaggccaaggggagccgcgccaucugguacauguggcucggcgcccgguuccuggaguucgaggcccugggcuucaugaacgaggaccacugguucucccgcgagaacagccucuccggggucgagggcgaggggcugcacaagcugggcuacauccuccgggacaucagcaagauccccgggggcaacauguacgcggacgacacggccggcugggacacccgcaucaccgaggacgaccugcagaacgaggccaagaucaccgacaucauggagccggagcacgcccugcucgccacguccaucuucaagcugaccuaccagaacaagguggugcggguccagcgccccgcgaagaacgggaccgugauggacgugaucagccgccgggaccagcgcggcuccgggcaggucggcaccuacggccugaacacguucaccaacauggaggcccagcucauccggcagauggagagcgaggggaucuuccugcccuccgagcuggagacccccaaccucgccgagcgcgugcuggacuggcuggagaagcacggcguggagcggcucaagcgcauggccaucagcggggacgacugcgucgugaagccgaucgacgaccgguucgccaccgcgcugacggcccugaacgacaugggcaaggugcgcaaggacaucccccagugggagcccuccaagggguggaacgacuggcagcagguccccuucugcagccaccacuuccaccagcucaucaugaaggacggccgggagaucguggugccgugccgcaaccaggacgagcuggucggccgggcccgcgugucccagggggccggcuggagccugcgggagaccgccugccucggcaagagcuacgcgcagauguggcagcugauguacuuccaccgccgggaccugcgccucgccgccaacgccaucugcuccgcggugcccgucgacugggugcccaccagccggaccacgugguccauccacgcccaccaccaguggaugaccaccgaggacaugcugagcguguggaaccgcgucuggaucgaggagaaccccuggauggaggacaagacccacguguccagcuggggcgacgugccguaccuggggaagcgggaggaccaguggugcggcucccucaucggccugacggcccgcgccaccugggccagcaacauccaggucgcgaucaaccaggugcgccggcugaucgggaacgagaacuaccucgacuacaugaccuccaugaagcgcuucaagaacgagggcgaccccgagggggcccugugguga

SEQ ID NO: 8346 - RNA, 9879 nt, Artificial Sequence
  derived and/or modified CDS sequence (opt1) from DENV-1__FJ024457__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgagaccgagcccgacgacguggacugcuggugcaacgccacggacaccugggugaccuacgggaccugcagccagacgggcgagcaccggcgggacaagcgguccguggcccucgcgccccacgugggccuggggcuggagacccgcaccgagaccuggaugagcuccgagggcgccuggaagcagauccagcgggucgagacgugggcccuccggcaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagguggccgagacccagcacggcaccgugcugguccagaucaaguacgagggcaccgacgcgcccugcaagauccccuucagcacgcaggacgagaagggggugacccagaacggccggcugaucaccgccaacccgaucgugaccgacaaggagaagcccgucaacaucgaggccgagccgcccuucggggaguccuacaucgugaucggcgccggcgagaaggcgcugaagcucagcugguucaagaagggguccagcaucggcaagauguucgaggccacggcccgcggggcccggcgcauggccauccugggcgacaccgcgugggacuucggguccaucggcggcguguucaccagcgucgggaagcuggugcaccagaucuucggcaccgccuacggggugcuguucuccggcgucagcuggacgaugaagaucgggaucggcgugcugcugaccuggcucggccugaacucccgcagcaccucccugagcaugaccugcaucgccguggggcucgucacgcuguaccugggcgugauggugcaggccgacuccgggugcgucaucaacuggaagggccgggagcucaagugcgggagcggcaucuucgugaccaacgaggugcacaccuggaccgagcaguacaaguuccaggccgacagcccgaagcgccuguccgcggccaucggcaaggccugggaggagggggucugcggcauccggagcgccacccgccuggagaacaucauguggaagcagaucuccaacgagcucaaccacauccugcuggagaacgacaugaaguucacggugguggucggggacguggccggcauccucgcgcaggggaagaagaugauccggccccagcccauggaguacaaguacagcuggaaguccuggggcaaggccaagaucaucggcgccgacgugcagaacaccaccuucaucaucgacgggcccaacaccccggagugccccgacgaccagcgcgccuggaacaucugggaggucgaggacuacggcuucgggaucuucacgaccaacaucuggcugaagcugcgggacagcuacacccaggugugcgaccaccgccucauguccgcggccaucaaggacagcaaggccgugcacgccgacaugggcuacuggaucgaguccgagaagaacgagaccuggaagcuggcccgggcgagcuucaucgaggucaagacgugcaucuggcccaagucccacacccuguggagcaacggcgugcucgaguccgagaugaucauccccaagaucuacgggggcccgaucagccagcacaacuaccgccccggguacuucacccagaccgccggccccuggcaccuggggaagcuggagcucgacuucgaccugugcgagggcacgaccguggucguggacgagcacugcggcaaccgggggccgucccugcgcaccaccacggugaccggcaagaucauccacgaguggugcugccggagcugcacccugccgccccuccgcuuccgcggggaggacggcugcugguacgggauggagauccgccccgucaaggagaaggaggagaaccuggugaaguccauggugagcgccggcagcggcgaggucgacuccuucagccucgggcugcugugcaucuccaucaugaucgaggaggugaugcggagccgcuggucccggaagaugcucaugaccggcacgcuggccguguucuuccugcucaucauggggcagcugaccuggaacgaccugauccgccucugcaucauggucggcgccaacgcgagcgaccgcauggggaugggcaccaccuaccuggcccugauggccacguucaagaugcggccgauguucgccgugggccuccuguuccgccggcugaccucccgcgaggugcuccugcugaccaucgggcucagccuggucgccuccguggagcugcccaacagccucgaggagcugggcgacgggcuggcgaugggcaucaugauccucaagcugcugaccgacuuccagucccaccagcucugggccacgcugcugagccucaccuucaucaagaccaccuucucccugcacuacgccuggaagacgauggccaugguccugagcaucgugucccucuucccccugugccugagcaccaccucccagaagaccacguggcuccccgugcugcugggcagccucgggugcaagccgcugaccauguuccugaucgcggagaacaagaucuggggccggcgcuccuggccccucaacgaggggaucauggccgucggcaucgugagcauccugcugagcucccuccugaagaacgacgugccccuggccgggccccucaucgccggcggcaugcugaucgccugcuacgucaucagcggguccagcgcggaccugucccucgagaaggccgccgaggugagcugggaggaggaggccgagcacuccggcgccagccacaacauccugguggagguccaggacgacgggaccaugaagaucaaggacgaggagcgggacgacacccugaccauccuccugaaggcgacgcugcucgccguguccggcguguacccgcugagcauccccgccacccuguucgucugguacuucuggcagaagaagaagcagcgcuccggggugcucugggacacccccagcccgcccgagguggagcgggccguccuggacgacggcaucuaccgcaucaugcagcggggccugcuggggcgcucccaggugggcgugggggucuuccaggagaacguguuccacaccauguggcacgugacgcggggcgccguccucauguaccaggggaagcgccuggagcccagcugggcguccgugaagaaggaccugaucagcuacggcggcggguggcggcuccagggcuccuggaacaccggggaggaggugcaggucaucgccguggagcccggcaagaaccccaagaacgugcagaccgcccccgggaccuucaagacgcccgagggcgaggucggcgccaucgcccuggacuucaagcccgggaccagcggcucccccaucgugaaccgcgaggggaagaucgugggccuguacggcaacggggucgugaccaccagcggcacguacgugagcgcgaucgcccaggccaaggccucccaggaggggccgcuccccgagaucgaggacgaggucuuccggaagcgcaaccugaccaucauggaccugcaccccggcagcgggaagacccggcgcuaccucccggcgaucgugcgggaggccaucaagcgcaagcugcgcacccugauccucgcccccacgcggguggucgccuccgagauggccgaggcgcugaagggcaugcccauccgcuaccagaccaccgccgucaagagcgagcacaccggcaaggagaucguggaccugaugugccacgccacguucaccaugcggcuccugucccccguccgcgugccgaacuacaacaugaucaucauggacgaggcccacuucaccgaccccagcuccaucgccgcgcggggguacaucagcacccgcgugggcaugggggaggccgccgccaucuucaugacggccacgccgcccggcuccgucgaggcguucccgcagagcaacgccgugauccaggacgaggagcgggacauccccgagcgcuccuggaacagcggguacgaguggaucaccgacuuccccggcaagaccgugugguucguccccuccaucaagagcggcaacgacaucgccaacugccugcggaagaacgggaagcgcgugauccagcucucccggaagacguucgacaccgaguaccagaagaccaagaacaacgacugggacuacguggucaccacggacaucagcgagaugggcgccaacuuccgcgcggaccgggugaucgacccgcgccggugccugaagcccgugauccugaaggacgggcccgagcgcgucauccucgccggccccaugccggugaccgucgccuccgccgcccagcggcgcgggcggaucggccgcaaccacaacaaggagggcgaccaguacaucuacauggggcagccccugaacaacgacgaggaccacgcgcacuggaccgaggccaagaugcugcucgacaacaucaacacccccgagggcaucauccccgcccuguucgagccggagcgcgagaaguccgccgccaucgacggggaguaccggcugcgcggcgaggcgcggaagacguucguggagcucaugcgccgcggggaccugcccguguggcuguccuacaaggucgccagcgagggcuuccaguacagcgaccgccgguggugcuucgacggcgagcgcaacaaccaggugcucgaggagaacauggacguggagaucuggaccaaggagggggagcggaagaagcugcgcccccgguggcuggacgcccgcaccuacuccgacccccucgcccugcgggaguucaaggaguucgccgcgggccgccggagcgucuccggggaccugauccucgagaucggcaagcugccgcagcaccugacccagcgcgcccagaacgcccucgacaaccuggugaugcugcacaacagcgagcagggcgggcgggccuaccgccacgcgauggaggagcuccccgacacgaucgagacccugaugcugcucgcccugaucgccgugcugaccggcggggucacccucuucuuccuguccggccgggggcugggcaagaccagcaucggccuccugugcgugauggccuccagcgugcugcucuggauggccuccgucgagccccacuggaucgcggccagcaucauccuggaguucuuccugauggugcuccugauccccgagccggaccgccagcggacgccccaggacaaccagcuggccuacguggucaucgggcuccuguucaugauccugaccguggccgccaacgagaugggccuccuggagaccaccaagaaggaccuggggaucggccacguggcggucgagaaccaccaccacgccgccaugcucgacguggaccugcaccccgccuccgccuggacgcuguacgcgguggccaccaccaucaucaccccgaugaugcgccacacgaucgagaacaccaccgccaacaucagccucaccgccaucgccaaccaggcggccauccugauggggcuggacaagggcuggcccaucuccaagauggacaucggcgucccccuccuggcccuggggugcuacagccaggugaacccccucacgcugaccgccgcggugcugaugcucgucgcccacuacgccaucaucggcccggggcugcaggccaaggccacccgcgaggcgcagaagcggaccgccgccggcaucaugaagaaccccacgguggacgggaucguggccaucgaccuggaccccgucguguacgacgccaaguucgagaagcagcucggccagaucaugcugcugauccucugcaccucccagauccugcugaugcgcaccaccugggcgcucugcgagagcaucacgcuggccaccggcccccugaccacccucugggagggguccccgggcaaguucuggaacacgaccaucgccgugagcauggccaacaucuuccggggguccuaccuggccggcgcgggccuggccuucagccucaugaagucccucgggggcgggcgccgggggaccggggcccagggcgagacccugggcgagaaguggaagcgccagcucaaccagcuguccaagagcgaguucaacacguacaagcgguccgggaucauggaggucgaccgcagcgaggccaaggagggccugaagcgcggggagaccaccaagcacgcggugucccgcggcaccgccaagcuccggugguucguggagcgcaaccuggucaagcccgaggggaaggugaucgaccugggcugcggccgcgggggcuggagcuacuacugcgccgggcugaagaaggugacggaggucaagggcuacaccaagggcggccccggccacgaggagcccaucccgauggccaccuacggguggaaccucgugaagcugcacuccggcaaggacguguucuucaucccgcccgagaagugcgacacccugcucugcgacaucggggagagcucccccaacccgacgaucgaggagggccgcacccugcggguccugaagaugguggagcccuggcuccgcgggaaccaguucugcaucaagauccugaaccccuacaugcccagcguggucgagacccuggagcagaugcagcggaagcacggcggcaugcucgugcgcaacccgcugucccggaacagcacccacgagauguacuggguguccugcgggaccggcaacaucgucagcgccgugaacaugacgucccgcaugcugcucaaccgcuucaccauggcgcaccggaagcccaccuacgagcgcgacguggaccugggggccggcacccggcacgucgccguggagcccgagguggccaaccuggacaucaucggccagcgcaucgagaacaucaagcacgagcacaagagcacguggcacuacgacgaggacaaccccuacaagaccugggccuaccacggguccuacgaggucaagccgagcggcuccgcgagcagcauggugaacggggucgugaagcuccugaccaagcccugggacgugauccccauggucacccagaucgccaugacggacaccacccccuucggccagcagcggguguucaaggagaagguggacacccgcacgccgaaggccaagcgggggaccgcccagaucauggaggucaccgccaaguggcuguggggcuuccucucccgcaacaagaagccccggaucugcacccgcgaggaguucacgcggaaggugcgcagcaacgcggccaucggcgccguguucgucgacgagaaccaguggaacuccgccaaggaggcgguggaggacgagcgguucugggaccuggugcaccgcgagcgggagcugcacaagcaggggaagugcgcgaccugcgucuacaacaugaugggcaagcgcgagaagaagcucggggaguucggcaaggccaaggggagccgggccaucugguacauguggcugggcgcccgcuuccuggaguucgaggcgcucggcuucaugaacgaggaccacugguucucccgggagaacagccuguccgggguggagggcgaggggcugcacaagcucggcuacauccugcgcgacaucagcaagauccccgggggcaacauguacgccgacgacaccgccggcugggacacccggaucacggaggacgaccugcagaacgaggcccgcaucaccgacaucauggagccggagcacgcccuccuggcgcgcuccaucuucaagcugaccuaccagaacaaggugguccgggugcagcgccccgccaagaacgggaccgugauggacgucaucagccggcgcgaccagcggggcuccggccagguggggacguacggccucaacaccuucaccaacauggaggcccagcugauccgccagauggagagcgaggggaucuucucccccagcgagcuggagacccccauccucgccgagcgggugcuggacuggcuggagaaguacggcgucgagcgccucaagcggauggccaucuccggggacgacugcguggugaagccgaucgacgaccgcuucgcgacggcccugaccgcccugaacgacaugggcaagguccggaaggacaucccccagugggagcccagcaagggguggaacgacuggcagcagguccccuucugcucccaccacuuccaccagcucaucaugaaggacggccgcgagaucguggucccgugccggaaccaggacgagcuggugggccgcgcccgggugagccagggggccggcuggagccugcgcgagaccgcgugccucgggaaguccuacgcccagauguggcagcugauguacuuccaccggcgcgaccugcggcucgccgccaacgcgaucugcagcgccguccccguggacuggauccccaccucccgcacgaccuggagcauccacgcccaccaccaguggaugaccaccgaggacaugcuguccguguggaaccgcgucuggaucgaggagaaccccuggauggaggacaagacgcacaucagcuccuggggcgacgugccguaccuggggaagcgggaggaccaguggugcggcagccucaucggccugaccgcccgcgccaccugggcgaccaacauccagguggccaucaaccagguccggcgccugaucgggaacgagaacuaccucgacuacaugaccuccaugaagcgguucaagaacgagagcgaccccgagggcgcccugugguga

SEQ ID NO: 8347 - RNA, 9879 nt, Artificial Sequence
  derived and/or modified CDS sequence (opt1) from DENV-1__FJ205881__SS-prME
agcgugaccaugcugcuccugcugaugcccaccgcccucgccuuccaccugaccacccggggcggggagccccacaugaucgugagcaagcaggagcggggcaagagccuccuguucaagaccagcgcgggggugaacaugugcacccugaucgccauggaccugggcgagcucugcgaggacaccaugaccuacaagugcccccggaucaccgagaccgagcccgacgacguggacugcuggugcaacgccaccgacaccugggucaccuacgggaccugcagccagacgggcgagcaccggcgggacaagcgguccguggcccuggcgccccacgugggccuggggcucgagacccgcaccgagaccuggaugagcuccgagggcgccuggaagcagauccagcgggucgagacgugggcccugcggcaccccggguucaccgugaucgcccuguuccucgcccacgcgaucggcaccagcaucacccagaaggggaucaucuucauccugcugaugcucgugacgcccuccauggccaugcggugcgucggcaucggcagccgcgacuucguggaggggcuguccggcgccaccuggguggacgucgugcuggagcacgggagcugcgugaccaccauggccaaggacaagcccacgcucgacaucgagcugcugaagaccgaggucaccaaccccgccgugcuccggaagcugugcaucgaggcgaagaucuccaacaccacgaccgacagccgcugcccgacccagggcgaggccacccugguggaggagcaggacgccaacuucgucugccggcgcacguucguggaccggggcugggggaacggcugcggccuguucggcaaggggucccugaucacgugcgccaaguucaagugcgugaccaagcuggagggcaagaucguccaguacgagaaccucaaguacagcgugaucgugaccguccacacgggcgaccagcaccagguggggaacgaguccaccgagcacggcaccaccgccaccaucacgccccaggcgcccaccaccgagauccagcugaccgacuacggggcccugacgcucgacugcagcccccgcaccggccuggacuucaacgagaugguccugcucaccaugaaggagaaguccuggcuggugcacaagcagugguuccuggaccucccccugcccuggaccagcggggccagcacgucccaggagaccuggaaccggcaggaccugcucgugaccuucaagaccgcccacgccaagaagcaggaggucguggugcugggcagccaggagggcgcgaugcacacggcccugaccggggccaccgagauccagaccuccggcacgaccaccaucuucgccgggcaccucaagugccgccugaagauggacaagcugacccucaagggcaugagcuacgucaugugcacgggguccuucaagcuggagaaggagcuggccgagacccagcacggcaccgugcuggugcagaucaaguacgagggcaccgacgcgcccugcaagauccccuucagcacgcaggacgagaagggggucacccagaacggccggcucaucaccgccaacccgaucgugaccgacaaggagaagcccgugaacaucgaggccgagccgcccuucggggaguccuacaucgucaucggcgccggcgagaaggcgcugaagcugagcugguucaagaagggguccagcaucggcaagauguucgaggccacggcccgcggggcccggcgcauggccauccucggcgacaccgcgugggacuucggguccaucggcggcguguucaccagcguggggaagcugguccaccagaucuucggcaccgccuacggggugcuguucuccggcgugagcuggacgaugaagaucgggaucggcguccuccugaccuggcugggccucaacucccgcagcaccucccugagcaugaccugcaucgccguggggcuggugacgcucuaccugggcgucauggugcaggccgacuccgggugcgugaucaacuggaagggccgggagcugaagugcgggagcggcaucuucgucaccaacgaggugcacaccuggaccgagcaguacaaguuccaggccgacagcccgaagcgccucuccgcggccaucggcaaggccugggaggagggggugugcggcauccggagcgccacccgccuggagaacaucauguggaagcagaucuccaacgagcugaaccacauccuccuggagaacgacaugaaguucacggucguggugggggacgucgccggcauccuggcgcaggggaagaagaugauccggccccagcccauggaguacaaguacagcuggaaguccuggggcaaggccaagaucaucggcgccgacgugcagaacaccaccuucaucaucgacgggcccaacaccccggagugccccgacgaccagcgcgccuggaacaucugggagguggaggacuacggcuucgggaucuucacgaccaacaucuggcucaagcugcgggacagcuacacccaggucugcgaccaccgccugauguccgcggccaucaaggacagcaaggccgugcacgccgacaugggcuacuggaucgaguccgagaagaacgagaccuggaagcucgcccgggcgagcuucaucgaggugaagacgugcaucuggcccaagucccacacccuguggagcaacggcguccuggaguccgagaugaucauccccaagaucuacgggggcccgaucagccagcacaacuaccgccccggguacuucacccagaccgccggccccuggcaccucgggaagcuggagcuggacuucgaccucugcgagggcacgaccgugguggucgacgagcacugcggcaaccgggggccgucccugcgcaccaccacggugaccggcaagaucauccacgaguggugcugccggagcugcacccugccgccccugcgcuuccgcggggaggacggcugcugguacgggauggagauccgccccgugaaggagaaggaggagaaccuggucaaguccauggugagcgccggcagcggcgagguggacuccuucagccuggggcuccugugcaucuccaucaugaucgaggaggucaugcggagccgcuggucccggaagaugcugaugaccggcacgcucgccguguucuuccugcugaucauggggcagcucaccuggaacgaccugauccgccugugcaucauggugggcgccaacgcgagcgaccgcauggggaugggcaccaccuaccucgcccugauggccacguucaagaugcggccgauguucgccgucggccuccucuuccgccggcugaccucccgcgaggugcugcuccugaccaucgggcugagccucguggccuccgucgagcugcccaacagccuggaggagcucggcgacgggcuggcgaugggcaucaugauccugaagcuccugaccgacuuccagucccaccagcugugggccacgcuccugagccugaccuucaucaagaccaccuucucccuccacuacgccuggaagacgauggccauggugcugagcaucgucucccuguucccccucugccugagcaccaccucccagaagaccacguggcugcccgugcuccugggcagccuggggugcaagccgcucaccauguuccugaucgcggagaacaagaucuggggccggcgcuccuggccccugaacgaggggaucauggccgugggcaucgucagcauccuccugagcucccugcucaagaacgacgugccccuggccgggccccugaucgccggcggcaugcucaucgccugcuacgugaucagcggguccagcgcggaccugucccuggagaaggccgccgaggucagcugggaggaggaggccgagcacuccggcgccagccacaacauccucguggaggugcaggacgacgggaccaugaagaucaaggacgaggagcgggacgacacccugaccauccugcucaaggcgacgcugcuggccgucuccggcguguacccgcucagcauccccgccacccuguucgugugguacuucuggcagaagaagaagcagcgcuccgggguccugugggacacccccagcccgcccgagguggagcgggccgugcuggacgacggcaucuaccgcaucaugcagcggggccuccuggggcgcucccaggucggcguggggguguuccaggagaacgucuuccacaccauguggcacgugacgcggggcgccgugcugauguaccaggggaagcgccucgagcccagcugggcguccgucaagaaggaccugaucagcuacggcggcggguggcggcugcagggcuccuggaacaccggggaggagguccaggugaucgccgucgagcccggcaagaaccccaagaacgugcagaccgcccccgggaccuucaagacgcccgagggcgaggugggcgccaucgcccucgacuucaagcccgggaccagcggcucccccaucgucaaccgcgaggggaagaucgugggccuguacggcaacgggguggucaccaccagcggcacguacgugagcgcgaucgcccaggccaagaccucccaggaggggccgcugcccgagaucgaggacgagguguuccggaagcgcaaccucaccaucauggaccugcaccccggcagcgggaagacccggcgcuaccugccggccaucguccgggaggcgaucaagcgcaagcuccgcacgcugauccuggcccccacccgggugguggccuccgagauggccgaggcccucaagggcaugcccauccgcuaccagaccaccgcggucaagagcgagcacacgggcaaggagaucguggaccugaugugccacgccaccuucaccaugcggcugcucucccccgugcgcgucccgaacuacaacaugaucaucauggacgaggcccacuucaccgaccccagcuccaucgccgcccggggguacaucagcacgcgcgugggcaugggggaggcggccgccaucuucaugaccgccacgccgcccggcuccguggaggccuucccgcagagcaacgcggucauccaggacgaggagcgggacauccccgagcgcuccuggaacagcggguacgaguggaucaccgacuuccccggcaagacggugugguucgugcccuccaucaagagcggcaacgacaucgccaacugccugcggaagaacgggaagcgcgucauccagcugucccggaagaccuucgacaccgaguaccagaagaccaagaacaacgacugggacuacguggugacgaccgacaucagcgagaugggcgccaacuuccgcgccgaccgggucaucgacccgcgccggugccucaagcccgugauccugaaggacgggcccgagcgcgugauccuggcgggccccaugccggucaccguggccuccgccgcccagcggcgcgggcggaucggccgcaaccacaacaaggagggcgaccaguacaucuacauggggcagccccucaacaacgacgaggaccacgcccacuggaccgaggcgaagaugcugcuggacaacaucaacacgcccgagggcaucauccccgcccucuucgagccggagcgcgagaaguccgccgccaucgacggggaguaccggcugcgcggcgaggcccggaagaccuucgucgagcugaugcgccgcggggaccuccccguguggcuguccuacaagguggcgagcgagggcuuccaguacagcgaccgccgguggugcuucgacggcgagcgcaacaaccagguccuggaggagaacauggacguggagaucuggaccaaggagggggagcggaagaagcuccgcccccgguggcuggacgcccgcaccuacuccgacccccuggcccuccgggaguucaaggaguucgccgccggccgccggagcguguccggggaccugauccuggagaucggcaagcucccgcagcaccugacgcagcgcgcgcagaacgcccuggacaaccucgucaugcugcacaacagcgagcagggcgggcgggccuaccgccacgccauggaggagcugcccgacaccaucgagacccucaugcugcuggcgcucaucgccgugcugaccggcggggugacccuguucuuccucuccggccgggggcugggcaagacgagcaucggccugcucugcgucauggccuccagcgugcugcuguggauggccuccguggagccccacuggaucgccgcgagcaucauccucgaguucuuccugaugguccugcucauccccgagccggaccgccagcggacgccccaggacaaccagcuggccuacguggugaucgggcuccucuucaugauccugaccgucgccgccaacgagaugggccugcucgagaccacgaagaaggaccuggggaucggccacguggccguggagaaccaccaccacgcggccaugcuggacgucgaccuccaccccgccuccgccuggacccuguacgccguggcgaccaccaucaucacgccgaugaugcgccacaccaucgagaacaccaccgccaacaucagccugacggccaucgccaaccaggccgcgauccucauggggcuggacaagggcuggcccaucuccaagauggacaucggcgugccccugcucgcccuggggugcuacagccaggucaacccccugacccucaccgccgccgugcugaugcugguggcgcacuacgccaucaucggcccggggcuccaggccaaggccacccgcgaggcccagaagcggacggcggccggcaucaugaagaaccccaccgucgacgggaucguggccaucgaccuggaccccguggucuacgacgccaaguucgagaagcagcugggccagaucaugcuccugauccugugcaccucccagauccuccugaugcgcaccacgugggcccugugcgagagcaucacccucgcgaccggcccccugaccacgcugugggagggguccccgggcaaguucuggaacaccaccaucgccgugagcauggccaacaucuuccggggguccuaccucgccggcgccggccuggcguucagccugaugaagucccucgggggcgggcgccggggcaccggggcccagggcgagacgcugggcgagaaguggaagcgccagcugaaccagcucuccaagagcgaguucaacaccuacaagcgguccgggaucauggagguggaccgcagcgaggccaaggagggccugaagcgcggggagaccaccaagcacgccgucucccgcggcacggcgaagcugcggugguucguggagcgcaaccuggugaagcccgaggggaaggucaucgaccucggcugcggccgcggcggguggagcuacuacugcgccgggcugaagaaggugaccgaggugaagggguacaccaagggcgggcccggccacgaggagcccaucccgauggccaccuacggguggaaccuggucaagcuccacuccggcaaggacguguucuucaucccgcccgagaagugcgacacgcugcugugcgacaucggggagagcucccccaacccgaccaucgaggagggccgcacccuccgggugcugaagauggucgagcccuggcugcgcgggaaccaguucugcaucaagauccucaaccccuacaugcccagcgugguggagacccuggagcagaugcagcggaagcacggcggcaugcugguccgcaacccgcucucccggaacagcacccacgagauguacuggguguccugcgggacgggcaacaucgugagcgccgucaacaugaccucccgcaugcugcugaaccgcuucaccauggcccaccggaagcccaccuacgagcgcgacguggaccucggggcgggcacgcggcacguggccgucgagcccgagguggccaaccuggacaucaucggccagcgcaucgagaacaucaagcacgagcacaagagcaccuggcacuacgacgaggacaaccccuacaagaccugggccuaccacggguccuacgaggugaagccgagcggcuccgccagcagcauggucaacgggguggucaagcugcucaccaagcccugggacgugauccccauggugacgcagaucgcgaugaccgacaccacccccuucggccagcagcgggucuucaaggagaagguggacacgcgcaccccgaaggccaagcgggggaccgcccagaucauggaggugaccgccaaguggcuguggggcuuccugucccgcaacaagaagccccggaucugcacgcgcgaggaguucacccggaagguccgcagcaacgccgcgaucggcgccguguucguggacgagaaccaguggaacuccgccaaggaggccgucgaggacgagcgguucugggaccucgugcaccgcgagcgggagcugcacaagcaggggaagugcgcgaccugcguguacaacaugaugggcaagcgcgagaagaagcugggggaguucggcaaggccaaggggagccgggccaucugguacauguggcucggcgcccgcuuccuggaguucgaggcccugggcuucaugaacgaggaccacugguucucccgggagaacagccucuccggggucgagggcgaggggcugcacaagcugggcuacauccuccgcgacaucagcaagauccccgggggcaacauguacgcggacgacaccgccggcugggacacgcggaucaccgaggacgaccugcagaacgaggcccgcaucaccgacaucauggagccggagcacgcccugcucgccaaguccaucuucaagcugaccuaccagaacaagguggugcgcguccagcggcccgcgaagaacgggacggugauggacgugaucagccgccgggaccagcgcggcuccgggcaggucggcaccuacggccugaacaccuucaccaacauggaggcccagcucauccggcagauggagagcgaggggaucuucucccccagcgagcuggagacgcccaaccuggccgagcgcgugcucgacuggcuggagaaguacggcguggagcggcugaagcgcauggccaucuccggggacgacugcgucgugaagccgaucgacgaccgguucgccaccgcgcucaccgcccugaacgacaugggcaaggugcgcaaggacaucccccagugggagcccagcaagggguggaacgacuggcagcagguccccuucugcucccaccacuuccaccagcugaucaugaaggacggccgggagaucguggugccgugccgcaaccaggacgagcucgucggccgggcccgcgugagccagggggccggcuggagccugcgggagaccgccugccuggggaaguccuacgcgcagauguggcagcucauguacuuccaccgccgggaccugcgccuggccgccaacgccaucugcagcgcggugcccgucgacuggauccccacgucccggaccaccuggagcauccacgcccaccaccaguggaugaccacggaggacaugcucuccguguggaaccgcguguggaucgaggagaaccccuggauggaggacaagacccacaucagcuccuggggcgacgucccguaccuggggaagcgcgaggaccaguggugcggcagccugaucggccucaccgcccgggccaccugggccaccaacauccagguggcgaucaaccaggugcgccggcugaucgggaacgagaacuaccuggacuacaugacguccaugaagcgcuucaagaacgagagcgaccccgagggcgcccucugguga

SEQ ID NO: 8348 - RNA, 9879 nt, Artificial Sequence
  derived and/or modified CDS sequence (opt1) from DENV-1__FJ205882__SS-prME
agcgugaccaugcugcucaugcugaugcccaccgcccuggccuuccaccucaccacccgcggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccgcaucaccgaggccgagcccgacgacguggacugcuggugcaacgccaccgacaccugggugaccuacgggaccugcagccagaccggcgagcaccggcgcgacaagcggagcguggcccucgcgccccacgugggccuggggcuggagacgcgcaccgagaccuggaugagcuccgagggcgccuggaagcagauccagcggguggagaccugggcccuccgccaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcggugcugcggaagcucugcaucgaggccaagaucuccaacaccaccacggacagccgcugccccacccagggcgaggccacccugguggaggagcaggacgccaacuucgucugccggcgcaccuucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacaccggcgaccagcaccagguggggaacgaguccacggagcacggcaccaccgcgaccaucacgccccaggcccccagcacggagauccagcucaccgacuacggggcccugacccuggacugcagcccccggaccggccucgacuucaacgagaugguccugcugacgaugaaggagaaguccuggcucgugcacaagcagugguuccuggaccugccgcuccccuggaccagcggggccuccaccagccaggagaccuggaaccggcaggaccugcuggugacguucaagaccgcccacgcgaagaagcaggaggucguggugcucggcucccaggagggcgccaugcacaccgcccugaccggggccacggagauccagaccagcggcaccaccacgaucuucgccgggcaccugaagugccgccucaagauggacaagcugacccugaagggcauguccuacgucaugugcaccgggagcuucaagcucgagaaggagguggcggagacccagcacggcacggugcugguccagaucaaguacgagggcaccgacgcccccugcaagauccccuucuccacccaggacgagaagggggugacccagaacggccggcugaucacggccaaccccaucgugaccgacaaggagaagcccgucaacaucgaggccgagccgcccuucggggagagcuacaucgugaucggcgcgggcgagaaggcccugaagcucuccugguucaagaaggggagcuccaucggcaagauguucgaggccaccgcccgcggggcccggcgcauggcgauccugggcgacaccgccugggacuucgggagcaucggcggcguguucacguccgucgggaagcuggugcaccagaucuucggcaccgccuacggggugcuguucagcggcgucuccuggaccaugaagaucgggaucggcgugcugcugaccuggcucggccugaacagccgcuccacgagccuguccaugaccugcaucgccguggggcucgucacccuguaccugggcgugauggugcaggccgacagcgggugcgucaucaacuggaagggccgggagcucaagugcgggagcggcaucuucgugaccaacgaggugcacacguggaccgagcaguacaaguuccaggcggacuccccgaagcgccugagcgccgccaucggcaaggccugggacgagggggucugcggcauccgguccgccacccgccuggagaacaucauguggaagcagaucagcaacgagcucaaccacauccugcuggagaacgacaugaaguucaccgugguggucggggacguggcgggcauccucgcccaggggaagaagaugauccggccccagcccauggaguacaaguacuccuggaaguccuggggcaaggccaagaucaucggcgccgacgugcagaacaccacguucaucaucgacgggcccaacaccccggagugccccgacgaccagcgcgcguggaacaucuggaaggucgaggaccacggcuucgggaucuuccccaccaacaucuggcugaagcugcgggacuccuacacccaggugugcgaccaccgccucaugagcgccgccaucaaggacuccaaggccgugcacgccgacaugggcuacuggaucgagagcgagaagaacgagacguggaagcuggcgcgggccuccuucaucgaggucaagaccugcaucuggcccaagagccacacccugugguccaacggcgugcucgagagcgagaugaucaucccgaagaucuacgggggccccaucucccagcacaacuaccgccccggguacuucacccagacggccggcccguggcaccuggggaagcuggagcucgacuucaaccugugcgagggcaccaccguggucguggacgagcacugcggcaaccgggggcccagccugcgcaccacgaccgugaccggcaagaucauccacgaguggugcugccgguccugcacccugccgccccuccgcuucaagggggaggacggcugcugguacgggauggagauccggccggucaaggagaaggaggagaaccuggucaagagcauggugagcgccggcuccggcgaggucgacagcuucucccucgggcugcugugcaucagcaucaugaucgaggaggugaugcgcucccgguggagccgcaagaugcucaugacgggcacccuggccguguucuuccugcucaucauggggcagcugaccuggaacgaccugauccggcucugcaucauggucggcgcgaacgccuccgaccgcauggggaugggcaccacguaccuggcccugauggccaccuucaagaugcgccccaugcucgccguggggcugcuguuccggcgccucaccagccgggaggugcugcugcucaccaucgggcugucccuggucgcgagcguggagcuccccaacucccuggaggagcugggcgacgggcucgccaugggcaucaugauccugaagcugcucacggacuuccagagccaccagcugugggccacccugcucucccugaccuucaucaagaccacguacagccugcacuacgccuggaagaccauggcgaugguccucuccaucgugagccuguucccccugugccucuccaccaccagccagaagacgaccuggcugccggugcugcucggcucccuggggugcaagccccugaccauguuccucaucgccgagaacaagaucuggggccgcaagagcuggccccugaacgaggggaucauggccgucggcaucgugagcauccugcucuccagccugcugaagaacgacgugccccucgccgggccgcugaucgccggcggcaugcugaucgcgugcuacgucaucuccgggagcuccgccgaccucagccuggagaaggccgccgagguguccugggaggaggaggccgagcacagcggcgcgucccacaacauccugguggagguccaggacgacgggaccaugaagaucaaggacgaggagcgggacgacacgcucaccauccugcugaaggccacccuccuggccgugagcggcguguacccccuguccauccccgccacccucuucgucugguacuucuggcagaagaagaagcagcgcagcggggugcugugggacacccccuccccgcccgagguggagcgggccguccuggacgacggcaucuaccgcaucaugcagcggggccugcucgggcgcagccaggugggcgugggggucuuccaggagaacguguuccacacgauguggcacgugacccggggcgcgguccugauguaccaggggaagcgccuggagcccuccugggccagcgugaagaaggaccucaucuccuacggcggcggguggcggcugcagggcagcuggaacaccggggaggaggugcaggucaucgccguggagcccggcaagaacccgaagaacgugcagaccgcccccgggacguucaagaccuccgagggcgaggucggcgccaucgcgcuggacuucaagcccgggaccagcggcagccccaucgugaaccgcgaggggaagaucgugggccucuacggcaacggggucgugaccacguccggcaccuacgugagcgccaucgcccaggccaaggcgucccaggaggggccgcugcccgagaucgagaacgaggucuuccggaagcgcaaccugaccaucauggaccuccaccccggcagcgggaagacccggcgcuaccugccggccaucgugcgggaggccaucaagcgcaagcugcggacgcucauccuggcccccacccgcguggucgccuccgagauggcggaggcccugaagggcaugcccauccgcuaccagaccaccgccgucaagagcgagcacacgggcaaggagaucguggaccucaugugccacgccaccuucaccaugcggcugcugucccccguccgcgugccgaacuacaacaugaucaucauggacgaggcccacuucaccgaccccagcuccaucgcggcccggggguacaucagcacgcgcgugggcaugggggaggccgccgccaucuucaugaccgcgacgccgcccggcuccgucgaggccuucccgcagagcaacgccgugauccaggacgaggagcgggacauccccgagcgcuccuggaacagcggguacgaguggaucaccgacuuccccggcaagacggugugguucguccccuccaucaagagcggcaacgacaucgccaacugccuccggaagaacgggaagcgcgugauccagcugucccggaagaccuucgacaccgaguaccagaagaccaagaacaacgacugggacuacguggucacgaccgacaucagcgagaugggcgcgaacuuccgcgccgaccgggugaucgacccgcgccggugccugaagcccgugauccucaaggacgggcccgagcgcgucauccuggccggccccaugccggugaccgucgccuccgccgcgcagcggcgcgggcggaucggccgcaaccacaacaaggagggcgaccaguacaucuacauggggcagccccugaacaacgacgaggaccacgcccacuggaccgaggccaagaugcuccuggacaacaucaacacgcccgagggcaucauccccgcccuguucgagccggagcgggagaaguccgccgcgaucgacggggaguaccgccuccgcggcgaggcccggaagaccuucguggagcugaugcgccgcggggaccugcccguguggcucagcuacaaggucgccuccgagggcuuccaguacagcgaccgccgguggugcuucgacggcgagcgcaacaaccaggugcuggaggagaacauggacguggagaucuggaccaaggagggggagcggaagaagcugcgcccccgguggcucgacgcccgcaccuacuccgacccccuggcccugcgggaguucaaggaguucgcggccggccgcaagagcgucuccggggaccucauccuggagaucggcaagcugccgcagcaccucacgcagcgggcccagaacgcccuggacaaccuggugaugcuccacaacagcgagcagggcgggcgcgcguaccggcacgccauggaggagcugcccgacaccaucgagacccugaugcuccuggcccugaucgccgugcucaccggcggggucacgcuguucuuccuguccggccgcgggcucggcaagaccagcaucggccugcugugcgugauggccuccagcgugcuccuguggauggcguccgucgagccccacuggaucgccgccagcaucauccuggaguucuuccucauggugcugcugauccccgagccggaccggcagcgcacgccccaggacaaccagcucgccuacguggucaucgggcugcuguucaugauccucaccguggccgcgaacgagaugggccugcuggagaccacgaagaaggaccucgggaucggccacguggccgucgagaaccaccaccacgccgccaugcuggacguggaccugcaccccgccuccgcguggacccucuacgccguggccaccaccaucaucacgccgaugaugcggcacaccaucgagaacaccaccgccaacaucagccugacggccaucgcgaaccaggccgccauccugauggggcucgacaagggcuggcccaucuccaagauggacaucggcgucccccugcuggcccucgggugcuacagccaggugaacccccugacccugaccgcggccgugcucaugcuggucgcccacuacgccaucaucggcccggggcugcaggccaaggcgacccgcgaggcccagaagcggacggccgccggcaucaugaagaaccccaccguggacgggaucguggccaucgaccucgaccccgucguguacgacgcgaaguucgagaagcagcugggccagaucaugcugcucauccugugcaccucccagauccugcucaugcgcaccacgugggcccugugcgagagcaucacccuggccaccggcccccucaccacgcugugggagggguccccgggcaaguucuggaacaccaccaucgccgugagcauggccaacaucuuccgcgggagcuaccuggcgggcgccggccucgccuucucccugaugaagucccucgggggcgggcggcgcgggaccggggcccagggcgagacgcucggcgagaaguggaagcggcagcugaaccagcuguccaagagcgaguucaacaccuacaagcgcuccgggaucauggaggucgaccggagcgaggcgaaggagggccucaagcgcggggagaccaccaagcacgccgugucccggggcacggccaagcugcgcugguucguggagcggaaccuggucaagcccgaggggaaggugaucgaccugggcugcggccgcgggggcuggagcuacuacugcgccgggcucaagaaggugaccgaggucaagggcuacaccaagggcgggcccggccacgaggagcccaucccgauggccaccuacggguggaaccuggugaagcugcacuccggcaaggacguguucuucaucccgcccgagaagugcgacacgcuccugugcgacaucggggagagcucccccaacccgaccaucgaggagggccggacccugcgcguccucaagaugguggagcccuggcugcgggggaaccaguucugcaucaagauccugaaccccuacaugcccagcguggucgagacccucgagcagaugcagcgcaagcacggcggcaugcuggugcggaacccgcugucccgcaacagcacgcacgagauguacuggguguccugcgggaccggcaacaucgucagcgcggugaacaugaccucccggaugcuccugaaccgcuucaccauggcccaccggaagcccaccuacgagcgcgacguggaccugggggccggcacgcgccacgucgccguggagcccgagguggccaaccucgacaucaucggccagcggaucgagaacaucaagcacgagcacaagagcaccuggcacuacgacgaggacaaccccuacaagaccugggcguaccacggguccuacgaggucaagccgagcggcagcgccuccagcauggugaacggggucgugaagcugcugaccaagcccugggacgugauccccauggucacgcagaucgccaugaccgacaccacccccuucggccagcagcgcguguucaaggagaagguggacacgcggaccccgaaggccaagcgcgggaccgcccagaucauggaggucaccgcgaaguggcucuggggcuuccugucccggaacaagaagccccgcaucugcacgcgggaggaguucacccgcaaggugcggagcaacgccgccaucggcgccguguucgucgacgagaaccaguggaacuccgcgaaggaggccguggaggacgagcgcuucugggaccuggugcaccgggagcgcgagcuccacaagcaggggaagugcgcgaccugcgucuacaacaugaugggcaagcgggagaagaagcugggggaguucggcaaggccaaggggagccgcgccaucugguacauguggcugggcgcgcgguuccucgaguucgaggcccugggcuucaugaacgaggaccacugguucucccgcgagaacagccuguccgggguggagggcgaggggcuccacaagcugggcuacauccugcgggacaucagcaagauccccgggggcaacauguacgccgacgacaccgccggcugggacacgcgcaucaccgaggacgaccuccagaacgaggccaagaucaccgacaucauggagccggagcacgcgcugcuggccaaguccaucuucaagcucaccuaccagaacaaggugguccgggugcagcgccccgccaagaacgggacggugauggacgucaucagccggcgcgaccagcgcggcuccggccaggugggcaccuacggccugaacaccuucaccaacauggaggcccagcugauccggcagauggagagcgaggggaucuucucccccagcgagcucgagacgcccaaccuggccggccgcgugcuggacuggcucgagaagcacggggucgagcggcugaagcgcauggcgaucuccggcgacgacugcguggugaagccgaucgacgaccgguucgccaccgcccugaccgcccucaacgacauggggaagguccgcaaggacaucccccagugggagcccagcaagggcuggaacgacuggcagcagguccccuucugcagccaccacuuccaccagcugaucaugaaggacggccgggagaucguggucccgugccgcaaccaggacgagcugguggggcgggcccgcgugucccagggcgcgggguggagccuccgggagaccgccugccugggcaaguccuacgcccagauguggcagcugauguacuuccaccgccgggaccuccgccuggccgcgaacgccaucugcagcgccguccccguggacugggugcccacgucccggaccaccuggagcauccacgcccaccaccaguggaugaccacggaggacaugcuguccgucuggaaccgcguguggaucgaggagaaccccuggauggaggacaagacccacaucagcuccuggggcgacgugccguaccucggcaagcgggaggaccaguggugcggcagccugaucgggcugaccgcccgcgcgaccugggccacgaacauccaggucgccaucaaccaggugcggcgccucaucggcaacgagaacuaccuggacuacaugaccuccaugaagcgcuucaagaacgagagcgaccccgagggggcccugugguga

SEQ ID NO: 8349 - RNA, 9879 nt, Artificial Sequence
  derived and/or modified CDS sequence (opt1) from DENV-1__FJ390388__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgagaccgagcccgacgacguggacugcuggugcaacgccacggacaccugggugaccuacgggaccugcagccagacgggcgagcaccggcgcgacaagcgguccguggcccucgcgccccacgugggccuggggcuggagacccgcaccgagaccuggaugagcuccgagggcgccuggaagcagauccagcgggucgagacgugggcccuccgccaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagcuggccgagacccagcacggcaccgugcuggugcagaucaaguacgagggcaccgacgcgcccugcaagauccccuucagcacgcaggacgagaagggggucacccagaacggccggcugaucaccgccaacccgaucgugaccgacaaggagaagcccgugaacaucgaggccgagccgcccuucggggaguccuacaucgucaucggcgccggcgagaaggcgcucaagcugagcugguucaagaagggguccagcaucggcaagauguucgaggccacggcccgcggggcccggcgcauggccauccugggcgacaccgcgugggacuucggguccaucggcggcguguucaccagcguggggaagcucguccaccagaucuucggcaccgccuacggggugcuguucuccggcgugagcuggacgaugaagaucgggaucggcguccugaugaccuggcucggccugaacucccgcagcaccucccugagcaugaccugcaucgccguggggcucgugacgcuguaccugggcgucauggugcaggccgacuccgggugcgugaucaacuggaagggccgggagcucaagugcgggagcggcaucuucgucaccaacgaggugcacaccuggaccgagcaguacaaguuccaggccgacagcccgaagcgccuguccgcggccaucggcaaggccugggaggagggggugugcggcauccggagcgccacccgccuggagaacaucauguggaagcagaucuccaacgagcucaaccacauccugcuggagaacgacaugaaguucacggucguggugggggacgucgccggcauccucgcgcaggggaagaagaugauccggccccagcccauggagcacaaguacagcuggaaguccuggggcaaggccaagaucaucggcgccgacgugcagaacaccaccuucaucaucgacgggcccaacaccccggagugccccgacgaccagcgcgccuggaacaucugggagguggaggacuacggcuucgggaucuucacgaccaacaucuggcugaagcugcgggacagcuacacccaggucugcgaccaccgccucauguccgcggccaucaaggacagcaaggccgugcacgccgacaugggcuacuggaucgaguccgagaagaacgagaccuggaagcuggcccgggcgagcuucaucgaggugaagacgugcaucuggcccaagucccacacccuguggagcaacggcguccucgaguccgagaugaucauccccaagaucuacgggggcccgaucagccagcacaacuaccgccccggguacuucacccagaccgccggccccuggcaccuggggaagcuggagcucgacuucgaccugugcgagggcacgaccgugguggucgacgagcacugcggcaaccgggggccgucccugcgcaccaccacggugaccggcaagaucauccacgaguggugcugccggagcugcacccugccgccccuccgcuuccgcggggaggacggcugcugguacgggauggagauccgccccgugaaggagaaggaggagaaccuggucaaguccauggugagcgccggcagcggcgagguggacuccuucagccucgggcugcugugcaucuccaucaugaucgaggaggucaugcggagccgcuggucccggaagaugcucaugaccggcacgcuggccguguucuuccugcucaucguggggcagcugaccuggaacgaccugauccgccucugcaucauggucggcgccaacgcgagcgaccgcauggggaugggcaccaccuaccuggcccugauggccacguucaagaugcggccgauguucgccguggggcuccuguuccgccggcugaccucccgcgaggugcuccugcugaccaucgggcucagccuggucgccuccguggagcugcccaacagccucgaggagcugggcgacgggcuggcgaugggcaucaugauccucaagcugcugaccgacuuccagucccaccagcucugggccacgcugcugagccucaccuucaucaagaccaccuucucccugcacuacgccuggaagacgauggccaugguccugagcguggugucccucuucccccugugccugagcaccaccucccagaagaccacguggcuccccguccugcugggcagccucgggugcaagccgcugaccauguuccugaucgcggagaacaagaucuggggccggcgcuccuggccccucaacgaggggaucauggccgugggcaucgugagcauccugcugagcucccuccugaagaacgacgucccccuggccgggccccucaucgccggcggcaugcugaucgccugcuacgugaucagcggguccagcgcggaccugucccucgagaaggccgccgaggugagcugggaggaggaggccgagcacuccggcgccagccacaacauccuggucgaggugcaggacgacgggaccaugaagaucaaggacgaggagcgggacgacacccugaccauccuccugaaggcgacgcugcucgccguguccggcgucuacccgcugagcauccccgccacccuguucgugugguacuucuggcagaagaagaagcagcgcuccggggugcucugggacacccccagcccgcccgaggucgagcgggccgugcuggacgacggcaucuaccgcaucaugcagcggggccugcuggggcgcucccaggugggcgucgggguguuccaggagaacguguuccacaccauguggcacgucacgcggggcgccgugcucauguaccaggggaagcgccuggagcccagcugggcguccgugaagaaggaccugaucagcuacggcggcggguggcggcuccagggcuccuggaacaccggggaggagguccaggugaucgccguggagcccggcaagaaccccaagaacguccagaccgcccccgggaccuucaagacgcccgagggcgaggugggcgccaucgcccuggacuucaagcccgggaccagcggcucccccaucgugaaccgcgagcggaagaucgucgggcuguacggcaacggcguggugaccaccagcgggacguacgucagcgcgaucgcccaggccaaggccucccaggagggcccgcuccccgagaucgaggacgagguguuccgcaagcggaaccugaccaucauggaccugcaccccgggagcggcaagacccgccgguaccucccggcgaucgugcgcgaggccaucaagcgcaagcugcggacccugauccucgcccccacgcgcgucguggccuccgagauggccgaggcgcugaaggggaugcccauccgguaccagaccaccgccgucaagagcgagcacaccggcaaggagaucgucgaccugaugugccacgccacguucaccaugcgccuccugucccccgugcgggugccgaacuacaacaugaucaucauggacgaggcccacuucaccgaccccagcuccaucgccgcgcgcggcuacaucagcacccgggucgggaugggcgaggccgccgccaucuucaugacggccacgccgcccggguccguggaggcguucccgcagagcaacgccgugauccaggacgaggagcgcgacauccccgagcgguccuggaacagcggcuacgaguggaucaccgacuuccccgggaagaccgucugguucgugcccuccaucaagagcggcaacgacaucgccaacugccugcgcaagaacggcaagcgggugauccagcucucccgcaagacguucgacaccgaguaccagaagaccaagaacaacgacugggacuacgucgugaccacggacaucagcgagaugggggccaacuuccgggcggaccgcgugaucgacccgcggcgcugccugaagcccgucauccugaaggacggccccgagcgggugauccucgccgggcccaugccggucaccguggccuccgccgcccagcgccggggccgcaucgggcgcaaccacaacaaggagggcgaccaguacaucuacaugggccagccccugaacaacgacgaggaccacgcgcacuggaccgaggccaagaugcugcucgacaacaucaacacccccgaggggaucauccccgcccuguucgagccggagcgggagaaguccgccgccaucgacggcgaguaccgccugcgcggggaggcgcgcaagacguucguggagcucaugcggcgcggcgaccugcccgucuggcuguccuacaagguggccagcgagggguuccaguacagcgaccggcgcuggugcuucgacggcgagcggaacaaccaggugcucgaggagaacauggacgucgagaucuggaccaaggagggcgagcgcaagaagcugcggccccgcuggcuggacgcccggaccuacuccgacccccucgcccugcgcgaguucaaggaguucgccgcggggcggcgcagcguguccggcgaccugauccucgagaucgggaagcugccgcagcaccugacccagcgggcccagaacgcccucgacaaccuggugaugcugcacaacagcgagcagggcggccgcgccuaccggcacgcgauggaggagcuccccgacacgaucgagacccugaugcugcucgcccugaucgccguccugaccgggggcgugacccucuucuuccuguccgggcgcggccuggggaagaccagcaucggccuccugugcgugauggccuccagcguccugcucuggauggccuccguggagccccacuggaucgcggccagcaucauccuggaguucuuccugauggugcuccugauccccgagccggaccggcagcgcacgccccaggacaaccagcuggccuacgucgugaucggccuccuguucaugauccugaccguggccgccaacgagauggggcuccuggagaccaccaagaaggaccugggcaucgggcacgucgcgguggagaaccaccaccacgccgccaugcucgacguggaccugcaccccgccuccgccuggacgcuguacgcggucgccaccaccaucaucaccccgaugaugcgccacacgaucgagaacaccaccgccaacaucagccucaccgccaucgccaaccaggcggccauccugaugggccuggacaagggguggcccaucuccaagauggacaucggcgugccccuccuggcccugggcugcuacagccaggugaacccccucacgcugaccgccgcgguccugaugcucguggcccacuacgccaucaucgggccgggccugcaggccaaggccacccgggaggcgcagaagcgcaccgccgccgggaucaugaagaaccccacgguggacggcaucgucgccaucgaccuggaccccgugguguacgacgccaaguucgagaagcagcucgggcagaucaugcugcugauccucugcaccucccagauccugcugaugcggaccaccugggcgcucugcgagagcaucacgcuggccaccggcccccugaccacccucugggagggcuccccggggaaguucuggaacacgaccaucgccgucagcauggccaacaucuuccgcggcuccuaccuggccggggcgggccuggccuucagccucaugaagucccugggcgggggccggcgcgggaccggcgcccagggggagacccugggcgagaaguggaagcggcagcucaaccagcuguccaagagcgaguucaacacguacaagcgcuccggcaucauggagguggaccggagcgaggccaaggaggggcugaagcgcggcgagaccaccaagcacgcggugucccgggggaccgccaagcuccgcugguucgucgagcggaaccuggugaagcccgagggcaaggugaucgaccuggggugcggccgcggcggguggagcuacuacugcgccggccugaagaaggucacggaggugaagggguacaccaagggcgggcccggccacgaggagcccaucccgauggccaccuacggcuggaaccucgugaagcugcacuccgggaaggacgucuucuucaucccgcccgagaagugcgacacccugcucugcgacaucggcgagagcucccccaacccgacgaucgaggaggggcggacccugcgcgugcugaagaugguggagcccuggcuccggggcaaccaguucugcaucaagauccugaaccccuacaugcccagcgucguggagacccuggagcagaugcagcgcaagcacgggggcaugcucgugcggaacccgcugucccgcaacagcacccacgagauguacugggucuccugcggcaccgggaacaucgugagcgccgugaacaugacgucccgcaugcugcucaaccgguucaccauggcgcaccgcaagcccaccuacgagcgggacgucgaccugggcgccgggacccgccacguggccguggagcccgaggucgccaaccuggacaucaucggccagcggaucgagaacaucaagcacgagcacaagagcacguggcacuacgacgaggacaaccccuacaagaccugggccuaccacggcuccuacgaggugaagccgagcggguccgcgagcagcauggucaacggcguggugaagcuccugaccaagcccugggacgucauccccauggugacccagaucgccaugacggacaccacccccuucgggcagcagcgcguguucaaggagaaggucgacacccggacgccgaaggccaagcgcggcaccgcccagaucauggaggugaccgccaaguggcuguggggguuccucucccggaacaagaagccccgcaucugcacccgggaggaguucacgcgcaaggugcggagcaacgcggccaucggcgccgucuucguggacgagaaccaguggaacuccgccaaggaggcgguggaggacgagcgcuucugggaccugguccaccgggagcgcgagcugcacaagcagggcaagugcgcgaccugcguguacaacaugauggggaagcgggagaagaagcucggcgaguucgggaaggccaagggcagccgcgccaucugguacauguggcugggggcccgguuccuggaguucgaggcgcucggcuucaugaacgaggaccacugguucucccgcgagaacagccuguccggcguggagggggagggccugcacaagcucggguacauccugcgggacaucagcaagauccccggcgggaacauguacgccgacgacaccgccggcugggacacccgcaucacggaggacgaccugcagaacgaggcccgcaucaccgacaucauggagccggagcacgcccuccuggcgaaguccaucuucaagcugaccuaccagaacaaggucgugcgggugcagcgccccgccaagaacggcaccgucauggacgugaucagccggcgcgaccagcggggguccggccagguggggacguacggccucaacaccuucaccaacauggaggcccagcugauccgccagauggagagcgagggcaucuucucccccagcgagcuggagacccccaaccucgccgagcggguccuggacuggcuggagaaguacgggguggagcgccucaagcggauggccaucuccggcgacgacugcguggucaagccgaucgacgaccgcuucgcgacggcccugaccgcccugaacgacauggggaaggugcggaaggacaucccccagugggagcccagcaagggcuggaacgacuggcagcagguccccuucugcucccaccacuuccaccagcucaucaugaaggacgggcgcgagaucgucgugccgugccggaaccaggacgagcuggugggccgcgcccgggucagccagggcgccggguggagccugcgcgagaccgcgugccucggcaaguccuacgcccagauguggcagcugauguacuuccaccggcgcgaccugcggcucgccgccaacgcgaucugcagcgccgugcccguggacuggauccccaccucccgcacgaccuggagcauccacgcccaccaccaguggaugaccaccgaggacaugcuguccgucuggaaccgcguguggaucgaggagaaccccuggauggaggacaagacgcacaucagcuccuggggcgacgugccguaccugggcaagcgggaggaccaguggugcgggagccucaucggccugaccgcccgcgccaccugggcgaccaacauccaggucgccaucaaccaggugcggcgccugaucggcaacgagaacuaccucgacuacaugaccuccaugaagcgguucaagaacgagagcgaccccgagggggcccugugguga

SEQ ID NO: 8350 - RNA, 9879 nt, Artificial Sequence
  derived and/or modified CDS sequence (opt1) from DENV-1__FJ024464__SS-prME
agcgugaccaugcugcugaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgagaccgagcccgacgacguggacugcuggugcaacgccacggacaccugggugaccuacgggaccugcagccagacgggcgagcaccggcgggacaagcgguccguggcccucgcgccccacgugggccuggggcuggagacccgcaccgagaccuggaugagcuccgagggcgcguggaagcagauccagcgggucgagacgugggcccuccggcaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagcuggccgagacccagcacggcaccgugcuggugcagaucaaguacgagggcaccgacgcgcccugcaagauccccuucagcacgcaggacgagaagggggucacccagaacggccggcugaucaccgccaacccgaucgugaccgacaaggagaagcccgugaacaucgaggccgagccgcccuucggggaguccuacaucgucaucggcgccggcgagaaggcgcucaagcugagcugguucaagaagggguccagcaucggcaagauguucgaggccacggcccgcggggugcggcgcauggccauccugggcgacaccgccugggacuucggguccaucggcggcguguucaccagcgucgggaagcucgugcaccagaucuucggcaccgcguacggggugcuguucuccggcgucagcuggacgaugaagaucgggaucggcgugcugcucaccuggcugggccugaacucccgcagcaccucccucagcaugaccugcaucgccguggggcuggucacgcuguaccucggcgugauggugcaggccgacuccgggugcgucaucaacuggaagggccgggagcugaagugcgggagcggcaucuucgugaccaacgaggugcacaccuggaccgagcaguacaaguuccaggccgacagcccgaagcgccuguccgccgcgaucggcaaggccugggaggagggggucugcggcauccggagcgccacccgccucgagaacaucauguggaagcagaucuccaacgagcugaaccacauccugcucgagaacgacaugaaguucacggugguggucggggacguggccggcauccuggcccaggggaagaagaugauccggccccagcccauggaguacaaguacagcuggaaguccuggggcaaggcgaagaucaucggcgccgacgugcagaacaccaccuucaucaucgacgggcccaacaccccggagugccccgacgaccagcgcgccuggaacaucugggaggucgaggacuacggcuucgggaucuucacgaccaacaucuggcugaagcuccgggacagcuacacccaggugugcgaccaccgccugauguccgccgcgaucaaggacagcaaggccgugcacgccgacaugggcuacuggaucgaguccgagaagaacgagaccuggaagcuggcccgggccagcuucaucgaggucaagacgugcaucuggcccaagucccacacccucuggagcaacggcgugcuggaguccgagaugaucauccccaagaucuacgggggcccgaugagccagcacaacuaccgccccggguacuucacccagaccgcgggccccuggcaccuggggaagcucgagcuggacuucgaccugugcgagggcacgaccguggucguggacgagcacugcggcaaccgggggccgucccuccgcaccaccacggugaccggcaagaucauccacgaguggugcugccggagcugcacccugccgccccugcgcuuccgcggggaggacggcugcugguacgggauggagauccgccccgucaaggagaaggaggagaaccucgugaaguccauggugagcgccggcagcggcgaggucgacuccuucagccuggggcugcucugcaucuccaucaugaucgaggaggugaugcggagccgcuggucccggaagaugcugaugaccggcacgcuggccguguucuuccuccugaucauggggcagcugaccuggaacgaccucauccgccugugcaucauggucggcgccaacgccagcgaccgcauggggaugggcaccaccuaccuggcgcucauggccacguucaagaugcggccgauguucgccgugggccugcuguuccgccggcucaccucccgcgaggugcugcugcucaccaucgggcugagccuggucgccuccguggagcuccccaacagccuggaggagcugggcgacgggcucgccaugggcaucaugauccugaagcugcucaccgacuuccagucccaccagcugugggcgacgcugcucagccugaccuucaucaagaccaccuucucccugcacuacgccuggaagacgauggccaugguccucagcaucgugucccuguucccccugugccucagcaccaccucccagaagaccacguggcugcccgugcugcucggcagccuggggugcaagccgcugaccauguuccucaucgccgagaacaagaucuggggccggcgcuccuggccccugaacgaggggaucauggcggucggcaucgugagcauccugcucagcucccugcugaagaacgacgugccccucgccgggccccugaucgccggcggcaugcugaucgccugcuacgucaucagcggguccagcgccgaccucucccuggagaaggcggccgaggugagcugggaggaggaggccgagcacuccggcgccagccacaacauccugguggagguccaggacgacgggaccaugaagaucaaggacgaggagcgggacgacacccucaccauccugcugaaggccacgcuccuggcgguguccggcguguacccgcugagcauccccgccacccucuucgucugguacuucuggcagaagaagaagcagcgcuccggggugcugugggacacccccagcccgcccgagguggagcgggccguccuggacgacggcaucuaccgcaucaugcagcggggccugcucgggcgcucccaggugggcgugggggucuuccaggagaacguguuccacaccauguggcacgugacgcggggcgccguccugauguaccaggggaagcgccuggagcccagcugggccuccgugaagaaggaccucaucagcuacggcggcggguggcggcugcagggcuccuggaacaccggggaggaggugcaggucaucgcgguggagcccggcaagaaccccaagaacgugcagaccgcccccgggaccuucaagacgcccgagggcgaggucggcgccaucgcccuggacuucaagcccgggaccagcggcucccccaucgugaaccgcgaggggaagaucgugggccucuacggcaacggggucgugaccaccagcggcacguacgugagcgccaucgcgcaggccaaggccucccaggaggggccgcugcccgagaucgaggacgaggucuuccggaagcgcaaccugaccaucauggaccuccaccccggcagcgggaagacccggcgcuaccugccggccaucgugcgggaggcgaucaagcgcaagcugcgcacccucauccuggcccccacgcggguggucgccuccgagauggccgaggcccugaagggcaugcccauccgcuaccagaccaccgcggucaagagcgagcacaccggcaaggagaucguggaccucaugugccacgccacguucaccaugcggcugcugucccccguccgcgugccgaacuacaacaugaucaucauggacgaggcccacuucaccgaccccagcuccaucgccgcccggggguacaucagcacccgcgugggcaugggggaggcggccgccaucuucaugacggccacgccgcccggcuccgucgaggccuucccgcagagcaacgcggugauccaggacgaggagcgggacauccccgagcgcuccuggaacagcggguacgaguggaucaccgacuuccccggcaagaccgugugguucguccccuccaucaagagcggcaacgacaucgccaacugccuccggaagaacgggaagcgcgugauccagcugucccggaagacguucgacaccgaguaccagaagaccaagaacaacgacugggacuacguggucaccacggacaucagcgagaugggcgccaacuuccgcgccgaccgggugaucgacccgcgccggugccugaagcccgugauccucaaggacgggcccgagcgcgucauccuggcgggccccaugccggugaccgucgccuccgccgcccagcggcgcgggcggaucggccgcaaccacaacaaggagggcgaccaguacaucuacauggggcagccccugaacaacgacgaggaccacgcccacuggaccgaggcgaagaugcuccuggacaacaucaacacccccgagggcaucauccccgcccuguucgagccggagcgcgagaaguccgccgccaucgacggggaguaccggcuccgcggcgaggcccggaagacguucguggagcugaugcgccgcggggaccugcccguguggcucuccuacaaggucgcgagcgagggcuuccaguacagcgaccgccgguggugcuucgacggcgagcgcaacaaccaggugcuggaggagaacauggacguggagaucuggaccaaggagggggagcggaagaagcugcgcccccgguggcucgacgcccgcaccuacuccgacccccuggcccugcgggaguucaaggaguucgccgccggccgccggagcgucuccggggaccucauccuggagaucggcaagcugccgcagcaccucacccagcgcgcgcagaacgcccuggacaaccuggugaugcuccacaacagcgagcagggcgggcgggccuaccgccacgccauggaggagcugcccgacacgaucgagacccugaugcuccuggcgcugaucgccgugcucaccggcggggucacccuguucuuccuguccggccgggggcucggcaagaccagcaucggccugcugugcgugauggccuccagcgugcuccuguggauggccuccgucgagccccacuggaucgccgcgagcaucauccuggaguucuuccucauggugcugcugauccccgagccggaccgccagcggacgccccaggacaaccagcucgccuacguggucaucgggcugcuguucaugauccucaccguggccgccaacgagaugggccugcuggagaccaccaagaaggaccucgggaucggccacguggccgucgagaaccaccaccacgcggccaugcuggacguggaccugcaccccgccuccgccuggacgcucuacgccguggcgaccaccaucaucaccccgaugaugcgccacacgaucgagaacaccaccgccaacaucagccugaccgccaucgccaaccaggccgcgauccugauggggcucgacaagggcuggcccaucuccaagauggacaucggcgucccccugcuggcccucgggugcuacagccaggugaacccccugacgcugaccgccgccgugcucaugcuggucgcgcacuacgccaucaucggcccggggcugcaggccaaggccacccgcgaggcccagaagcggaccgcggccggcaucaugaagaaccccacgguggacgggaucguggccaucgaccucgaccccgucguguacgacgccaaguucgagaagcagcugggccagaucaugcugcucauccugugcaccucccagauccugcucaugcgcaccaccugggcccugugcgagagcaucacgcuggcgaccggcccccucaccacccugugggagggguccccgggcaaguucuggaacacgaccaucgccgugagcauggccaacaucuuccggggguccuaccuggccggcgccggccucgcguucagccugaugaagucccucgggggcgggcgccgggggaccggggcccagggcgagacccucggcgagaaguggaagcgccagcugaaccagcuguccaagagcgaguucaacacguacaagcgguccgggaucauggaggucgaccgcagcgaggccaaggagggccucaagcgcggggagaccaccaagcacgccgugucccgcggcaccgcgaagcugcggugguucguggagcgcaaccuggucaagcccgaggggaaggugaucgaccugggcugcggccgcgggggcuggagcuacuacugcgccgggcucaagaaggugacggaggucaagggcuacaccaagggcggccccggccacgaggagcccaucccgauggccaccuacggguggaaccuggugaagcugcacuccggcaaggacguguucuucaucccgcccgagaagugcgacacccuccugugcgacaucggggagagcucccccaacccgacgaucgaggagggccgcacccugcggguccucaagaugguggagcccuggcugcgcgggaaccaguucugcaucaagauccugaaccccuacaugcccagcguggucgagacccucgagcagaugcagcggaagcacggcggcaugcuggugcgcaacccgcugucccggaacagcacccacgagauguacuggguguccugcgggaccggcaacaucgucagcgccgugaacaugacgucccgcaugcuccugaaccgcuucaccauggcccaccggaagcccaccuacgagcgcgacguggaccugggggcgggcacccggcacgucgccguggagcccgagguggccaaccucgacaucaucggccagcgcaucgagaacaucaagcacgagcacaagagcacguggcacuacgacgaggacaaccccuacaagaccugggccuaccacggguccuacgaggucaagccgagcggcuccgccagcagcauggugaacggggucgugaagcugcugaccaagcccugggacgugauccccauggucacccagaucgcgaugacggacaccacccccuucggccagcagcggguguucaaggagaagguggacacccgcacgccgaaggccaagcgggggaccgcccagaucauggaggucaccgccaaguggcucuggggcuuccugucccgcaacaagaagccccggaucugcacccgcgaggaguucacgcggaaggugcgcagcaacgccgcgaucggcgccguguucgucgacgagaaccaguggaacuccgccaaggaggccguggaggacgagcgguucugggaccuggugcaccgcgagcgggagcuccacaagcaggggaagugcgcgaccugcgucuacaacaugaugggcaagcgcgagaagaagcugggggaguucggcaaggccaaggggagccgggccaucugguacauguggcugggcgcccgcuuccucgaguucgaggcccugggcuucaugaacgaggaccacugguucucccgggagaacagccuguccgggguggagggcgaggggcuccacaagcugggcuacauccugcgcgacaucagcaagauccccgggggcaacauguacgcggacgacaccgccggcugggacacccggaucacggaggacgaccuccagaacgaggcccgcaucaccgacaucauggagccggagcacgcccugcuggccaaguccaucuucaagcucaccuaccagaacaaggugguccgcgugcagcggcccgcgaagaacgggaccgugauggacgucaucagccgccgggaccagcgcggcuccggccagguggggacguacggccugaacaccuucaccaacauggaggcccagcugauccggcagauggagagcgaggggaucuucucccccagcgagcucgagacccccaaccuggccaagcgcgugcuggacuggcucgagaaguacggcgucgagcggcugaagcgcauggccaucuccggggacgacugcguggugaagccgaucgacgaccgguucgccacggcgcugaccgcccucaacgacaugggcaagguccgcaaggacaucccccagugggagcccagcaagggguggaacgacuggcagcagguccccuucugcucccaccacuuccaccagcugaucaugaaggacggccgggagaucguggucccgugccgcaaccaggacgagcuggugggccgggcccgcgugagccagggggccggcuggagccuccgggagaccgccugccuggggaaguccuacgcgcagauguggcagcugauguacuuccaccgccgggaccuccgccuggccgccaacgccaucugcagcgcgguccccguggacuggauccccaccucccggacgaccuggagcauccacgcccaccaccaguggaugaccaccgaggacaugcuguccguguggaaccgcgucuggaucgaggagaaccccuggauggaggacaagacgcacaucagcuccuggggcgacgugccguaccucgggaagcgcgaggaccaguggugcggcagccugaucggccugaccgcccgggccaccugggccaccaacauccagguggcgaucaaccagguccgccggcucaucgggaacgagaacuaccuggacuacaugaccuccaugaagcgcuucaagaacgagagcgaccccgagggcgcccugugguga

SEQ ID NO: 8351 - RNA, 9879 nt, Artificial Sequence
  derived and/or modified CDS sequence (opt1) from DENV-1__FJ410191__SS-prME
agcgugaccaugcugcucaugcugaugcccaccgcccuggccuuccaccucacgacccggggcggggagccccacaugaucguguccaagcaggagcggggcaagagccugcuguucaagaccuccgccggggugaacaugugcacccucaucgccauggaccugggcgaguucugcgaggacaccaugaccuacaagugcccccggaucaccgaggccgagcccgacgacguggacugcuggugcaacgccaccgacacgugggugaccuacgggaccugcagccagaccggcgagcaccggcgcgacaagcgguccguggcccuggcgccccacgugggccucgggcuggagacgcgcaccgagaccuggaugagcuccgagggcgccuggaagcagauccagaaggucgagaccugggcccugcggcaccccggguucacggugaucgcccucuuccuggcgcacgccaucggcaccagcaucacccagaaggggaucaucuucauccugcucaugcuggugacccccuccauggccaugcgcugcgucggcaucggcagccgggacuucguggaggggcuguccggcgccacguggguggacgucgugcucgagcacgggagcugcgugaccaccauggccaaggacaagcccacccuggacaucgagcugcucaagacggaggucaccaaccccgcggugcugcgcaagcugugcaucgaggccaagaucuccaacaccaccacggacagccggugcccgacccagggcgaggccacccucguggaggagcaggacgccaacuucgucugccgccggaccuucguggaccgcggcugggggaacggcugcgggcuguucggcaaggggucccugaucacgugcgccaaguucaagugcgugaccaagcucgagggcaagaccguccagcacgagaaccugaaguacagcgugaucgugaccguccacacgggcgaccagcaccagguggggaacgaguccaccgagcacggcaccaccgcgaccaucacgccccaggcccccagcaccgagauccagcugaccgacuacggggcccucacccuggacugcagcccccggacgggccuggacuucaacgagaugguccuccugaccaugaaggagaaguccuggcuggugcacaagcagugguuccucgaccugccgcugcccuggaccagcggggccuccaccagccaggagacguggaaccgcaaggaccuccuggugaccuucaagaccgcccacgcgaagaagcaggaggucguggugcugggcucccaggagggcgccaugcacaccgcccucacgggggccaccgagauccagaccagcggcaccacgaccaucuucgccgggcaccugaagugccggcugaagauggacaagcucacccugaagggcaccuccuacgucaugugcacggggagcuucaagcuggagaaggagguggcggagacccagcacggcaccgugcucguccagaucaaguacgagggcaccgacgcccccugcaagauccccuucuccacgcaggacgagaagggggugacccagaacggccgccugaucaccgccaacccgaucgugaccgacaaggagaagcccgucaacaucgaggccgagccgcccuucggggagagcuacaucgugaucggcgcgggcgagaaggcccugaagcuguccugguucaagaaggggagcuccaucggcaagauguucgaggccacggcccgcggggcccgccggauggcgauccucggcgacaccgccugggacuucgggagcaucggcggcguguucaccuccgucgggaagcuggugcaccagaucuucggcaccgccuacggggugcuguucagcggcgucuccuggacgaugaagaucgggaucggcgugcuccugaccuggcugggccucaacagccgcuccaccagccuguccaugaccugcaucgccguggggcuggucacgcucuaccugggcgugauggugcaggccgacagcgggugcgucaucaacuggaagggccgcgagcugaagugcgggagcggcaucuucgugaccaacgaggugcacaccuggaccgagcaguacaaguuccaggcggacuccccgaagcggcucagcgccgccaucggcaaggccugggaggagggggucugcggcauccgcuccgccacccggcuggagaacaucauguggaagcagaucagcaacgagcugaaccacauccuccuggagaacgacaugaaguucacggugguggucggggacguggcgggcauccuggcccaggggaagaagaugauccgcccccagcccauggaguacaaguacuccuggaaguccuggggcaaggccaagaucaucggcgccgacgugcagaacaccaccuucaucaucgacgggcccaacaccccggagugccccgacgaccagcgggcguggaacaucugggaggucgaggacuacggcuucgggaucuucacgaccaacaucuggcucaagcugcgcgacuccuacacccaggugugcgaccaccggcugaugagcgccgccaucaaggacuccaaggccgugcacgccgacaugggcuacuggaucgagagcgagaagaacgagaccuggaagcucgcgcgcgccuccuucaucgaggucaagacgugcaucuggcccaagagccacacccugugguccaacggcgugcuggagagcgagaugaucauccccaagaucuacgggggcccgaccucccagcacaacuaccggcccggguacuucacccagacggccggccccuggcaccucgggaagcuggagcuggacuucgaccucugcgagggcaccaccguggucguggacgagcacugcggcaaccgcgggccgagccugcggaccacgaccgugaccggcaagaucauccacgaguggugcugccgcuccugcacccugccgccccugcgguucaagggggaggacggcugcugguacgggauggagauccgccccgucaaggagaaggaggagaaccuggucaagagcauggugagcgccggcuccggcgaggucgacagcuucucccuggggcuccugugcaucagcaucaugaucgaggaggugaugcggucccgcuggagccggaagaugcugaugacgggcacccucgccguguucuuccugcugaucauggggcagcucaccuggaacgaccugauccgccugugcaucauggucggcgcgaacgccuccgaccggauggggaugggcaccacguaccucgcccugauggccaccuucaagaugcgcccgauguucgccguggggcuccuguuccgccggcugaccagccgcgaggugcugcuccugaccaucgggcugucccucgucgcgagcguggagcugcccaacucccuggaggagcucggcgacgggcuggccaugggcaucaugauccugaagcuccugacggacuuccagagccaccagcugugggccacccuccugucccugaccuucaucaagaccacguucagccuccacuacgccuggaagaccauggcgaugguccuguccaucgugagccuguucccccucugccuguccaccaccagccagaagacgaccuggcugcccgugcuccugggcucccuggggugcaagccgcucaccauguuccugaucgccgagaacaagaucuggggccgcaagagcuggccccugaacgaggggaucauggccgucggcaucgugagcauccuccuguccagccugcucaagaacgacgugccccuggccgggccccugaucgccggcggcaugcucaucgcgugcuacgucaucuccgggagcuccgccgaccugagccuggagaaggccgccgagguguccugggaggaggaggccgagcacagcggcgcgucccacaacauccucguggagguccaggacgacgggaccaugaagaucaaggacgaggagcgcgacgacacccugacgauccugcucaaggccacccugcuggccgugagcggcguguacccgcucuccauccccgccacccuguucgucugguacuucuggcagaagaagaagcagcggagcggggugcugugggacacccccagcccgcccgagguggagcgcgccguccucgacgacggcaucuaccggaucaugcagcgcggccugcuggggcggagccaggugggcgugggggucuuccaggagaacguguuccacacgauguggcacgugacccgcggcgcgguccugauguaccaggggaagcggcucgagcccuccugggccagcgugaagaaggaccugaucuccuacggcggcggguggcgccugcagggcagcuggaacaccggggaggaggugcaggucaucgccguggagcccggcaagaaccccaagaacgugcagaccgcccccgggacguucaagaccuccgagggcgaggucggcgccaucgcgcucgacuucaagcccgggaccagcggcagccccaucgugaaccgggaggggaagaucgugggccuguacggcaacggggucgugaccacguccggcaccuacgugagcgccaucgcccaggccaaggcgucccaggaggggccccugccggagaucgaggacgaggucuuccgcaagcggaaccucaccaucauggaccugcaccccggcagcgggaagacccgccgguaccugcccgccaucgugcgcgaggccaucaagcggaagcuccgcacgcugauccuggccccgacccggguggucgccuccgagauggcggaggcccucaagggcaugcccauccgcuaccagaccaccgccgugaagggcgagcacacggggaaggagaucguggaccugaugugccacgccaccuucaccaugcgccugcucagccccguccgggugcccaacuacaacaugaucaucauggacgaggcccacuucaccgacccguccagcaucgcggcccgcggcuacaucuccacgcggguggggaugggcgaggccgccgccaucuucaugaccgcgacgccgcccgggagcgucgaggccuucccccaguccaacgccgugauccaggacgaggagcgcgacaucccggagcggagcuggaacuccggcuacgaguggaucaccgacuuccccggcaagacggugugguucguccccagcaucaaguccgggaacgacaucgccaacugccugcgcaagaacggcaagcgggugauccagcugagccgcaagaccuucgacaccgaguaccagaagaccaagaacaacgacugggacuacguggucacgaccgacaucuccgagaugggggcgaacuuccgggccgaccgcgugaucgacccccggcgcugccucaagccggugauccugaaggacggccccgagcgggucauccuggccgggcccaugcccgugaccgucgccagcgccgcgcagcgccggggccgcaucggccggaaccacaacaaggagggggaccaguacaucuacaugggccagccgcucaacaacgacgaggaccacgcccacuggaccgaggccaagaugcugcuggacaacaucaacacgcccgaggggaucauccccgcccucuucgagcccgagcgcgagaaguccgccgcgaucgacggcgaguaccggcugcgcggggaggcccgcaagaccuucguggagcugaugcggcgcggcgaccucccgguguggcugagcuacaaggucgccagcgagggcuuccaguacuccgaccggcgcuggugcuucgacggggagcggaacaaccaggugcuggaggagaacauggacguggagaucuggaccaaggagggcgagcgcaagaagcuccggccccgcuggcuggacgcccggaccuacagcgacccccuggcccuccgcgaguucaaggaguucgcggccgggcggcgcuccgucagcggcgaccugauccuggagaucggcaagcucccccagcaccugacgcagcgggcccagaacgcccuggacaaccucgugaugcugcacaacuccgagcagggcgggcgcgcguaccggcacgccauggaggagcugccggacaccaucgagacccucaugcugcuggcccucaucgccgugcugaccgggggcgucacccuguucuuccucagcgggcgcggccugggcaagacguccaucgggcugcucugcgugauggccagcuccgcgcugcuguggauggccagcguggagccccacuggaucgccgccuccaucauccucgaguucuuccugaugguccugcucauccccgagcccgaccggcagcgcaccccgcaggacaaccagcuggccuacguggugaucggccuccucuucaugauccugaccgucgcggccaacgagauggggcugcucgagaccacgaagcgggaccugggcaucgggcacguggccguggagaaccaccaccacgccgccaugcuggacgucgaccuccaccccgcgagcgccuggacccuguacgccguggccaccaccaucaucacgcccaugaugcgccacaccaucgagaacaccaccgccaacaucucccugacggcgaucgccaaccaggccgccauccucaugggccuggacaagggcuggccgaucagcaagauggacaucggggugccccugcucgcgcugggcugcuacucccaggucaacccccugacccucaccgccgccgugcugaugcugguggcccacuacgccaucaucgggcccggccuccaggcgaaggccacccgggaggcccagaagcgcacggccgccgggaucaugaagaacccgaccgucgacggcaucguggcgaucgaccuggaccccguggucuacgacgccaaguucgagaagcagcugggccagaucaugcuccuggugcugugcaccagccagauccuccugaugcgcaccacgugggcccugugcgaguccaucacccucgccaccgggccccugaccacgcugugggagggcagccccgggaaguucuggaacaccaccaucgccguguccauggcgaacaucuuccggggcagcuaccucgccggcgccgggcuggccuucagccugaugaagucccucggcgggggccgccgggggaccggcgcgcagggcgagacgcugggggagaaguggaagcgccagcugaaccagcucagcaaguccgaguucaacaccuacaagcggagcggcaucauggaggucgaccgcuccgaggccaaggaggggcugaagcggggcgagaccaccaagcacgccgugagccgcgggacggccaagcugcggugguucguggagcgcaaccucgucaagccggagggcaaggugaucgaccugggcugcgggcggggcgggugguccuacuacugcgccggccugaagaaggugaccgaggucaagggguacaccaagggcggccccgggcacgaggagcccauccccauggcgaccuacggcuggaaccuggugaagcuccacagcgggaaggacguguucuucaucccgcccgagaagugcgacacgcugcugugcgacaucggcgaguccagccccaaccccaccaucgaggaggggcgcacccuccggguccugaagaugguggagccguggcugcgcggcaaccaguucugcaucaagauccucaaccccuacaugcccuccguggucgagacccuggagcagaugcagcggaagcacggcgggaugcuggugcgcaacccccucagccggaacuccacccacgagauguacugggugagcugcggcacggggaacaucgucuccgccgugaacaugaccagccgcaugcugcugaaccgguucaccauggcccaccgcaagccgaccuacgagcgcgacguggaccucggcgccggcacgcggcacgucgccguggagcccgagguggcgaaccuggacaucaucgggcagcgcaucgagaacaucaagcacgagcacaaguccaccuggcacuacgacgaggacaaccccuacaagaccugggccuaccacggcagcuacgaggucaagcccuccgggagcgccagcuccauggugaacggcgucgugaagcugcucaccaagccgugggacgugauccccauggucacgcagaucgccaugaccgacaccacccccuucgggcagcagcggguguucaaggagaagguggacacgcgcacccccaaggccaagcggggcaccgcgcagaucauggaggucaccgccaaguggcuguggggcuuccugagccgcaacaagaagccgcggaucugcacgcgcgaggaguucacccggaaggugcgcuccaacgccgccaucggggcgguguucgucgacgagaaccaguggaacagcgccaaggaggccguggaggacgagcgguucugggaccucgugcaccgcgagcgggagcugcacaagcagggcaagugcgcgaccugcgucuacaacaugauggggaagcgcgagaagaagcugggcgaguucgggaaggccaagggcucccgggcgaucugguacauguggcucggcgcccgcuuccuggaguucgaggcccugggguucaugaacgaggaccacugguucagccgggagaacucccucagcggcguggagggggagggccugcacaagcugggguacauccuccgcgacaucuccaagauccccggcggcaacauguacgccgacgacaccgccgggugggacacgcggaucaccgaggacgaccugcagaacgaggcgaagaucaccgacaucauggagcccgagcacgcccugcucgccaagagcaucuucaagcugaccuaccagaacaaggugguccgcgugcagcggccggccaagaacggcacggugauggacgucaucucccgccgcgaccagcgggggagcggccaggugggcaccuacgggcugaacaccuucaccaacaucgaggcccagcucauccgccagauggaguccgaggagaucuucagccccuccgagcuggagacgcccaaccuggcgggccgggugcucgacuggcuggagaagcacggggucgagcgccugaagcggauggccaucagcggcgacgacugcguggugaagcccaucgacgaccgcuucgccaccgcccucaccgcccugaacgacauggggaagguccggaaggacaucccgcagugggagcccuccaagggcuggaacgacuggcagcagguccccuucugcagccaccacuuccaccagcugaucaugaaggacggccgcgagaucgugguccccugccggaaccaggacgagcucguggggcgcgcgcgggugagccagggcgccggguggucccugcgcgagaccgccugccugggcaagagcuacgcccagauguggcagcucauguacuuccaccggcgcgaccugcggcuggcggccaacgccaucugcuccgccgucccgguggacugggugcccacgagccgcaccaccugguccauccacgcccaccaccaguggaugaccacggaggacaugcucagcgucuggaaccggguguggaucgaggagaaccccuggauggaggacaagacccacaucuccagcuggggcgacgugcccuaccugggcaagcgcgaggaccaguggugcggcucccugaucgggcucaccgcgcgggccaccugggccaccaacauccaggucgccaucaaccaggugcgccgccugaucggcaacgagaacuaccuggacuacaugacgagcaugaagcgguucaagaacgaguccgacccggagggggcccucugguga

SEQ ID NO: 8352 - RNA, 9879 nt, Artificial Sequence
  derived and/or modified CDS sequence (opt1) from DENV-1__FJ432723__SS-prME
agcgugaccaugcugcucaugcugaugcccaccgcccuggccuuccaccucaccacccggggcggggagccccacaugaucgugaccaagcaggagcggggcaagagccugcuguucaagaccagcgcgggggugaacaugugcacccucaucgccauggaccugggcgagcugugcgaggacaccaugaccuacaagugcccccggaucaccgaggccgagcccgacgacguggacugcuggugcaacgccacggacaccugggugaccuacgggaccugcagccagacgggcgagcaccggcgcgacaagcggagcguggcccucgcgccccacgugggccuggggcuggagacccgcaccgagaccuggauguccagcgagggcgccuggaagcagauccagcgggucgagacgugggcccuccgccaccccggguucaccgugaucgcccuguuccuggcgcacgccaucggcaccuccaucacccagaaggggaucaucuucauccuccugaugcuggugacgcccagcauggccaugcggugcgucggcaucggcucccgcgacuucguggaggggcucagcggcgccaccuggguggacgucgugcuggagcacggguccugcgugaccaccauggccaaggacaagcccacgcuggacaucgagcuccugaagaccgaggucaccaaccccgcggugcugcggaagcucugcaucgaggccaagaucagcaacaccacgaccgacucccgcugccccacccagggcgaggccacccugauggaggagcaggacgccaacuucgugugccggcgcacguucgucgaccggggcugggggaacggcugcgggcuguucggcaaggggagccucaucacgugcgccaaguucaagugcgugaccaagcuggagggcaagaucgugcaguacgagaaccugaaguacuccgucaucgugaccgugcacacgggcgaccagcaccaggucgggaacgagagcaccgagcacggcaccaccgcgaccaucacgccccaggcccccaccuccgagauccagcucaccgacuacggggcccugacccuggacugcagcccccgcacgggccucgacuucaacgagauggugcugcugaccaugaaggagaaguccuggcucguccacaagcagugguuccuggaccugccgcuccccuggaccagcggggccagcaccucccaggagacguggaaccggcaggaccugcuggugaccuucaagaccgcccacgcgaagaagcaggagguggucgugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgugaugugcaccggguccuucaagcucgagaaggaggucgcggagacgcagcacggcaccgugcuggugcagaucaaguacgagggcaccgacgcccccugcaagauccccuucagcacccaggacgagaagggggucacgcagaacggccggcugaucaccgccaacccgaucgugaccgacaaggagaagcccgugaacaucgaggccgagccgcccuucggggaguccuacaucgucaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcguggggaagcugguccaccagaucuucggcaccgccuacggggugcuguucuccggcgugagcuggaccaugaagaucgggaucggcguccugcugacguggcucggccugaacucccgcagcaccucccugagcaugaccugcaucgccguggggcucgugacccuguaccugggcgucauggugcaggccgacuccgggugcgugaucaacuggaagggccgggagcucaagugcgggagcggcaucuucgucacgaacgaggugcacaccuggaccgagcaguacaaguuccaggcggacagcccgaagcgccuguccgccgccaucggcaaggccugggaggagggggugugcggcauccggagcgccacccgccuggagaacaucauguggaagcagaucuccaacgagcucaaccacauccugcuggagaacgacaugaaguucaccgucguggugggggacgucgugggcauccucgcgcaggggaagaagaugauccggccccagcccauggagcacaaguacagcuggaaguccuggggcaaggccaagaucaucggcgccgacgugcagaacacgaccuucaucaucgacgggcccaacaccccggagugccccgacgaccagcgcgccuggaacaucugggaggucgaggacuacggcuucgggaucuucaccacgaacaucuggcugaagcugcgggacagcuacacccaggugugcgaccaccgccucauguccgcggccaucaaggacagcaaggccgugcacgccgacaugggcuacuggaucgaguccgagaagaacgagaccuggaagcuggcccgggcgagcuucaucgaggucaagaccugcaucuggcccaagucccacacgcuguggagcaacggcgugcucgaguccgagaugaucauccccaagaucuacgggggcccgaucagccagcacaacuaccgccccggguacuucacccagaccgccggccccuggcaccuggggaagcuggagcucgacuucgaccugugcgagggcaccacgguggucguggacgagcacugcggcaaccgggggccgucccugcgcaccaccaccgugacgggcaagaucauccacgaguggugcugccggagcugcacccugccgccccuccgcuucaagggggaggacggcugcugguacgggauggagauccggcccgucaaggagaaggaggagaaccuggugaaguccauggugagcgccggcagcggcgaggucgacuccuucagccucgggcugcugugcaucuccaucaugaucgaggaggugaugcgcagccgguggucccgcaagaugcucaugaccggcacccuggccguguuccugcuccugaucauggggcagcugacguggaacgaccucauccggcugugcaucauggucggcgccaacgcgagcgaccgcauggggaugggcaccaccuaccuggcccucaucgccaccuucaagaugcgcccgauguucgccguggggcugcuguuccggcgccucacgucccgggaggugcugcugcucaccaucgggcugagccuggucgccuccguggagcuccccaacagccuggaggagcugggcgacgggcucgcgaugggcaucaugauccugaagcugcucaccgacuuccagucccaccagcugugggccacccugcucagcuucacguucaucaagaccacccugucccugcacuacgccuggaagaccauggccaugguccucagcaucgugucccuguucccccugugccucagcacgaccucccagaagaccaccuggcugcccgugcugcucggcagccuggggugcaagccgcugacgauguuccucaucgcggagaacaagaucuggggccgcaaguccuggccccugaacgaggggaucauggccgucggcguggugagcauccugcucagcucccugcugaagaacgacgucccccucgccgggccccugaucgccggcggcaugcugaucgccugcuacgugaucagcggguccagcgcggaccucucccuggagaaggccgccgaggugagcugggaggaggaggccgagcacuccggcgccagccacaacauccuggucgaggugcaggacgacgggaccaugaagaucaaggacgaggagcgggacgacacccucaccauccugcugaaggcgacccuccuggccguguccggcgucuacccgcugagcauccccgccacccucuucgugugguacuucuggcagaagaagaagcagcgcuccggggugcugugggacacccccagcccgcccgaggucgagcgggccgugcuggacgacggcaucuaccgcaucaugcagcggggccugcucgggcgcucccaggugggcgucgggguguuccaggagaacguguuccacaccauguggcacgucacccggggcgccgugcugauguaccaggggaagcgccuggagcccagcugggcguccgugaagaaggaccucaucagcuacggcggcggguggcggcugcagggcuccuggaacacgggggaggagguccaggugaucgccguggagcccggcaagaaccccaagaacguccagaccgcccccgggaccuucaagacccccgagggcgaggugggcgccaucgcccuggacuucaagcccgggacgagcggcucccccaucgugaaccgcgaggggaagaucgucggccucuacggcaacgggguggugaccaccagcggcaccuacgucagcgcgaucgcccaggccaaggccucccaggaggggccgcugcccgagaucgaggacgagguguuccggaagcgcaaccugacgaucauggaccuccaccccggcagcgggaagacccggcgcuaccugccggcgaucgugcgggaggccaucaagcgcaagcugcggacccucauccuggcccccacccgcgucguggccuccgagauggccgaggcgcugaagggcaugcccauccgcuaccagacgaccgccgucaagagcgagcacaccggcaaggagaucgucgaccucaugugccacgccaccuucacgaugcggcugcugucccccgugcgcgugccgaacuacaacaugaucaucauggacgaggcccacuucaccgaccccagcuccaucgccgcgcggggguacaucagcacccgcgucggcaugggggaggccgccgccaucuucaugaccgccacgccgcccggcuccguggaggcguucccgcagagcaacgccgugauccaggacgaggagcgggacauccccgagcgcuccuggaacagcggguacgaguggaucaccgacuuccccggcaagaccgucugguucgugcccuccaucaagagcggcaacgacaucgccaacugccuccggaagaacgggaagcgcgugauccagcugucccggaagaccuucgacacggaguaccagaagaccaagaacaacgacugggacuacgucgugaccaccgacaucagcgagaugggcgccaacuuccgcgcggaccgggugaucgacccgcgccggugccugaagcccgucauccucaaggacgggcccgagcgcgugauccuggccggccccaugccggucacgguggccuccgccgcccagcggcgcgggcggaucggccgcaaccacaacaaggagggcgaccaguacaucuacauggggcagccccugaacaacgacgaggaccacgcgcacuggaccgaggccaagaugcuccuggacaacaucaacacccccgagggcaucauccccgcccuguucgagccggagcgggagaaguccgccgccaucgacggggaguaccgccuccgcggcgaggcgcggaagaccuucguggagcugaugcgccgcggggaccugcccgucuggcucuccuacaagguggccagcgagggcuuccaguacagcgaccgccgguggugcuucgacggcgagcgcaacaaccaggugcuggaggagaacauggacgucgagaucuggacgaaggagggggagcggaagaagcugcgcccccgguggcucgacgcccgcaccuacuccgacccccuggcccugcgggaguucaaggaguucgccgcgggccgccggagcguguccggggaccucauccuggagaucggcaagcugccgcagcaccucacccagcgcgcccagaacgcccuggacaaccuggugaugcuccacaacagcgagcagggcgggcgggccuaccgccacgcgauggaggagcugcccgacaccaucgagacgcugaugcuccuggcccugaucgccguccucaccggcggggugacccuguucuuccuguccggccgggggcucggcaagaccagcaucggccugcugugcgugauggccuccagcguccuccuguggauggccuccguggagccccacuggaucgcggccagcaucauccuggaguucuuccucauggugcugcugauccccgagccggaccgccagcggacgccccaggacaaccagcucgccuacgucgugaucgggcugcuguucaugauccucacgguggccgccaacgagaugggccugcuggagaccaccaagaaggaccucgggaucggccacgucgcgguggagaaccaccaccacgccaccaugcuggacguggaccugcaccccgccuccgccuggacgcucuacgccgucgcgaccaccaucaucaccccgaugaugcgccacacgaucgagaacaccaccgccaacaucagccugaccgccaucgccaaccaggccgcgauccugauggggcucgacaagggcuggcccaucuccaagauggacaucggcgugccccugcuggcccucgggugcuacagccaggugaacccccugacgcugaccgccgccguccucaugcugguggcgcacuacgccaucaucggcccggggcugcaggccaaggccacccgggaggcccagaagcgcaccgcggccggcaucaugaagaaccccacgguggacgggaucgucgccaucgaccucgaccccgugguguacgacgccaaguucgagaagcagcugggccagaucaugcugcucauccugugcaccucccagauccugcucaugcgcaccaccugggcccugugcgagagcaucacgcuggcgaccggcccccucaccacccugugggagggguccccgggcaaguucuggaacacgaccaucgccgucagcauggccaacaucuuccggggguccuaccuggccggcgccggccucgcguucagccugaugaagucccucgggggcgggcgccgggggaccggggcccagggcgagacccucggcgagaaguggaagcgccagcugaaccagcuguccaagagcgaguucaacacguacaagcgguccgggaucauggagguggaccgcagcgaggccaaggagggccucaagcgcggggagaccacccgccacgccgugucccggggcaccgcgaagcugcgcugguucgucgagcggaaccuggugaagcccgaggggaaggugaucgaccugggcugcggccgcgggggcuggagcuacuacugcgccgggcucaagaaggucacggaggugaagggcuacaccaagggcgggcccggccacgaggagcccaucccgauggccaccuacggguggaaccuggugaagcugcacuccggcaaggacgucuucuucacgccgcccgagaagugcgacacgcuccugugcgacaucggggagagcucccccaacccgaccaucgaggagggccggacccugcgcgugcucaagaugguggagcccuggcugcgggggaaccaguucugcaucaagauccugaaccccuacaugcccagcgucguggagacccucgagcagaugcagcgcaagcacggcggcaugcuggugcggaacccgcugucccgcaacagcacccacgagauguacugggucuccugcgggacgggcaacaucgugagcgccgugaacaugaccucccggaugcuccugaaccgcuucaccauggcccaccgcaagcccaccuacgagcgggacgucgaccugggggcgggcacgcgccacguggccguggagcccgaggucgccaaccucgacaucaucggccagcggaucgagaacaucaagcacgagcacaagagcaccuggcacuacgacgaggacaaccccuacaagaccugggccuaccacggguccuacgaggugaagccgagcggcuccgccagcagcauggucaacgggguggugaagcugcugaccaagcccugggacgucauccccauggugacgcagaucgcgaugaccgacaccacccccuucggccagcagcgcguguucaaggagaaggucgacacgcggaccccgaaggccaagcgcgggaccgcccagaucauggaggugaccgccaaguggcucuggggcuuccugucccggaacaagaagccccgcaucugcacgcgggaggaguucacccgcaaggugcggagcaacgccgcgaucggcgccgucuucguggacgagaaccaguggaacuccgccaaggaggccguggaggacgagcgcuucugggaccugguccagaaggagcgggagcuccacaagcaggggaagugcgcgaccugcguguacaacaugaugggcaagcgcgagaagaagcugggggaguucggcaaggccaaggggagccgggccaucugguacauguggcugggcgcccgcuuccucgaguucgaggcccugggcuucaugaacgaggaccacugguucucccgggagaacagccuguccgggguggagggcgaggggcuccacaagcugggcuacauccugcgcgacaucagcaagauccccgggggcaacauguacgcggacgacaccgccggcugggacacgcggaucaccgaggacgaccuccagaacgaggccaagaucaccgacaucauggagccggagcacgcccugcuggccaccuccaucuucaagcucacguaccagaacaaggucgugcgcgugcagcggcccgcgaagaacgggaccgucauggacgugaucagccgccgcgaccagcggggcuccggccaggugggcaccuacggccugaacaccuucacgaacauggaggcccagcugauccgccagauggagagcgaggggaucuuccuccccggcgagcuggagacccccaaccuggccgagcggguccucgacuggcuggagaaguacgggguggagcgccugaagcggauggccaucuccggcgacgacugcguggucaagccgaucgacgaccgcuucgccaccgcgcucaccgcccugaacgacauggggaaggugcggaaggacaucccccagugggagcccagcaagggcuggaacgacuggcagcagguccccuucugcucccaccacuuccaccagcugaucaugaaggacggccgcgagaucgucgugccgugccggaaccaggacgagcucguggggcgcgcccgggucagccagggcgccggguggucccugcgcgagacggccugccugggcaagagcuacgcgcagauguggcagcucauguacuuccaccggcgcgaccugcggcuggccgccaacgccaucugcagcgcggugcccguggacuggguccccaccucccgcaccaccuggagcauccacgcccaccaccaguggaugacgaccgaggacaugcucuccguguggaaccggguguggaucgaggagaaccccuggauggaggacaagacccacgucagcuccuggggcgacgugccguaccugggcaagcgcgaggaccaguggugcggcagccugaucgggcucaccgcccgggccaccugggccuccaacauccagguggcgaucaaccagguccgccgccugaucggcaacgagaacuaccuggacuacaugacgagcaugaagcgguucaagaacgagggggaccccgagggcgcccucugguga

SEQ ID NO: 8353 - RNA, 9879 nt, Artificial Sequence
  derived and/or modified CDS sequence (opt1) from DENV-1__FJ410192__SS-prME
agcgugaccaugcugcugaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgagaccgagcccgacgacguggacugcuggugcaacgccacggacaccugggugaccuacgggaccugcagccagacgggcgagcaccggcgggacaagcgguccguggcccucgcgccccacgugggccuggggcuggagacccgcaccgagaccuggaugagcuccgagggcgccuggaagcagauccagcgggucgagacgugggcccuccggcaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagcuggccgagacccagcacggcaccgugcuggugcagaucaaguacgagggcaccgacgcgcccugcaagauccccuucagcacgcaggacgagaagggggucacccagaacggccggcugaucaccgccaacccgaucgugaccgacaaggagaagcccgugaacaucgaggccgagccgcccuucggggaguccuacaucgucaucggcgccggcgagaaggcgcucaagcugagcugguucaagaagggguccagcaucggcaagauguucgaggccacggcccgcggggcccggcgcauggccauccugggcgacaccgcgugggacuucggguccaucggcggcguguucaccagcguggggaagcucguccaccagaucuucggcaccgccuacggggugcuguucuccggcgugagcuggacgaugaagaucgggaucggcguccugcucaccuggcugggccugaacucccgcagcaccucccucagcaugaccugcaucgccguggggcuggugacgcuguaccucggcgucauggugcaggccgacuccgggugcgugaucaacuggaagggccgggagcugaagugcgggagcggcaucuucgucaccaacgaggugcacaccuggaccgagcaguacaaguuccaggccgacagcccgaagcgccuguccgcggccaucggcaaggccugggaggagggggugugcggcauccggagcgccacccgccucgagaacaucauguggaagcagaucuccaacgagcugaaccacauccugcucgagaacgacaugaaguucacggucguggugggggacgucgccggcauccuggcgcaggggaagaagaugauccggccccagcccauggaguacaaguacagcuggaaguccuggggcaaggccaagaucaucggcgccgacgugcagaacaccaccuucaucaucgacgggcccaacaccccggagugccccgacgaccagcgcgccuggaacaucugggagguggaggacuacggcuucgggaucuucacgaccaacaucuggcugaagcuccgggacagcuacacccaggucugcgaccaccgccugauguccgcggccaucaaggacagcaaggccgugcacgccgacaugggcuacuggaucgaguccgagaagaacgagaccuggaagcuggcccgggcgagcuucaucgaggugaagacgugcaucuggcccaagucccacacccucuggagcaacggcguccuggaguccgagaugaucauccccaagaucuacgggggcccgaucagccagcacaacuaccgccccggguacuucacccagaccgccggccccuggcaccuggggaagcucgagcuggacuucgaccugugcgagggcacgaccgugguggucgacgagcacugcggcaaccgggggccgucccuccgcaccaccacggugaccggcaagaucauccacgaguggugcugccggagcugcacccugccgccccugcgcuuccgcggggaggacggcugcugguacgggauggagauccgccccgugaaggagaaggaggagaaccucgucaaguccauggugagcgccggcagcggcgagguggacuccuucagccuggggcugcucugcaucuccaucaugaucgaggaggucaugcggagccgcuggucccggaagaugcugaugaccggcacgcuggccguguucuuccuccugaucauggggcagcugaccuggaacgaccucauccgccugugcaucauggugggcgccaacgcgagcgaccgcauggggaugggcaccaccuaccuggcccucauggccacguucaagaugcggccgauguucgccgucggccugcuguuccgccggcucaccucccgcgaggugcugcugcucaccaucgggcugagccugguggccuccgucgagcuccccaacagccuggaggagcugggcgacgggcucgcgaugggcaucaugauccugaagcugcucaccgacuuccagucccaccagcugugggccacgcugcucagccugaccuucaucaagaccaccuucucccugcacuacgccuggaagacgauggccaugauccucagcaucgugucccuguucccccugugccucagcaccaccucccagaagaccacguggcugcccguccugcucggcagccuggggugcaagccgcugaccauguuccucaucgcggagaacaagaucuggggccggcgcuccuggccccugaacgaggggaucauggccgugggcaucgugagcauccugcucagcucccugcugaagaacgacgucccccucgccgggccccugaucgccggcggcaugcugaucgccugcuacgugaucagcggguccagcgcggaccucucccuggagaaggccgccgaggugagcugggaggaggaggccgagcacuccggcgccagccacaacauccuggucgaggugcaggacgacgggaccaugaagaucaaggacgaggagcgggacgacacccucaccauccugcugaaggcgacgcuccuggccguguccggcgucuacccgcugagcauccccgccacccucuucgugugguacuucuggcagaagaagaagcagcgcuccggggugcugugggacacccccagcccgcccgaggucgagcgggccgugcuggacgacggcaucuaccgcaucaugcagcggggccugcucgggcgcucccaggugggcgucgggguguuccaggagaacguguuccacaccauguggcacgucacgcggggcgccgugcugauguaccaggggaagcgccuggagcccagcugggcguccgugaagaaggaccucaucagcuacggcggcggguggcggcugcagggcuccuggaacaccggggaggagguccaggugaucgccguggagcccggcaagaaccccaagaacguccagaccgcccccgggaccuucaagacgcccgagggcgaggugggcgccaucgcccuggacuucaagcccgggaccagcggcucccccaucgugaaccgcgaggggaagaucgucggccucuacggcaacgggguggugaccaccagcggcacguacgucagcgcgaucgcccaggccaaggccucccaggaggggccgcugcccgagaucgaggacgagguguuccggaagcgcaaccugaccaucauggaccuccaccccggcagcgggaagacccggcgcuaccugccggcgaucgugcgggaggccaucaagcgcaagcugcgcacccucauccuggcccccacgcgggucguggccuccgagauggccgaggcgcugaagggcaugcccauccgcuaccagaccaccgccgucaagagcgagcacaccggcaaggagaucgucgaccucaugugccacgccacguucaccaugcggcugcugucccccgugcgcgugccgaacuacaacaugaucaucauggacgaggcccacuucaccgaccccagcuccaucgccgcgcggggguacaucagcacccgcgucggcaugggggaggccgccgccaucuucaugacggccacgccgcccggcuccguggaggcguucccgcagagcaacgccgugauccaggacgaggagcgggacauccccgagcgcuccuggaacagcggguacgaguggaucaccgacuuccccggcaagaccgucugguucgugcccuccaucaagagcggcaacgacaucgccaacugccuccggaagaacgggaagcgcgugauccagcugucccggaagacguucgacaccgaguaccagaagaccaagaacaacgacugggacuacgucgugaccacggacaucagcgagaugggcgccaacuuccgcgcggaccgggugaucgacccgcgccggugccugaagcccgucauccucaaggacgggcccgagcgcgugauccuggccggccccaugccggugaccgucgccuccgccgcccagcggcgcgggcggaucggccgcaaccacaacaaggagggcgaccaguacaucuacauggggcagccccugaacaacgacgaggaccacgcgcacuggaccgaggccaagaugcuccuggacaacaucaacacccccgagggcaucauccccgcccuguucgagccggagcgcgagaaguccgccgccaucgacggggaguaccggcuccgcggcgaggcgcggaagacguucguggagcugaugcgccgcggggaccugcccgucuggcucuccuacaagguggccagcgagggcuuccaguacagcgaccgccgguggugcuucgacggcgagcgcaacaaccaggugcuggaggagaacauggacgucgagaucuggaccaaggagggggagcggaagaagcugcgcccccgguggcucgacgcccgcaccuacuccgacccccuggcccugcgggaguucaaggaguucgccgcgggccgccggagcguguccggggaccucauccuggagaucggcaagcugccgcagcaccucacccagcgcgcccagaacgcccuggacaaccuggugaugcuccacaacagcgagcagggcgggcgggccuaccgccacgcgauggaggagcugcccgacacgaucgagacccugaugcuccuggcccugaucgccguccucaccggcggggugacccuguucuuccuguccggccgggggcucggcaagaccagcaucggccugcugugcgugauggccuccagcguccuccuguggauggccuccguggagccccacuggaucgcggccagcaucauccuggaguucuuccucauggugcugcugauccccgagccggaccgccagcggacgccccaggacaaccagcucgccuacgucgugaucgggcugcuguucaugauccucaccguggccgccaacgagaugggccugcuggagaccaccaagaaggaccucgggaucggccacgucgcgguggagaaccaccaccacgccgccaugcuggacguggaccugcaccccgccuccgccuggacgcucuacgcggucgccaccaccaucaucaccccgaugaugcgccacacgaucgagaacaccaccgccaacaucagccugaccgccaucgccaaccaggcggccauccugauggggcucgacaagggcuggcccaucuccaagauggacaucggcgugccccugcuggcccucgggugcuacagccaggugaacccccugacgcugaccgccgcgguccucaugcugguggcccacuacgccaucaucggcccggggcugcaggccaaggccacccgcgaggcgcagaagcggaccgccgccggcaucaugaagaaccccacgguggacgggaucgucgccaucgaccucgaccccgugguguacgacgccaaguucgagaagcagcugggccagaucaugcugcucauccugugcaccucccagauccugcucaugcgcaccaccugggcgcugugcgagagcaucacgcuggccaccggcccccucaccacccugugggagggguccccgggcaaguucuggaacacgaccaucgccgucagcauggccaacaucuuccggggguccuaccuggccggcgcgggccucgccuucagccugaugaagucccucgggggcgggcgccgggggaccggggcccagggcgagacccucggcgagaaguggaagcgccagcugaaccagcuguccaagagcgaguucaacacguacaagcgguccgggaucauggagguggaccgcagcgaggccaaggagggccucaagcgcggggagaccaccaagcacgcggugucccgcggcaccgccaagcugcggugguucgucgagcgcaaccuggugaagcccgaggggaaggugaucgaccugggcugcggccgcggcggguggagcuacuacugcgccgggcucaagaaggucacggaggugaagggguacaccaagggcggccccggccacgaggagcccaucccgauggccaccuacggguggaaccuggugaagcugcacuccggcaaggacgucuucuucaucccgcccgagaagugcgacacccuccugugcgacaucggggagagcucccccaacccgacgaucgaggagggccgcacccugcgggugcucaagaugguggagcccuggcugcgcgggaaccaguucugcaucaagauccugaaccccuacaugcccagcgucguggagacccucgagcagaugcagcggaagcacggcggcaugcuggugcgcaacccgcugucccggaacagcacccacgagauguacugggucuccugcgggaccggcaacaucgugagcgccgugaacaugacgucccgcaugcuccugaaccgcuucaccauggcgcaccggaagcccaccuacgagcgcgacgucgaccugggggccggcacccggcacguggccguggagcccgaggucgccaaccucgacaucaucggccagcgcaucgagaacaucaagcacgagcacaagagcacguggcacuacgacgaggacaaccccuacaagaccugggccuaccacggguccuacgaggugaagccgagcggcuccgcgagcagcauggugaacggggucgugaagcugcugaccaagcccugggacgucauccccauggugacccagaucgccaugacggacaccacccccuucggccagcagcggguguucaaggagaaggucgacacccgcacgccgaaggccaagcgggggaccgcccagaucauggaggugaccgccaaguggcucuggggcuuccugucccgcaacaagaagccccggaucugcacccgcgaggaguucacgcggaaggugcgcagcaacgcggccaucggcgccgucuucguggacgagaaccaguggaacuccgccaaggaggcgguggaggacgagcgguucugggaccugguccaccgcgagcgggagcuccacaagcaggggaagugcgcgaccugcguguacaacaugaugggcaagcgcgagaagaagcugggggaguucggcaaggccaaggggagccgggccaucugguacauguggcugggcgcccgcuuccucgaguucgaggcgcugggcuucaugaacgaggaccacugguucucccgggagaacagccuguccgggguggagggcgaggggcuccacaagcugggcuacauccugcgcgacaucagcaagauccccgggggcaacauguacgccgacgacaccgccggcugggacacccggaucacggaggacgaccuccagaacgaggcccgcaucaccgacaucauggagccggagcacgcccugcuggcgaaguccaucuucaagcucaccuaccagaacaaggucgugcgcgugcagagccccgccaagaacgggaccgucauggacgugaucucccggcgcgaccagcggggcagcggccagguggggacguacggccugaacaccuucaccaacauggaggcccagcugauccgccagauggaguccgaggggaucuucagccccuccgagcucgagacccccaaccuggccgagcggguccuggacuggcucgagaaguacggcguggagcgccugaagcggauggccaucagcggggacgacugcguggucaagccgaucgacgaccgcuucgcgacggcccugaccgcccucaacgacaugggcaaggugcggaaggacaucccccagugggagcccuccaagggguggaacgacuggcagcagguccccuucugcagccaccacuuccaccagcugaucaugaaggacggccgcgagaucgucgugccgugccggaaccaggacgagcuggugggccgcgcccgggucagccagggggccggcuggucccuccgcgagaccgcgugccugggcaagagcuacgcccagauguggcagcugauguacuuccaccggcgcgaccuccggcuggccgccaacgcgaucugcuccgccgugcccguggacuggauccccaccagccgcacgaccugguccauccacgcccaccaccaguggaugaccaccgaggacaugcugagcgucuggaaccggguguggaucgaggagaaccccuggauggaggacaagacgcacaucuccagcuggggcgacgugccguaccucgggaagcgcgaggaccaguggugcggcucccugaucggccugaccgcccgcgccaccugggcgaccaacauccaggucgccaucaaccaggugcggcgccucaucgggaacgagaacuaccuggacuacaugaccagcaugaagcgguucaagaacgaguccgaccccgagggcgcccugugguga

SEQ ID NO: 8354 - RNA, 9879 nt, Artificial Sequence
  derived and/or modified CDS sequence (opt1) from DENV-1__FJ410194__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccgcaucaccgagaccgagcccgacgacguggacugcuggugcaacgccacggacaccugggugaccuacgggaccugcagccagacgggcgagcaccggcgcgacaagcgguccguggcccucgcgccccacgugggccuggggcuggagacccgcaccgagaccuggaugagcuccgagggcgcguggaagcagauccagcgggucgagacgugggcccuccgccacccgggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugccccacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccgcuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagguggccgagacccagcacggcaccgugcugguccagaucaaguacgagggcaccgacgcgcccugcaagauccccuucagcacgcaggacgagaagggggugacccagaacggccggcugaucaccgccaacccgaucgugaccgacaaggagaagcccgucaacaucgaggccgagccgcccuucggggaguccuacaucgugaucggcgccggcgagaaggcgcugaagcucagcugguucaagaagggguccagcaucggcaagauguucgaggccacggcccgcggggcccggcgcauggccauccugggcgacaccgcgugggacuucggguccaucggcggcguguucaccagcgucgggaagcuggugcaccagaucuucggcaccgccuacggggugcuguucuccggcgucagcuggacgaugaagaucgggaucggcgugcugcugaccuggcucggccugaacucccgcagcaccucccugagcaugaccugcaucgccguggggcucgucacgcuguaccugggcgugauggugcaggccgacuccgggugcgucaucaacuggaagggccgggagcucaagugcgggagcggcaucuucgugaccaacgaggugcacaccuggaccgagcaguacaaguuccaggccgacagcccgaagcgccuguccgcggccaucggcaaggccugggaggagggggucugcggcauccggagcgccacccgccuggagaacaucauguggaagcagaucuccaacgagcucaaccacauccugcuggagaacgacaugaaguucacggugguggucggggacguggccggcauccucgcgcaggggaagaagaugauccggccccagcccauggaguacaaguacagcuggaaguccuggggcaaggccaagaucaucggcgccgacgugcagaacaccaccuucaucaucgacgggcccaacaccccggagugccccgacgaccagcgcgccuggaacaucugggaggucgaggacuacggcuucgggaucuucacgaccaacaucuggcugaagcugcgggacagcuacacccaggugugcgaccaccgccucauguccgcggccaucaaggacagcaaggccgugcacgccgacaugggcuacuggaucgaguccgagaagaacgagaccuggaagcuggcccgggcgagcuucaucgaggucaagacgugcaucuggcccaagucccacacccuguggagcaacggcgugcucgaguccgagaugaucauccccaagaucuacgggggcccgaucagccagcacaacuaccgccccggguacuucacccaggccgccggccccuggcaccuggggaagcuggagcucgacuucgaccugugcgagggcaccacgguggucguggacgagcacugcggcaaccgggggccgucccugcgcaccaccaccgugacgggcaagaucauccacgaguggugcugccggagcugcacccugccgccccuccgcuuccgcggggaggacggcugcugguacgggauggagauccgccccgucaaggagaaggaggagaaccuggugaaguccauggugagcgccggcagcggcgaggucgacuccuucagccucgggcugcugugcaucuccaucaugaucgaggaggugaugcggagccgcuggucccggcgcaugcucaugaccggcacccuggccguguucuuccugcucaucauggggcagcugacguggaacgaccugauccgccucugcaucauggucggcgcgaacgccagcgaccggauggggaugggcaccaccuaccuggcccugauggccaccuucaagaugcgcccgauguucgccgugggccuccuguuccggcgccugacgucccgggaggugcuccugcugaccaucgggcucagccuggucgcguccguggagcugcccaacagccucgaggagcugggcgacgggcuggccaugggcaucaugauccucaagcugcugaccgacuuccagucccaccagcucugggccacccugcugagccucacguucaucaagaccaccuucucccugcacuacgccuggaagaccauggcgaugguccugagcaucgugucccucuucccccugugccugagcacgaccucccagaagaccaccuggcuccccgugcugcugggcagccucgggugcaagccgcugacgauguuccugaucgccgagaacaagaucuggggccgccgguccuggccccucaacgaggggaucauggccgucggcaucgugagcauccugcugagcucccuccugaagaacgacgugccccuggccgggccccucaucgccggcggcaugcugaucgcgugcuacgucaucagcggguccagcgccgaccugucccucgagaaggccgccgaggugagcugggaggaggaggccgagcacuccggcgcgagccacaacauccugguggagguccaggacgacgggaccaugaagaucaaggacgaggagcgcgacgacacccugaccauccuccugaaggccacccugcucgccguguccggcguguacccgcugagcauccccgccacgcuguucgucugguacuucuggcagaagaagaagcagcgguccggggugcucugggacacccccagcccgcccgagguggagcgcgccguccuggacgacggcaucuaccggaucaugcagcgcggccugcuggggcggucccaggugggcgugggggucuuccaggagaacguguuccacaccauguggcacgugacccgcggcgcgguccucauguaccaggggaagcggcuggagcccagcugggccuccgugaagaaggaccugaucagcuacggcggcggguggcgccuccagggcuccuggaacacgggggaggaggugcaggucaucgccguggagcccggcaagaaccccaagaacgugcagaccgcccccgggaccuucaagacccccgagggcgaggucggcgccaucgcgcuggacuucaagcccgggacgagcggcucccccaucgugaaccgggaggggaagaucgugggccuguacggcaacggggucgugaccaccagcggcaccuacgugagcgccaucgcccaggccaaggcgucccaggaggggccgcuccccgagaucgaggacgaggucuuccgcaagcggaaccugacgaucauggaccugcaccccggcagcgggaagacccgccgguaccucccggccaucgugcgcgaggccaucaagcgcaagcugcggacccugauccucgcccccacccgcguggucgccuccgagauggcggaggcccugaagggcaugcccauccgguaccagacgaccgccgucaagagcgagcacaccggcaaggagaucguggaccugaugugccacgccaccuucacgaugcgccuccugucccccguccgggugccgaacuacaacaugaucaucauggacgaggcccacuucaccgaccccagcuccaucgcggcccgcggguacaucagcacccgggugggcaugggggaggccgccgccaucuucaugaccgcgacgccgcccggcuccgucgaggccuucccgcagagcaacgccgugauccaggacgaggagcgcgacauccccgagcgguccuggaacagcggguacgaguggaucaccgacuuccccggcaagaccgugugguucguccccuccaucaagagcggcaacgacaucgccaacugccugcgcaagaacgggaagcgggugauccagcucucccgcaagaccuucgacacggaguaccagaagaccaagaacaacgacugggacuacguggucaccaccgacaucagcgagaugggcgcgaacuuccgggccgaccgcgugaucgacccgcggcgcugccugaagcccgugauccugaaggacgggcccgagcgggucauccucgccggccccaugccggugacggucgccuccgccgcgcagcgccgggggcgcaucggccgcaaccacaacaaggagggcgaccaguacaucuacauggggcagccccugaacaacgacgaggaccacgcccacuggaccgaggccaagaugcugcucgacaacaucaacacccccgagggcaucauccccgcccuguucgagccggagcgggagaaguccgccgcgaucgacggggaguaccgccugcggggcgaggcccgcaagaccuucguggagcucaugcggcgcggggaccugcccguguggcuguccuacaaggucgccagcgagggcuuccaguacagcgaccggcgcuggugcuucgacggcgagcggaacaaccaggugcucgaggagaacauggacguggagaucuggacgaaggagggggagcgcaagaagcugcggccccgcuggcuggacgcccggaccuacuccgacccccucgcccugcgcgaguucaaggaguucgcggccggccggcgcagcgucuccggggaccugauccucgagaucggcaagcugccgcagcaccugacccagcgggcccagaacgcccucgacaaccuggugaugcugcacaacagcgagcagggcgggcgcgcguaccggcacgccauggaggagcuccccgacaccaucgagacgcugaugcugcucgcccugaucgccgugcugaccggcggggucacccucuucuuccuguccggccgcgggcugggcaagaccagcaucggccuccugugcgugauggccuccagcgugcugcucuggauggcguccgucgagccccacuggaucgccgccagcaucauccuggaguucuuccugauggugcuccugauccccgagccggaccggcagcgcacgccccaggacaaccagcuggccuacguggucaucgggcuccuguucaugauccugacgguggccgcgaacgagaugggccuccuggagaccaccaagaaggaccuggggaucggccacguggccgucgagaaccaccaccacgccgccaugcucgacguggaccugcaccccgccuccgcguggacccuguacgccguggccacgaccaucaucaccccgaugaugcgccacaccaucgagaacacgaccgccaacaucagccucaccgccaucgcgaaccaggccgccauccugauggggcuggacaagggcuggcccaucuccaagauggacaucggcgucccccuccuggcccuggggugcuacagccaggugaacccccucacccugacggcggccgugcugaugcucgucgcccacuacgccaucaucggcccggggcugcaggccaaggcgacccgggaggcccagaagcgcaccgccgccggcaucaugaagaaccccaccguggacgggaucguggccaucgaccuggaccccgucguguacgacgcgaaguucgagaagcagcucggccagaucaugcugcugauccucugcacgucccagauccugcugaugcggaccaccugggcccucugcgagagcaucacccuggccacgggcccccugaccacccucugggagggguccccgggcaaguucuggaacaccacgaucgccgugagcauggccaacaucuuccgcggguccuaccuggcgggcgccggccuggccuucagccucaugaagucccucgggggcgggcggcgcgggaccggggcccagggcgagacccugggcgagaaguggaagcggcagcucaaccagcuguccaagagcgaguucaacaccuacaagcgcuccgggaucauggaggucgaccggagcgaggcgaaggagggccugaagcgcggggagacgaccaagcacgccgugucccggggcaccgccaagcuccgcugguucguggagcggaaccuggucaagcccgaggggaaggugaucgaccugggcugcggccgcgggggcuggagcuacuacugcgccgggcugaagaaggugaccgaggucaagggcuacacgaagggcgggcccggccacgaggagcccaucccgauggccaccuacggguggaaccucgugaagcugcccuccggcaaggacguguucuucaucccgcccgagaagugcgacacccugcucugcgacaucggggagagcuccccgaaccccaccaucgaggagggccggacgcugcgcguccugaagaugguggagcccuggcuccgggggaaccaguucugcaucaagauccugaaccccuacaugccgagcguggucgagacccuggagcagaugcagcgcaagcacggcggcaugcucgugcggaacccccugucccgcaacagcacccacgagauguacuggguguccugcgggaccggcaacaucgucagcgcggugaacaugaccucccgcaugcugcucaaccgguucacgauggcccaccgcaagcccaccuacgagcgggacguggaccugggggccggcacccgccacgucgccguggagcccgagguggccaaccuggacaucaucggccagcggaucgagaacaucaagcacgagcacaagagcaccuggcacuacgacgaggacaacccguacaagacgugggcguaccacggguccuacgaggucaagcccagcggcuccgccagcagcauggugaacggggucgugaagcuccugaccaagcccugggacgugauccccauggucacccagaucgccaugaccgacacgaccccguucggccagcagcgcguguucaaggagaagguggacacccggacccccaaggccaagcgcgggacggcccagaucauggaggucaccgcgaaguggcuguggggcuuccucucccggaacaagaagccccgcaucugcacccgggaggaguucacccgcaaggugcggagcaacgccgccaucggcgccguguucgucgacgagaaccaguggaacuccgcgaaggaggccguggaggacgagcgcuucugggaccuggugcaccgggagcgcgagcugcacaagcaggggaagugcgccacgugcgucuacaacaugaugggcaagcgggagaagaagcucggggaguucggcaaggccaaggggagccgcgccaucugguacauguggcugggcgcgcgguuccuggaguucgaggcccucggcuucaugaacgaggaccacugguucucccgcgagaacagccuguccgggguggagggcgaggggcugcacaagcucggcuacauccugcgggacaucagcaagauccccgggggcaacauguacgccgacgacaccgccggcugggacacccgcaucaccgaggacgaccugcagaacgagccccgcaucacggacaucauggagcccgagcacgcccuccuggcgaaguccaucuucaagcugaccuaccagaacaaggugguccgggugcagagccccgccaagaacgggaccgugauggacgucaucucccgccgggaccagcgcggcagcggccagguggggaccuacggccucaacacguucaccaacauggaggcccagcugauccggcagauggaguccgaggggaucuucagcccguccgagcuggagacccccaaccucgccgagcgcgugcuggacuggcuggagaaguacggcgucgagcggcucaagcgcauggccaucagcggggacgacugcguggugaagcccaucgacgaccgguucgcgaccgcccugacggcccugaacgacaugggcaagguccgcaaggacaucccccagugggagccguccaagggguggaacgacuggcagcagguccccuucuggagccaccacuuccaccagcucaucaugaaggacggccgggagaucgugguccccugccgcaaccaggacgagcuggugggccgggcccgcgugagccagggggccggcuggucccugcgggagaccgcgugccucgccaagagcuacgcccagauguggcagcugauguacuuccaccgccgggaccugcgccucgccgcgaacgccaucugcuccgccguccccguggacuggaucccgaccagccggaccacgugguccauccacgcccaccaccaguggaugaccaccgaggacaugcugagcguguggaaccgcgucuggaucgaggagaaccccuggauggaggacaagacccacaucuccagcuggggcgacgugcccuaccugggcaagcgcgaggaccaguggugcgggucccucaucggccugacggcccgggcgaccugggccaccaacauccagguggccaucaaccagguccgccggcugaucggcaacgagaacuaccucgacuacaugaccagcaugaagcgcuucaagaacgaguccgaccccgagggggcccugugguga

SEQ ID NO: 8355 - RNA, 9879 nt, Artificial Sequence
  derived and/or modified CDS sequence (opt1) from DENV-1__FJ432725__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccgcaucaccgagaccgagcccgacgacguggacugcuggugcaacgccacggacaccugggugaccuacgggaccugcagccagacgggcgagcaccggcgcgacaagcgguccguggcccucgcgccccacgugggccuggggcuggagacccgcaccgagaccuggaugagcuccgagggcgccuggaagcagauccagcggguggagacgugggcccuccgccaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagguggccgagacccagcacggcaccgugcugguccagaucaaguacgagggcaccgacgcgcccugcaagauccccuucagcacgcaggacgagaagggggugacccagaacggccggcugaucaccgccaacccgaucgugaccgacaaggagaagcccgucaacaucgaggccgagccgcccuucggggaguccuacaucgugaucggcgccggcgagaaggcgcugaagcucagcugguucaagaagggguccagcaucggcaagauguucgaggccacggcccgcggggcccggcgcauggccauccugggcgacaccgcgugggacuucggguccaucggcggcguguucaccagcgucgggaagcuggugcaccagaucuucggcaccgccuacgggguccuguucuccggcgucagcuggacgaugaagaucgggaucggcgugcugcugaccuggcucggccugaacucccgcagcaccucccugagcaugaccugcaucgccguggggcucgucacgcuguaccugggcgugauggugcaggccgacuccgggugcgucaucaacuggaagggccgggagcucaagugcgggagcggcaucuucgugaccaacgaggugcacaccuggaccgagcaguacaaguuccaggccgacagcccgaagcgccuguccgcggccaucggcaaggccugggaggagggggucugcggcauccggagcgccacccgccuggagaacaucauguggaagcagaucuccaacgagcucaaccacauccugcuggagaacgacaugaaguucacggugguggucggggacguggccggcauccucgcgcaggggaagaagaugauccggccccagcccauggaguacaaguacagcuggaaguccuggggcaaggccaagaucaucggcgccgacgugcagaacaccaccuucaucaucgacgggcccaacaccccggagugccccgacgaccagcgcgccuggaacaucugggaggucgaggacuacggcuucgggaucuucacgaccaacaucuggcugaagcugcgggacagcuacacccaggugugcgaccaccgccucauguccgcggccaucaaggacagcaaggccgugcacgccgacaugggcuacuggaucgaguccgagaagaacgagaccuggaagcuggcccgggcgagcuucaucgaggucaagacgugcaucuggcccaagucccacacccuguggagcaacggcgugcucgaguccgagaugaucauccccaagaucuacgggggcccgaucagccagcacaacuaccgccccggguacuucacccaggccgccggccccuggcaccuggggaagcuggagcucgacuucgaccugugcgagggcaccacgguggucguggacgagcacugcggcaaccgggggccgucccugcgcaccaccaccgugacgggcaagaucauccacgaguggugcugccggagcugcacccugccgccccuccgcuuccgcggggaggacggcugcugguacgggauggagauccgccccgucaaggagaaggaggagaaccuggugaaguccauggugagcgccggcagcggcgaggucgacuccuucagccucgggcugcugugcaucuccaucaugaucgaggaggugaugcggagccgcuggucccggcgcaugcucaugaccggcacccuggccguguucuuccugcucaucauggggcagcugacguggaacgaccugauccgccucugcaucauggucggcgcgaacgccagcgaccggauggggaugggcaccaccuaccuggcccugauggccaccuucaagaugcgcccgauguucgccgugggccuccuguuccggcgccugacgucccgggaggugcuccugcugaccaucgggcucagccuggucgcguccguggagcugcccaacagccucgaggagcugggcgacgggcuggccaugggcaucaugauccucaagcugcugaccgacuuccagucccaccagcucugggccacccugcugagccucacguucaucaagaccaccuucucccugcacuacgccuggaagaccauggcgaugguccugagcaucgugucccucuucccccugugccugagcacgaccucccagaagaccaccuggcuccccgugcugcugggcagccucgggugcaagccgcugacgauguuccugaucgccgagaacaagaucuggggccgccgguccuggccccucaacgaggggaucauggccgucggcaucgugagcauccugcugagcucccuccugaagaacgacgugccccuggccgggccccucaucgccggcggcaugcugaucgcgugcuacgucaucagcggguccagcgccgaccugucccucgagaaggccgccgaggugagcugggaggaggaggccgagcacuccggcgcgagccacaacauccugguggagguccaggacgacgggaccaugaagaucaaggacgaggagcgcgacgacacccugaccauccuccugaaggccacccugcucgccguguccggcguguacccgcugagcauccccgccacgcuguucgucugguacuucuggcagaagaagaagcagcgguccggggugcucugggacacccccagcccgcccgagguggagcgcgccguccuggacgacggcaucuaccggaucaugcagcgcggccugcuggggcggucccaggugggcgugggggucuuccaggagaacguguuccacaccauguggcacgugacccgcggcgcgguccucauguaccaggggaagcggcuggagcccagcugggccuccgugaagaaggaccugaucagcuacggcggcggguggcgccuccagggcuccuggaacacgggggaggaggugcaggucaucgccguggagcccggcaagaaccccaagaacgugcagaccgcccccgggaccuucaagacccccgagggcgaggucggcgccaucgcgcuggacuucaagcccgggacgagcggcucccccaucgugaaccgggaggggaagaucgugggccuguacggcaacggggucgugaccaccagcggcaccuacgugagcgccaucgcccaggccaaggcgucccaggaggggccgcuccccgagaucgaggacgaggucuuccgcaagcggaaccugacgaucauggaccugcaccccggcagcgggaagacccgccgguaccucccggccaucgugcgcgaggccaucaagcgcaagcugcggacccugauccucgcccccacccgcguggucgccuccgagauggcggaggcccugaagggcaugcccauccgguaccagacgaccgccgucaagagcgagcacaccggcaaggagaucguggaccugaugugccacgccaccuucacgaugcgccuccugucccccguccgggugccgaacuacaacaugaucaucauggacgaggcccacuucaccgaccccagcuccaucgcggcccgcggguacaucagcacccgggugggcaugggggaggccgccgccaucuucaugaccgcgacgccgcccggcuccgucgaggccuucccgcagagcaacgccgugauccaggacgaggagcgcgacauccccgagcgguccuggaacagcggguacgaguggaucaccgacuuccccggcaagaccgugugguucguccccuccaucaagagcggcaacgacaucgccaacugccugcgcaagaacgggaagcgggugauccagcucucccgcaagaccuucgacacggaguaccagaagaccaagaacaacgacugggacuacguggucaccaccgacaucagcgagaugggcgcgaacuuccgggccgaccgcgugaucgacccgcggcgcugccugaagcccgugauccugaaggacgggcccgagcgggucauccucgccggccccaugccggugacggucgccuccgccgcgcagcgccgggggcgcaucggccgcaaccacaacaaggagggcgaccaguacaucuacauggggcagccccugaacaacgacgaggaccacgcccacuggaccgaggccaagaugcugcucgacaacaucaacacccccgagggcaucauccccgcccuguucgagccggagcgggagaaguccgccgcgaucgacggggaguaccgccugcggggcgaggcccgcaagaccuucguggagcucaugcggcgcggggaccugcccguguggcuguccuacaaggucgccagcgagggcuuccaguacagcgaccggcgcuggugcuucgacggcgagcggaacaaccaggugcucgaggagaacauggacguggagaucuggacgaaggagggggagcgcaagaagcugcggccccgcuggcuggacgcccggaccuacuccgacccccucgcccugcgcgaguucaaggaguucgcggccggccggcgcagcgucuccggggaccugauccucgagaucggcaagcugccgcagcaccugacccagcgggcccagaacgcccucgacaaccuggugaugcugcacaacagcgagcagggcgggcgcgcguaccggcacgccauggaggagcuccccgacaccaucgagacgcugaugcugcucgcccugaucgccggcgugaccgggggcgucacccugguguuccucuccgggcgcggccugggcaagaccagcaucgggcugcucugcgugauggccuccagcguccugcuguggauggcguccguggagccccacuggaucgccgccagcaucauccucgaguucuuccugauggugcugcucauccccgagccggaccggcagcgcacgccccaggacaaccagcuggccuacgucgugaucggccuccucuucaugauccugacgguggccgcgaacgagauggggcugcucgagaccaccaagaaggaccugggcaucgggcacgucgccguggagaaccaccaccacgccgccaugcuggacguggaccuccaccccgccuccgcguggacccuguacgccgucgccacgaccaucaucaccccgaugaugcgccacaccaucgagaacacgaccgccaacaucagccugaccgccaucgcgaaccaggccgccauccucaugggccuggccaagggcuggcccaucuccaagauggacaucggggugccccugcucgcgcugggcugcuacagccaggugaacccccugacccucacggccccgguccugaugcugguggcccacuacgccaucaucgggcccggccuccaggccaaggcgacccgggaggcccagaagcgcaccgccgccgggaucaugaagaaccccaccguggacggcaucgucgccaucgaccuggaccccgugguguacgacgcgaaguucgagaagcagcugggccagaucaugcuccugauccugugcacgucccagauccuccugaugcggaccaccugggcccugugcgagagcaucacccucgccacggggccgcugaccacccugugggagggcucccccgggaaguucuggaacaccacgaucgccgucagcauggccaacaucuuccgcggcuccuaccucgcgggcgccgggcuggccuucagccugaugaagucccucggcgggggccggcgcgggaccggcgcccagggcgagacccugggggagaaguggaagcggcagcugaaccagcucuccaagagcgaguucaacaccuacaagcgcuccggcaucauggagguggaccggagcgaggcgaaggaggggcugaagcgcggcgagacgaccaagcacgccgugucccgggggaccgccaagcugcgcugguucgucgagcggaaccucgugaagcccgagggcaaggugaucgaccugggcugcgggcgcggcggguggagcuacuacugcgccggccugaagaaggucaccgaggugaagggguacacgaagggcggccccgggcacgaggagccgauccccauggccaccuacggcuggaaccuggugaagcuccacuccgggaaggacgucuucuucaucccgcccgagaagugcgacacccugcugugcgacaucggcgagagcuccccgaaccccaccaucgaggaggggcggacgcuccgcgugcugaagaugguggagcccuggcugcggggcaaccaguucugcaucaagauccucaaccccuacaugccgagcgucguggagacccuggagcagaugcagcgcaagcacggcgggaugcuggugcggaacccccucucccgcaacagcacccacgagauguacugggucuccugcggcaccgggaacaucgugagcgcggugaacaugaccucccgcaugcugcugaaccgguucacgauggcccaccgcaagcccaccuacgagcgggacgucgaccucggcgccggcccccgccacguggccguggagccggaggucgccaaccuggacaucaucgggcagcggaucgagaacaucaagcacgagcacaagagcaccuggcacuacgacgaggacaaccccuacaagaccugggcguaccacggcuccuacgaggugaagcccagcggguccgccagcagcauggucaacggcguggugaagcugcucacgaagcccugggacgucaucccgauggugacccagaucgccaugaccgacaccacgcccuucgggcagcagcgcguguucaaggagaaggucgacacccggacccccaaggccaagcgcggcaccgcccagaucauggaggugacggcgaaguggcuguggggcuuccugucccggaacaagaagccgcgcaucugcacccgggaggaguucacccgcaaggugcggagcaacgccgccaucggggccgucuucguggacgagaaccaguggaacuccgcgaaggaggccguggaggacgagcgcuucugggaccucggccaccgggagcgcgagcugcacaagcaggggaagugcgcgaccugcgucagcaacaugaugggcaagcgggagaagaagcugggggaguucggcaagcccaagggcucccgccccaucugguacauguggcucggggcccgguuccuggaguucgaggcccugggcuucaugaacgaggaccacugguucagccgcgagaacucccucagcgggguggagggcgaggggcugcacaagcugggcuacauccuccgggacaucuccaagauccccggcgggaacauguacgcggacgacacggccggcugggacacccgcaucaccgaggacgaccugcagaacgaggcccgcaucaccgacaucauggagccggagcacgcccugcucgccaagagcaucuucaagcugacguaccagaacaaggugguccgggugcagcgccccgcgaagaacgggaccgugauggacgucaucuccagccgggaccagcgcggcuccggccagguggggaccuacggccugaacaccuucacgaacauggaggcccagcucauccggcagauggagagcgaggggaucuucucccccagcgagcuggagacccccaaccuggccgagcgcgugcucgacuggcuggagaaguacggcgucgagcggcugaagcgcauggccaucuccggggacgacugcguggugaagccgaucgacgaccgguucgccaccgcgcucaccgcccugaacgacaugggcaagguccgcaaggacaucccccagugggagcccagcaagggcuggaacgacuggcagcagguccccuucugcagccaccacuuccaccagcugaucaugaaggacgggcgggagaucguggucccgugccgcaaccaggacgagcucgugggccgggcccgcgugucccagggggccggcuggagccugcgggagacggccugccuggggaaguccuacgcgcagauguggcagcucauguacuuccaccgccgggaccugcgccuggccgccaacgccaucugcagcgcgguccccguggacuggauccccaccucccggaccaccuggagcauccacgcccaccaccaguggaugacgaccgaggacaugcucuccguguggaaccgcgucuggaucgaggagaaccccuggauggaggacaagacccacaucagcuccuggggcgacgugccguaccugggcaagcgcgaggaccaguggugcgggagccugaucggccucaccgcccgggccacgugggccaccaacauccagguggcgaucaaccagguccgccggcugaucgggaacgagaacuaccuggacuacaugaccuccaugaagcgcuucaagaacgagagcgaccccgagggcgcccucugguga

SEQ ID NO: 8356 - RNA, 9879 nt, Artificial Sequence
  derived and/or modified CDS sequence (opt1) from DENV-1__FJ432729__SS-prME
agcgugaccaugcugcucaugcugaugcccaccgcccuggccuuccaccucaccacccggggcggggagccccacaugaucgugaccaagcaggagcggggcaagagccugcuguucaagaccagcgcgggggugaacaugugcacccucaucgccauggaccugggcgagcugugcgaggacaccaugaccuacaagugcccccggaucaccgaggccgagcccgacgacguggacugcuggugcaacgccacggacaccugggucaccuacgggaccugcagccagacgggcgagcaccggcgcgacaagcggagcguggcccucgcgccccacgugggccuggggcuggagacccgcaccgagaccuggauguccagcgagggcgccuggaagcagauccagcgggucgagacgugggcccuccgccaccccggguucaccgugaucgcccuguuccuggcgcacgugaucggcaccuccaucacccagaaggggaucaucuucauccuccugaugcuggucacgcccagcauggccaugcggugcgugggcaucggcucccgcgacuucguggaggggcucagcggcgccaccugggucgacguggugcuggagcacggguccugcgucaccaccauggccaaggacaagcccacgcuggacaucgagcuccugaagaccgaggugaccaaccccgccgugcugcggaagcucugcaucgaggcgaagaucagcaacaccacgaccgacucccgcugccccacccagggcgaggccacccugauggaggagcaggacgccaacuucgucugccggcgcacguucguggaccggggcugggggaacggcugcgggcuguucggcaaggggagccucaucacgugcgccaaguucaagugcgugaccaagcuggagggcaagaucguccaguacgagaaccugaaguacuccgugaucgugaccguccacacgggcgaccagcaccagguggggaacgagagcaccgagcacggcaccaucgccaccaucacgccccaggcgcccacguccgagauccagcucaccgacuacggggcccugacccuggacugcagcccccgcaccggccucgacuucaacgagaugguccugcugacgaugaaggagaaguccuggcucgugcacaagcagugguuccuggaccugccgcuccccuggaccagcggggccagcaccucccaggagaccuggaaccggcaggaccugcuggugacguucaagaccgcccacgccaagaagcaggaggucguggugcucggcagccaggagggcgcgaugcacaccgcccugaccggggccacggagauccagaccuccggcaccaccacgaucuucgccgggcaccugaagugccgccucaagauggacaagcugacccugaagggcaugagcuacgucaugugcaccggguccuucaagcucgagaaggagguggccgagacccagcacggcacggugcugguccagaucaaguacgagggcaccgacgcgcccugcaagauccccuucagcacccaggacgagaagggggugacccagaacggccggcugaucacggccaacccgaucgugaccgacaaggagaagcccgucaacaucgaggccgagccgcccuucggggaguccuacaucgugaucggcgccggcgagaaggcgcugaagcucagcugguucaagaagggguccagcaucggcaagauguucgaggccaccgcccgcggggcccggcgcauggccauccugggcgacaccgcgugggacuucggguccaucggcggcguguucacgagcgucgggaagcuggugcaccagaucuucggcaccgccuacggggugcuguucuccggcgucagcuggaccaugaagaucgggaucggcgugcugcugaccuggcucggccugaacucccgcagcacgucccugagcaugaccugcaucgccguggggcucgucacccuguaccugggcgugauggugcaggccgacuccgggugcgucaucaacuggaagggccgggagcucaagugcgggagcggcaucuucgugaccaacgaggugcacacguggaccgagcaguacaaguuccaggccgacagcccgaagcgccuguccgcggccaucggcaaggccugggaggagggggucugcggcauccggagcgccacccgccuggagaacaucauguggaagcagaucuccaacgagcucaaccacauccugcuggagaacgacaugaaguucaccgugguggucggggacguggugggcauccucgcccaggggaagaagaugauccggccccagcccauggagcacaaguacagcuggaaguccuggggcaaggcgaagaucaucggcgccgacguccagaacaccacguucaucaucgacgggcccaacaccccggagugccccgacgaccagcgcgccuggaacaucugggagguggaggacuacggcuucgggaucuucaccaccaacaucuggcugaagcugcgggacagccacacccaggugugcgaccaccgccucauguccgccgcgaucaaggacagcaaggccguccacgccgacaugggcuacuggaucgaguccgagaagaacgagaccuggaagcuggcccgggccagcuucaucgaggugaagaccugcaucuggcccaagucccacacccuguggagcaacggcgugcucgaguccgagaugaucauccccaagaucuacgggggcccgaucagccagcacaacuaccgccccggguacuucacgcagaccgcgggccccuggcaccuggggaagcuggagcucgacuucgaccugugcgagggcaccaccgucgugguggacgagcacugcggcaaccgggggccgucccugcgcacgaccaccgucaccggcaagaucauccacgaguggugcugccggagcugcacgcugccgccccuccgcuucaagggggaggacggcugcugguacgggauggagauccggcccgugaaggagaaggaggagaaccuggugaaguccauggucagcgccggcagcggcgagguggacuccuucagccucgggcugcugugcaucuccaucaugaucgaggaggugaugcgcagccgguggucccgcaagaugcucaugaccggcacccuggccgucuuccugcuccugaucauggggcagcugaccuggaacgaccucauccggcugugcaucauggugggcgccaacgccagcgaccgcauggggaugggcacgaccuaccuggcgcucauggccaccuucaagaugcgcccgauguucgccgugggccugcuguuccggcgccucaccucccgggagguccugcugcucacgaucgggcugagccugguggccuccgucgagcuccccaacagccuggaggagcugggcgacgggcucgccaugggcaucaugauccugaagcugcucaccgacuuccagucccaccagcugugggcgacccugcucagccugaccuucaucaagacgacccugucccuccacuacgccuggaagaccauggccauggugcugagcaucgugucccuguucccccucugccugagcaccacgucccagaagaccaccuggcugcccguccuccugggcagccuggggugcaagccgcucgccaugcugcugaucgcggagaacaagaucuggggccgcaaguccuggccccucaacgaggggaucauggccgugggcguggucagcauccugcugagcucccuccugaagaacgacgugccccuggccgggccccucaucgccggcggcaugcugaucgccugcuacgugaucagcggguccagcgcggaccugucccucgagaaggccgccgaggucagcugggaggaggaggccgagcacuccggcgccagccacaacauccugguggaggugcaggacgacgggaccaugaagaucaaggacgaggagcgggacgacacgcugaccauccuccugaaggcgacccugcucgccgucuccggcguguacccgcugagcauccccgccacccuguucgugugguacuucuggcagaagaagaagcagcgcuccgggguccugugggacacccccagcccgcccgagguggagcgggccgugcucgacgacggcaucuaccgcaucaugcagcggggccugcuggggcgcucccaggucggcguggggguguuccaggagaacgucuuccacacgauguggcacgugacccggggcgccgugcucauguaccaggggaagcgccuggagcccagcugggcguccgucaagaaggaccugaucagcuacggcggcggguggcggcuccagggcuccuggaacaccggggaggagguccaggugaucgccgucgagcccggcaagaaccccaagaacgugcagaccgcccccgggacguucaagacccccgagggcgaggugggcgccaucgcccuggacuucaagcccgggaccagcggcucccccaucgucaaccgcgaggggaagaucgugggccuguacggcaacgggguggucaccacgagcggcaccuacgugagcgcgaucgcccaggccaaggccucccaggaggggccgcuccccgagaucgaggacgagguguuccggaagcgcaaccugaccaucauggaccugcaccccggcagcgggaagacccggcgcuaccucccggcgaucguccgggaggccaucaagcgcaagcugcggacgcugauccucgcccccacccgcgugguggccuccgagauggccgaggcgcugaagggcaugcccauccgcuaccagaccaccgccgucaagagcgagcacacgggcaaggagaucguggaccugaugugccacgccaccuucaccaugcggcuccugucccccgugcgcgucccgaacuacaacaugaucaucauggacgaggcccacuucaccgaccccagcuccaucgccgcgcggggguacaucagcacgcgcgugggcaugggggaggccgccgccaucuucaugaccgccacgccgcccggcuccguggaggcguucccgcagagcaacgccgucauccaggacgaggagcgggacauccccgagcgcuccuggaacagcggguacgaguggaucaccgacuuccccggcaagacggugugguucgugcccuccaucaagagcggcaacgacaucgccaacugccugcggaagaacgggaagcgcgucauccagcucucccggaagaccuucgacaccgaguaccagaagaccaagaacaacgacugggacuacguggugacgaccgacaucagcgagaugggcgccaacuuccgcgcggaccgggucaucgacccgcgccggugccugaagcccgugauccugaaggacgggcccgagcgcgucauccucgccggccccaugccggugaccguggccuccgccgcccagcggcgcgggcggaucggccgcaaccacaacaaggagggcgaccaguacaucuacauggggcagccccugaacaacgacgaggaccacgcgcacuggaccgaggccaagaugcugcucgacaacaucaacacgcccgagggcaucauccccgcccuguucgagccggagcgggagaaguccgccgccaucgacggggaguaccgccugcgcggcgaggcgcggaagaccuucgucgagcucaugcgccgcggggaccugcccguguggcuguccuacaagguggccagcgagggcuuccaguacagcgaccgccgguggugcuucgacggcgagcgcaacaaccagguccucgaggagaacauggacguggagaucuggaccaaggagggggagcggaagaagcugcgcccccgguggcuggacgcccgcaccuacuccgacccccucgcccugcgggaguucaaggaguucgccgcgggccgccggagcguguccggggaccugauccucgagaucggcaagcugccgcagcaccugacgcagcgcgcccagaacgcccucgacaaccuggucaugcugcacaacagcgagcagggcgggcgggccuaccgccacgcgauggaggagcuccccgacaccaucgagacccugaugcugcucgcccugaucgccgugcugaccggcggggugacccucuucuuccuguccggccgggggcugggcaagaccagcaucggccuccugugcgucauggccuccagcgugcugcucuggauggccuccguggagccccacuggaucgcggccagcaucauccuggaguucuuccugaugguccuccugauccccgagccggaccgccagcggacgccccaggacaaccagcuggccuacguggugaucgggcuccuguucaugauccugaccgucgccgccaacgagaugggccuccuggagaccacgaagaaggaccuggggaucggccacguggcgguggagaaccaccaccacgccaccaugcucgacgucgaccugcaccccgccuccgccuggacccuguacgccguggcgaccacgaucaucaccccgaugaugcgccacaccaucgagaacaccacggccaacaucagccucaccgccaucgccaaccaggccgcgauccugauggggcuggacaagggcuggcccaucuccaagauggacaucggcgugccccuccuggcccuggggugcuacagccaggucaacccccucacccugaccgccgccgugcugaugcucguggcgcacuacgccaucaucggcccggggcugcaggccaaggccacgcgggaggcccagaagcgcaccgcggccggcaucaugaagaaccccaccgucgacgggaucguggccaucgaccuggaccccguggucuacgacgccaaguucgagaagcagcucggccagaucaugcugcugauccucugcaccucccagauccugcugaugcgcacgaccugggcccucugcgagagcaucacccuggcgaccggcccccugacgacccucugggagggguccccgggcaaguucuggaacaccaccaucgccgugagcauggccaacaucuuccggggguccuaccuggccggcgccggccuggcguucagccucaugaagucccucgggggcgggcgccgggggacgggggcccagggcgagacccugggcgagaaguggaagcgccagcucaaccagcuguccaagagcgaguucaacaucuacaagcgguccgggaucauggagguggaccgcagcgaggccaaggagggccugaagcgcggggagaccacccgccacgccgucucccggggcacggcgaagcugcgcugguucguggagcggaaccucgugaagcccgaggggaaggucaucgaccugggcugcggccgcgggggcuggagcuacuacugcgccgggcugaagaaggugaccgaggugaagggcuacaccaagggcgggcccggccacgaggagcccaucccgauggccaccuacggguggaaccucgucaagcugcacuccggcaaggacguguucuucacgccgcccgagaagugcgacacccugcucugcgacaucggggagagcucccccaacccgaccaucgaggagggccggacccugcgcgugcugaagauggucgagcccuggcuccgggggaaccaguucugcaucaagauccugaaccccuacaugcccagcgugguggagacgcuggagcagaugcagcgcaagcacggcggcaugcucguccggaacccgcugucccgcaacagcacccacgagauguacuggguguccugcgggaccggcaacaucgugagcgccgucaacaugaccucccggaugcugcucaaccgcuucaccauggcccaccgcaagcccacguacgagcgggacguggaccugggggcgggcacccgccacguggccgucgagcccgagguggccaaccuggacaucaucggccagcggaucgagaacaucaagcacgagcacaagagcaccuggcacuacgacgaggacaaccccuacaagaccugggccuaccacggguccuacgaggucaagccgagcggcuccgccagcagcauggugaacgggguggucaagcuccugacgaagcccugggacgugauccccauggugacccagaucgcgaugaccgacaccacgcccuucggccagcagcgcgucuucaaggagaagguggacacccggaccccgaaggccaagcgcgggaccgcccagaucauggaggugacggcccgguggcuguggggcuuccucucccgcaacaagaagccccggaucugcacccgcgaggaguucacccggaagguccgcagcaacgccgcgaucggcgccguguucguggacgagaaccaguggaacuccgccaaggaggccgucgaggacgagcgguucugggaccuggugcagaaggagcgcgagcugcacaagcaggggaagugcgcgaccugcguguacaacaugaugggcaagcgggagaagaagcucggggaguucggcaaggccaaggggagccgcgccaucugguacauguggcugggcgcccgguuccuggaguucgaggcccucggcuucaugaacgaggaccacugguucucccgcgagaacagccuguccggggucgagggcgaggggcugcacaagcucggcuacauccugcgggacaucagcaagauccccgggggcaacauguacgcggacgacacggccggcugggacacccgcaucaccgaggacgaccugcagaacgaggcccggaucaccgacaucauggagccggagcacgcccuccuggccacguccaucuucaagcugaccuaccagaacaagguggugcgcguccagcgccccgcgaagaacgggaccgugauggacgugaucagccggcgcgaccagcggggcuccgggcaggucggcaccuacggccucaacacguucaccaacauggaggcccagcugauccgccagauggagagcgaggggaucuuccugcccuccgagcucgagacccagaaccuggccgagcgggugcuggacuggcucgagaaguacggcguggagcgccugaagcggauggccaucagcggggacgacugcgucgugaagcccaucgacgaccgcuucgccaccgcgcugacggcccucaacgacaugggcaaggugcggaaggacaucccgcagugggagcccuccaagggguggaacgacuggcagcagguccccuucugcagccaccacuuccaccagcugaucaugaaggacggccgcgagaucguggugcccugccggaaccaggacgagcuggucggccgcgcccgggugucccagggggccggcuggagccuccgcgagaccgccugccugggcaagagcuacgcgcagauguggcagcugauguacuuccaccggcgcgaccuccggcuggccgccaacgccaucugcuccgcggugccggucgacugggugcccaccagccgcaccacgugguccauccacgcccaccaccaguggaugaccaccgaggacaugcugagcguguggaaccgggucuggaucgaggagaaccccuggauggaggacaagacccacguguccagcuggggcgacgugcccuaccucgggaagcgcgaggaccaguggugcggcucccugaucggccugacggcccgcgccaccugggccagcaacauccaggucgcgaucaaccaggugcggcgccucaucgggaacgagaacuaccuggacuacaugaccuccaugaagcgguucaagaacgagggcgacccggagggggcccugugguga

SEQ ID NO: 8357 - RNA, 9879 nt, Artificial Sequence
  derived and/or modified CDS sequence (opt1) from DENV-1__FJ432730__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgaguucugcgaggacacgaugaccuacaagugcccccgcaucaccgaggccgagcccgacgacguggacugcuggugcaacgccaccgacacgugggugaccuacgggaccugcagccagaccggcgagcaccggcgggacaagcgguccguggcccuggcgccccacgugggccucgggcuggagacgcgcaccgagaccuggaugagcuccgagggcgccuggaagcagauccagcggguggagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugcccgacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaagaccguccaguacgagaaccugaaguacagcgugaucgugaccguccacacgggcgaccagcaccagguggggaacgaguccaccgagcacggcaccaccgcgaccaucacgccccaggcccccagcaccgagauccagcugaccgacuacggggcccucacccuggacugcagcccccggacgggccuggacuucaacgagaugguccuccugaccaugaaggagaaguccuggcuggugcacaagcagugguuccucgaccugccgcugcccuggaccagcggggccuccaccagccaggagacguggaaccggaaggaccuccuggugaccuucaagaccgcccacgcgaagaagcaggaggucguggugcugggcucccaggagggcgccaugcacaccgcccucacgggggccaccgagauccagaccagcggcaugaccacgaucuucgccgggcaccugaagugccgccugaagauggacaagcucacccugaagggcauguccuacgucaugugcaccgggagcuucaagcuggagaaggagguggcggagacccagcacggcacggugcucguccagaucaaguacgagggcaccgacgcccccugcaagauccccuucuccacccaggacgagaagggggugacccagaacggccggcugaucacggccaacccgaucgugaccgacaaggagaagcccgucaacaucgaggccgagccgcccuucggggagagcuacaucgugaucggcgcgggcgagaaggcccugaagcuguccugguucaagaaggggagcuccaucggcaagauguucgaggccaccgcccgcggggcccggcgcauggcgauccucggcgacaccgccugggacuucgggagcaucggcggcguguucacguccgucgggaagcuggugcaccagaucuucggcaccgccuacggggugcuguucagcggcgucuccuggaccaugaagaucgggaucggcgugcuccugaccuggcugggccucaacagccgcuccacgagccuguccaugaccugcaucgccguggggcuggucacccucuaccugggcgugauggugcaggccgacagcgggugcgucaucaacuggaagggccgggagcugaagugcgggagcggcaucuucgugaccaacgaggugcacacguggaccgagcaguacaaguuccaggcggacuccccgaagcgccucagcgccgccaucggcaaggccugggaggagggggucugcggcauccgguccgccacccgccuggagaacaucauguggaagcagaucagcaacgagcugaaccacauccuccuggagaacgacaugaaguucaccgugguggucggggacguggcgggcauccuggcccaggggaagaagaugauccggccccagcccauggaguacaaguacuccuggaaguccuggggcaaggccaagaucaucggcgccgacgugcagaacaccacguucaucaucgacgggcccaacaccccggagugccccgacgaccagcgcgcguggaacaucugggaggucgaggacuacggcuucgggaucuucaccaccaacaucuggcucaagcugcgggacuccuacacccaggugugcgaccaccgccugaugagcgccgccaucaaggacuccaaggccgugcacgccgacaugggcuacuggaucgagagcgagaagaacgagacguggaagcucgcgcgggccuccuucaucgaggucaagaccugcaucuggcccaagagccacacccugugguccaacggcgugcuggagagcgagaugaucauccccaagaucuacgggggcccgaucucccagcacaacuaccgccccggguacuucacgcagaccgccggccccuggcaccucgggaagcuggagcuggacuucgaccucugcgagggcaccaccguggucguggacgagcacugcggcaaccgggggccgagccugcgcacgaccaccgugaccggcaagaucauccacgaguggugcugccgguccugcacgcugccgccccugcgcuucaagggggaggacggcugcugguacgggauggagauccggcccgucaaggagaaggaggagaaccuggucaagagcauggugagcgccggcuccggcgaggucgacagcuucucccuggggcuccugugcaucagcaucaugaucgaggaggugaugcgcucccgguggagccgcaagaugcugaugaccggcacccucgccguguucuuccugcugaucauggggcagcucaccuggaacgaccugauccggcugugcaucauggucggcgcgaacgccuccgaccgcauggggaugggcacgaccuaccucgcccugauggccaccuucaagaugcgcccgauguucgccgugggccuccuguuccggcgccugaccagccgggaggugcugcuccugacgaucgggcugucccucgucgcgagcguggagcugcccaacucccuggaggagcucggcgacgggcuggccaugggcaucaugauccugaagcuccugaccgacuuccagagccaccagcugugggccacccuccugucccugaccuucaucaagacgaccuucagccuccacuacgccuggaagaccauggcgaugguccuguccaucgugagccuguucccccucugccuguccaccacgagccagaagaccaccuggcugcccgugcuccugggcucccuggggugcaagccgcucaccauguuccugaucgccgagaacaagaucuggggccgcaagagcuggccccugaacgaggggaucauggccgucggcaucgugagcauccuccuguccagccugcucaagaacgacgugccccuggccgggccccugaucgccggcggcaugcucaucgcgugcuacgucaucuccgggagcuccgccgaccugagccuggagaaggccgccgagguguccugggaggaggaggccgagcacagcggcgcgucccacaacauccucguggagguccaggacgacgggacgaugaagaucaaggacgaggagcgggacgacacccugaccauccugcucaaggccacccugcuggccgugagcggcguguacccgcucuccauccccgccacccuguucgucugguacuucuggcagaagaagaagcagcgcagcggggugcugugggacacgcccagcccgcccgagguggagcgggccguccucgacgacggcaucuaccgcaucaugcagcggggccugcuggggcgcagccaggugggcgugggggucuuccaggagaacguguuccacaccauguggcacgugacccggggcgcgguccugauguaccaggggaagcgccucgagcccuccugggccagcgugaagaaggaccugaucuccuacggcggcggguggcggcugcagggcagcuggaacaccggggaggaggugcaggucaucgccguggagcccggcaagaaccccaagaacgugcagacggcccccgggaccuucaagaccuccgagggcgaggucggcgccaucgcgcucgacuucaagcccgggaccagcggcagccccaucgugaaccgcgaggggaagaucgugggccuguacggcaacggggucgugacgaccuccggcaccuacgugagcgccaucgcccaggccaaggcgucccaggaggggccccugccggagaucgaggacgaggucuuccggaagcgcaaccucaccaucauggaccugcaccccggcagcgggaagacgcggcgcuaccugcccgccaucgugcgggaggccaucaagcgcaagcuccggacccugauccuggccccgacccgcguggucgccuccgagauggcggaggcccucaagggcaugcccauccgcuaccagaccacggccgucaagagcgagcacaccggcaaggagaucguggaccugaugugccacgccaccuucaccaugcggcugcucucccccguccgcgugcccaacuacaacaugaucaucauggacgaggcccacuucacggacccgagcuccaucgcggcccggggguacaucagcacccgcgugggcaugggggaggccgccgccaucuucaugaccgcgacgccgcccggcuccgucgaggccuucccccagagcaacgccgugauccaggacgaggagcgggacaucccggagcgcuccuggaacagcggguacgaguggaucacggacuuccccggcaagaccgugugguucguccccuccaucaagagcggcaacgacaucgccaacugccugcggaagaacgggaagcgcgugauccagcugucccggaagaccuucgacaccgaguaccagaagacgaagaacaacgacugggacuacguggucaccaccgacaucagcgagaugggcgcgaacuuccgcgccgaccgggugaucgacccccgccggugccucaagccggugauccugaaggacgggcccgagcgcgucauccuggccggccccaugcccgugaccgucgccuccgccgcgcagcggcgcgggcggaucggccgcaaccacaacaaggagggcgaccaguacaucuacauggggcagccgcucaacaacgacgaggaccacgcccacuggacggaggccaagaugcugcuggacaacaucaacacccccgagggcaucauccccgcccucuucgagcccgagcgggagaaguccgccgcgaucgacggggaguaccgccugcgcggcgaggcccggaagaccuucguggagcugaugcgccgcggggaccucccgguguggcugagcuacaaggucgccuccgagggcuuccaguacagcgaccgccgguggugcuucgacggcgagcgcaacaaccaggugcuggaggagaacauggacguggagaucuggaccaaggagggggagcggaagaagcuccgcccccgguggcuggacgcccgcacguacuccgacccccuggcccuccgggaguucaaggaguucgcggccggccgccggagcgucuccggggaccugauccuggagaucggcaagcucccccagcaccugacccagcgcgcccagaacgcccuggacaaccucgugaugcugcacaacagcgagcagggcgggcgggcguaccgccacgccauggaggagcugccggacaccaucgagacccucaugcugcuggcccucaucgccgugcugacgggcggggucacccuguucuuccucuccggccgggggcugggcaagaccagcaucggccugcucugcgugauggccuccagcgugcugcuguggauggcguccgucgagccccacuggaucgccgccagcaucauccucgaguucuuccugauggugcugcucauccccgagcccgaccgccagcggaccccgcaggacaaccagcuggccuacguggucaucgggcuccucuucaugauccugaccguggccgcgaacgagaugggccugcucgagacgaccaagaaggaccuggggaucggccacguggccgucgagaaccaccaccacgccgccaugcuggacguggaccuccaccccgccuccgcguggacccuguacgccguggccaccacgaucaucacccccaugaugcgccacaccaucgagaacaccacggccaacaucagccugaccgccaucgcgaaccaggccgccauccucauggggcuggacaagggcuggccgaucuccaagauggacaucggcgucccccugcucgcccuggggugcuacagccaggugaacccccugacccucaccgcggccgugcugaugcuggucgcccacuacgccaucaucggccccgggcuccaggccaaggcgacgcgggaggcccagaagcgcaccgccgccggcaucaugaagaacccgaccguggacgggaucguggccaucgaccuggaccccgucguguacgacgcgaaguucgagaagcagcugggccagaucaugcuccugauccugugcaccucccagauccuccugaugcgcacgaccugggcccugugcgagagcaucacccucgccaccggcccccugacgacccugugggaggggucccccggcaaguucuggaacaccaccaucgccgugagcauggccaacaucuuccgggggagcuaccucgcgggcgccggccuggccuucucccugaugaagucccucgggggcgggcgccggggcacgggggcccagggcgagacccugggcgagaaguggaagcgccagcugaaccagcucuccaagagcgaguucaacaccuacaagcgguccgggaucauggaggucgaccgcagcgaggcgaaggagggccugaagcgcggggagaccacgaagcacgccgugucccgcggcaccgccaagcugcggugguucguggagcgcaaccucgucaagccggaggggaaggugaucgaccugggcugcggccgcggcggguggagcuacuacugcgccgggcugaagaaggugaccgaggucaagggguacaccaagggcgggcccggccacgaggagcccauccccauggccacguacggguggaaccuggugaagcuccacuccggcaaggacguguucuucaucccgcccgagaagugcgacacccugcugugcgacaucggggagagcucccccaaccccaccaucgaggagggccgcacccuccggguccugaagaugguggagccguggcugcgcgggaaccaguucugcaucaagauccucaaccccuacaugcccagcguggucgagacgcuggagcagaugcagcggaagcacggcggcaugcuggugcgcaacccccucucccggaacagcacccacgagauguacuggguguccugcgggaccggcaacaucgucagcgcggugaacaugaccucccgcaugcugcugaaccgguucaccauggcccaccgcaagccgacguacgagcgcgacguggaccucggggccggcacccggcacgucgccguggagcccgagguggccaaccuggacaucaucggccagcgcaucgagaacaucaagcacgagcacaagagcaccuggcacuacgacgaggacaaccccuacaagaccugggcguaccacggguccuacgaggucaagcccagcggcagcgccuccagcauggugaacggggucgugaagcugcucacgaagccgugggacgugauccccauggucacccagaucgccaugaccgacaccacgcccuucggccagcagcggguguucaaggagaagguggacacccgcacccccaaggccaagcgggggaccgcccagaucauggaggucacggcgaaguggcuguggggcuuccugucccgcaacaagaagccgcggaucugcacccgcgaggaguucacccggaaggugcgcagcaacgccgccaucggcgccguguucgucgacgagaaccaguggaacuccgcgaaggaggccguggaggacgagcgguucugggaccucgugcaccgcgagcgggagcugcacaagcaggggaagugcgcgaccugcgucuacaacaugaugggcaagcgcgagaagaagcugggggaguucggcaaggccaaggggagccgggccaucugguacauguggcucggcgcgcgcuuccuggaguucgaggcccugggcuucaugaacgaggaccacugguucucccgggagaacagccucuccgggguggagggcgaggggcugcacaagcugggcuacauccuccgcgacaucagcaagauccccgggggcaacauguacgccgacgacacggccggcugggacacccggaucaccgaggacgaccugcagaacgaggccaagaucaccgacaucauggagcccgagcacgcgcugcucgccaaguccaucuucaagcugacguaccagaacaaggugguccgcgugcagcggccggccaagaacgggaccgugauggacgucaucagccgccgcgaccagcggggcuccggccaggugggcaccuacggccugaacaccuucacgaacauggaggcccagcucauccgccagauggagagcgaggggaucuucucccccagcgagcuggagacccccaaccuggcccggcgcgugcucgacuggcuggagaagcacggcgucgagcggcugaagcgcauggcgaucuccggggacgacugcguggugaagcccaucgacgaccgguucgccaccgcccucaccgcccugaacgacaugggcaagguccgcaaggacaucccgcagugggagcccagcaagggguggaacgacuggcagcagguccccuucugcagccaccacuuccaccagcugaucaugaaggacggccgggagaucgugguccccugccgcaaccaggacgagcucgugggccgggcccgcgugucccagggggcgggcuggagccugcgggagacggccugccuggggaaguccuacgcccagauguggcagcucauguacuuccaccgccgggaccugcgccuggccgcgaacgccaucugcagcgccgucccgguggacugggugcccaccucccggaccaccuggagcauccacgcccaccaccaguggaugacgaccgaggacaugcucuccgucuggaaccgcguguggaucgaggagaaccccuggauggaggacaagacccacaucagcuccuggggcgacgugcccuaccuggggaagcgggaggaccaguggugcggcagccugaucggccucaccgcccgcgcgacgugggccaccaacauccaggucgccaucaaccaggugcgccggcugaucgggaacgagaacuaccuggacuacaugaccuccaugaagcgcuucaagaacgagagcgacccggagggcgcccucugguga

SEQ ID NO: 8358 - RNA, 9879 nt, Artificial Sequence
  derived and/or modified CDS sequence (opt1) from DENV-1__FJ432732__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgagaccgagcccgacgacguggacugcuggugcaacgccaccgacaccugggugaccuacgggaccugcagccagacgggcgagcaccggcgggacaagcgguccguggcccucgcgccccacgugggccuggggcuggagacccgcaccgagaccuggaugagcuccgagggcgcguggaagcagauccagcggguggagacgugggcccuccggcaccccggguucaccgugaucgcccuguuccuggcccacgugaucggcaccagcaucacccagaaggggaucaucuucauccuccugaugcuggucacgcccuccauggcgaugcggugcgugggcaucggcagccgcgacuucguggaggggcucuccggcgccaccugggucgacguggugcuggagcacgggagcugcgucaccaccauggccaaggacaagcccacgcuggacaucgagcuccugaagaccgaggugaccaaccccgccgugcugcggaagcucugcaucgaggccaagaucuccaacaccacgaccgacagccgcugcccgacccagggcgaggcgacccuggucgaggagcaggacgccaacuucgugugccggcgcacguucguggaccggggcugggggaacggcugcgggcuguucggcaaggggucccucaucacgugcgccaaguucaagugcgucaccaagcuggagggcaagaucgugcaguacgagaaccugaaguacagcgugaucgucaccgugcacacgggcgaccagcaccaggucgggaacgaguccaccgagcacggcaccaccgccaccaucacgccccaggcccccaccaccgagauccagcucaccgacuacggggcgcugacgcuggacugcagcccccgcaccggccucgacuucaacgagauggugcugcugaccaugaaggagaaguccuggcucgugcacaagcagugguuccuggaccugccccuccccuggaccagcggggccagcacgucccaggagaccuggaaccggcaggaccugcuggucaccuucaagaccgcccacgccaagaagcaggagguggugguccucggcagccaggagggcgccaugcacacggcgcugaccggggccaccgagauccagaccuccggcacgaccaccaucuucgccgggcaccugaagugccgccucaagauggacaagcugacccugaagggcaugagcuacgugaugugcacgggguccuucaagcucgagaaggagguggccgagacccagcacggcaccguccuggugcagaucaaguacgagggcaccgacgcccccugcaagauccccuucagcacgcaggacgagaagggggugacccagaacggccggcugaucaccgcgaacccgaucgucaccgacaaggagaagcccgugaacaucgaggccgagccgcccuucggggaguccuacaucacgaucggcgccggcgagaaggcccugaagcucagcugguucaagaagggguccagcaucggcaagauguucgaggcgaccgcccgcggggcccggcgcauggccauccugggcgacaccgccugggacuucggguccaucggcggcguguucaccagcgucgggaagcuggugcaccagaucuucggcacggcguacgggguccuguucuccggcgucagcuggaccaugaagaucgggaucggcgugcugcugaccuggcucggccugaacucccgcagcaccucccugagcaugacgugcaucgccguggggcucgucacccuguaccugggcgugauggugcaggccgacuccgggugcgucaucaacuggaagggccgggagcucaagugcgggagcggcaucuucgugaccaacgaggugcacaccuggaccgagcaguacaaguuccaggccgacagcccgaagcgccuguccgccgcgaucggcaaggccugggaggagggggucugcggcauccggagcgccacgcgccuggagaacaucauguggaagcagaucuccaacgagcucaaccacauccugcuggagaacgacaugaaguucaccgugguggucggggacguggccggcaucuucgcccaggggaagaagaugauccggccccagcccauggaguacaaguacagcuggaaguccuggggcaaggcgaagaucaucggcgccgacgugcagaacaccaccuucaucaucgacgggcccaacacgccggagugccccgacgaccagcgcgccuggaacaucugggaggucgaggacuacggcuucgggaucuucaccaccaacaucuggcucaagcugcgggacagcuacacccaggugugcgaccaccgccugauguccgccgcgaucaaggacagcaaggccgugcacgccgacaugggcuacuggaucgaguccgagaagaacgagacguggaagcucgcccgggccagcuucaucgaggucaagaccugcaucuggcccaagucccacacccuguggagcaacggcgugcuggaguccgagaugaucauccccaagaucuacgggggcccgaucagccagcacaacuaccgccccggguacuucacccagacggcgggccccuggcaccucgggaagcuggagcuggacuucgaccucugcgagggcaccaccguggucguggacgagcacugcggcaaccgggggccgucccugcgcaccacgaccgugaccggcaagaucauccacgaguggugcugccggagcugcacccugccgccccugcgcuuccgcggggaggacggcugcugguacgggauggagauccgccccgucaaggagaaggaggagaaccuggugaaguccauggugagcgccggcagcggcgaggucgacuccuucagccuggggcuccugugcaucuccaucaugaucgaggaggugaugcggagccgcuggucccggaagaugcugaugacgggcacccucgccguguucuuccugcugaucauggggcagcucaccuggaacgaccugauccgccugugcaucauggucggcgccaacgccagcgaccgcauggggaugggcaccacguaccucgcgcugauggccaccuucaagaugcggccgauguucgccgugggccuccucuuccgccggcugaccucccgcgaggugcugcuccugaccaucgggcugagccucgucgccuccguggagcugcccaacagccuggaggagcucggcgacgggcuggccaugggcaucaugauccugaagcuccugacggacuuccagucccaccagcugugggcgacccuccugagccugaccuucaucaagaccacguucucccuccacuacgccuggaagaccauggccaugguccugagcaucgugucccuguucccccucugccugagcaccaccucccagaagacgaccuggcugcccgugcuccugggcagccuggggugcaagccgcucaccauguuccugaucgccgagaacaagaucuggggccggcgcuccuggccccugaacgaggggaucauggcggucggcaucgugagcauccuccugagcucccugcucaagaacgacgugccccuggccgggccccugaucgccggcggcaugcucaucgccugcuacgucaucagcggguccagcgccgaccugucccuggagaaggcggccgaggugagcugggaggaggaggccgagcacuccggcgccagccacaacauccucguggagguccaggacgacgggaccaugaagaucaaggacgaggagcgggacgacacccugacgauccugcucaaggccacccugcuggcgguguccggcguguacccgcucagcauccccgccacccuguucgucugguacuucuggcagaagaagaagcagcgcuccggggugcugugggacacccccagcccgcccgagguggagcgggccguccucgacgacggcaucuaccgcaucaugcagcggggccugcuggggcgcucccaggugggcgugggggucuuccaggagaacguguuccacacgauguggcacgugacccggggcgccguccugauguaccaggggaagcgccucgagcccagcugggccuccgugaagaaggaccugaucagcuacggcggcggguggcggcugcagggcuccuggaacaccggggaggaggugcaggucaucgcgguggagcccggcaagaaccccaagaacgugcagaccgcccccgggacguucaagacccccgagggcgaggucggcgccaucgcccucgacuucaagcccgggaccagcggcucccccaucgugaaccgcgaggggaagaucgugggccuguacggcaacggggucgugaccacgagcggcaccuacgugagcgccaucgcgcaggccaaggccucccaggaggggccgcugcccgagaucgaggacgaggucuuccggaagcgcaaccucaccaucauggaccugcaccccggcagcgggaagacccggcgcuaccugccggccaucgugcgggaggcgaucaagcgcaagcuccgcacgcugauccuggcccccacccggguggucgccuccgagauggccgaggcccucaagggcaugcccauccgcuaccagaccaccgcggucaagagcgagcacacgggcaaggagaucguggaccugaugugccacgccaccuucaccaugcggcugcucucccccguccgcgugccgaacuacaacaugaucaucauggacgaggcccacuucaccgaccccagcuccaucgccgcccggggguacaucagcacgcgcgugggcaugggggaggcggccgccaucuucaugaccgccacgccgcccggcuccgucgaggccuucccgcagagcaacgcggugauccaggacgaggagcgggacauccccgagcgcuccuggaacagcggguacgaguggaucaccgacuuccccggcaagacggugugguucguccccuccaucaagagcggcaacgacaucgccaacugccugcggaagaacgggaagcgcgugauccagcugucccggaagaccuucgacaccgaguaccagaagaccaagaacaacgacugggacuacguggucacgaccgacaucagcgagaugggcgccaacuuccgcgccgaccgggugaucgacccgcgccggugccucaagcccgugauccugaaggacgggcccgagcgcgucauccuggcgggccccaugccggugaccgucgccuccgccgcccagcggcgcgggcggaucggccgcaaccacaacaaggagggcgaccaguacaucuacauggggcagccccucaacaacgacgaggaccacgcccacuggaccgaggcgaagaugcugcuggacaacaucaacacgcccgagggcaucauccccgcccucuucgagccggagcgcgagaaguccgccgccaucgacggggaguaccggcugcgcggcgaggcccggaagaccuucguggagcugaugcgccgcggggaccuccccguguggcuguccuacaaggucgcgagcgagggcuuccaguacagcgaccgccgguggugcuucgacggcgagcgcaacaaccaggugcuggaggagaacauggacguggagaucuggaccaaggagggggagcggaagaagcuccgcccccgguggcuggacgcccgcaccuacuccgacccccuggcccuccgggaguucaaggaguucgccgccggccgccggagcgucuccggggaccugauccuggagaucggcaagcucccgcagcaccugacgcagcgcgcgcagaacgcccuggacaaccucgugaugcugcacaacagcgagcagggcgggcgggccuaccgccacgccauggaggagcugcccgacaccaucgagacccucaugcugcuggcgcucaucgccgugcugaccggcggggucacccuguucuuccucuccggccgggggcugggcaagacgagcaucggccugcucugcgugauggccuccagcgugcugcuguggauggccuccgucgagccccacuggaucgccgcgagcaucauccucgaguucuuccugauggugcugcucauccccgagccggaccgccagcggacgccccaggacaaccagcuggccuacguggucaucgggcuccucuucaugauccugaccguggccgccaacgagaugggccugcucgagaccacgaagaaggaccuggggaucggccacguggccgucgagaaccaccaccacgcggccaugcuggacguggaccuccaccccgccuccgccuggacccuguacgccguggcgaccaccaucaucacgccgaugaugcgccacaccaucgagaacaccaccgccaacaucagccugacggccaucgccaaccaggccgcgauccucauggggcuggacaagggcuggcccaucuccaagauggacaucggcgucccccugcucgcccuggggugcuacagccaggugaacccccugacccucaccgccgccgugcugaugcuggucgcgcacuacgccaucaucggcccggggcuccaggccaaggccacccgcgaggcccagaagcggacggcggccggcaucaugaagaaccccaccguggacgggaucguggccaucgaccuggaccccgucguguacgacgccaaguucgagaagcagcugggccagaucaugcuccugauccugugcaccucccagauccuccugaugcgcaccacgugggcccugugcgagagcaucacccucgcgaccggcccccugaccacgcugugggagggguccccgggcaaguucuggaacaccaccaucgccgugagcauggccaacaucuuccggggguccuaccucgccggcgccggccuggcguucagccugaugaagucccucgggggcgggcgccggggcaccggggcccagggcgagacgcugggcgagaaguggaagcgccagcugaaccagcucuccaagagcgaguucaacaccuacaagcgguccgggaucauggaggucgaccgcagcgaggccaaggagggccugaagcgcggggagaccaccaagcacgccgugucccgcggcacggcgaagcugcggugguucguggagcgcaaccucgucaagcccgaggggaaggugaucgaccugggcugcggccgcggcggguggagcuacuacugcgccgggcugaagaaggugaccgaggucaagggguacaccaagggcggccccggccacgaggagcccaucccgauggccaccuacggguggaaccuggugaagcuccacuccggcaaggacguguucuucaucccgcccgagaagugcgacacgcugcugugcgacaucggggagagcucccccaacccgaccaucgaggagggccgcacccuccggguccugaagaugguggagcccuggcugcgcgggaaccaguucugcaucaagauccucaaccccuacaugcccagcguggucgagacccuggagcagaugcagcggaagcacggcggcaugcuggugcgcaacccgcucucccggaacagcacccacgagauguacuggguguccugcgggacgggcaacaucgucagcgccgugaacaugaccucccgcaugcugcugaaccgcuucaccauggcccaccggaagcccaccuacgagcgcgacguggaccucggggcgggcacgcggcacgucgccguggagcccgagguggccaaccuggacaucaucggccagcgcaucgagaacaucaagcacgagcacaagagcaccuggcacuacgacgaggacaaccccuacaagaccugggccuaccacggguccuacgaggucaagccgagcggcuccgccagcagcauggugaacggggucgugaagcugcucaccaagcccugggacgugauccccauggucacgcagaucgcgaugaccgacaccacccccuucggccagcagcggguguucaaggagaagguggacacgcgcaccccgaaggccaagcgggggaccgcccagaucauggaggucaccgccaaguggcuguggggcuuccugucccgcaacaagaagccccggaucugcacgcgcgaggaguucacccggaaggugcgcagcaacgccgcgaucggcgccguguucgucgacgagaaccaguggaacuccgccaaggaggccguggaggacgagcgguucugggaccucgugcaccgcgagcgggagcugcacaagcaggggaagugcgcgaccugcgucuacaacaugaugggcaagcgcgagaagaagcugggggaguucggcaaggccaaggggagccgggccaucugguacauguggcucggcgcccgcuuccuggaguucgaggcccugggcuucaugaacgaggaccacugguucucccgggagaacagccucuccgggguggagggcgaggggcugcacaagcugggcuacauccuccgcgacaucagcaagauccccgggggcaacauguacgcggacgacaccgccggcugggacacgcggaucaccgaggacgaccugcagaacgaggcccgcaucaccgacaucauggagccggagcacgcccugcucgccaaguccaucuucaagcugaccuaccagaacaaggugguccgcgugcagcggcccgcgaagaacgggacggugauggacgucaucagccgccgggaccagcgcggcuccggccagguggggaccuacggccugaacaccuucaccaacauggaggcccagcucauccggcagauggagagcgaggggaucuucucccccagcgagcuggagacgcccaaccuggccgagcgcgugcucgacuggcuggagaaguacggcgucgagcggcugaagcgcauggccaucuccggggacgacugcguggugaagccgaucgacgaccgguucgccaccgcgcucaccgcccugaacgacaugggcaagguccgcaaggacaucccccagugggagcccagcaagggguggaacgacuggcagcagguccccuucugcucccaccacuuccaccagcugaucaugaaggacggccgggagaucguggucccgugccgcaaccaggacgagcucgugggccgggcccgcgugagccagggggccggcuggagccugcgggagaccgccugccuggggaaguccuacgcgcagauguggcagcucauguacuuccaccgccgggaccugcgccuggccgccaacgccaucugcagcgcgguccccguggacuggauccccacgucccggaccaccuggagcauccacgcccaccaccaguggaugaccacggaggacaugcucuccguguggaaccgcgucuggaucgaggagaaccccuggauggaggacaagacccacaucagcuccuggggcgacgugccguaccuggggaagcgcgaggaccaguggugcggcagccugaucggccucaccgcccgggccaccugggccaccaacauccagguggcgaucaaccagguccgccggcugaucgggaacgagaacuaccuggacuacaugacguccaugaagcgcuucaagaacgagagcgaccccgagggcgcccucugguga

SEQ ID NO: 8359 - RNA, 9879 nt, Artificial Sequence
  derived and/or modified CDS sequence (opt1) from DENV-1__FJ432733__SS-prME
agcgugaccaugcugcucaugcugaugcccaccgcccuggccuuccaccucaccacccggggcggggagccccacaugaucgugaccaagcaggagcggggcaagagccugcuguucaagaccagcgccggggugaacaugugcacccucaucgccauggaccugggcgagcugugcgaggacaccaugaccuacaagugcccccggaucaccgagguggagcccgacgacguggacugcuggugcaacgccaccgacaccugggugaccuacgggaccugcagccagacgggcgagcaccggcgcgacaagcggagcguggcccucgcgccccacgucggccuggggcuggagacccgcaccgagaccuggauguccagcgagggcgccuggaagcagauccagcggguggagacgugggcccuccgccaccccggguucaccgugaucgcccuguuccuggcccacgucaucggcaccuccaucacccagaaggggaucaucuucauccuccugaugcuggugacgcccagcauggcgaugcggugcgugggcaucggcucccgcgacuucgucgaggggcucagcggcgccaccuggguggacgugguccuggagcacggguccugcgugaccaccauggccaaggacaagcccacgcuggacaucgagcuccugaagaccgaggugaccaaccccgccguccugcggaagcucugcaucgaggccaagaucagcaacaccacgaccgacucccgcugccccacccagggcgaggcgacccugauggaggagcaggacgccaacuucgugugccggcgcacguucguggaccggggcugggggaacggcugcgggcuguucggcaaggggagccucaucacgugcgccaaguucaagugcgucaccaagcuggagggcaagaucgugcaguacgagaaccugaaguacuccgugaucgucaccgugcacacgggcgaccagcaccaggucgggaacgagagcaccgagcacggcaccaucgccaccaucacgccccaggcccccacguccgagauccagcucaccgacuacggggcgcugacccuggacugcagcccccgcaccggccucgacuucaacgagauggugcugcugacgaugaaggagaaguccuggcucgugcacaagcagugguuccuggaccugccgcuccccuggaccagcggggccagcaccucccaggagaccuggaaccggcaggaccugcuggucacguucaagaccgcccacgccaagaagcaggagguggugguccucggcagccaggagggcgccaugcacaccgcgcugaccggggccacggagauccagaccuccggcaccaccacgaucuucgccgggcaccugaagugccgccucaagauggacaagcugacccugaagggcaugagcuacgugaugugcaccggguccuucaagcucgagaaggagguggccgagacccagcacggcacgguccuggugcagaucaaguacgagggcaccgacgcccccugcaagauccccuucagcacccaggacgagaagggggugacccagaacggccggcugaucacggcgaacccgaucgucaccgacaaggagaagcccgugaacaucgaggccgagccgcccuucggggaguccuacaucgugaucggcgccggcgagaaggcccugaagcucagcugguucaagaagggguccagcaucggcaagauguucgaggcgaccgcccgcggggcccggcgcauggccauccugggcgacaccgccugggacuucggguccaucggcggcgucuucacgagcguggggaagcuggugcaccagaucuucggcaccgcguacgggguccucuucuccggcgugagcuggaccaugaagaucgggaucggcgugcugcugaccuggcucggccugaacucccgcagcacgucccugagcaugaccugcaucgccgucgggcucgugacccuguaccugggcgugaugguccaggccgacuccgggugcgugaucaacuggaagggccgggagcucaagugcgggagcggcaucuucgugaccaacgagguccacacguggaccgagcaguacaaguuccaggccgacagcccgaagcgccuguccgccgcgaucggcaaggccugggaggagggggugugcggcauccggagcgccacccgccuggagaacaucauguggaagcagaucuccaacgagcucaaccacauccugcuggagaacgacaugaaguucaccguggucgugggggacguggucggcauccucgcccaggggaagaagaugauccggccccagcccauggagcacaaguacagcuggaaguccuggggcaaggccaagaucaucggcgcggacgugcagaacaccacguucaucaucgacgggcccaacaccccggagugccccgacgaccagcgcgccuggaacaucugggagguggaggacuacggcuucgggaucuucaccaccaacaucuggcugaagcugcgggacagccacacgcaggucugcgaccaccgccucauguccgccgccaucaaggacagcaaggcggugcacgccgacaugggcuacuggaucgaguccgagaagaacgagaccuggaagcuggcccgggccagcuucaucgaggugaagaccugcaucuggcccaagucccacacccuguggagcaacggcguccucgaguccgagaugaucauccccaagaucuacgggggcccgaucagccagcacaacuaccgccccggguacuucacgcagaccgccggccccuggcaccuggggaagcuggagcucgacuucgaccugugcgagggcaccaccgugguggucgacgagcacugcggcaaccgggggccgucccugcgcacgaccaccgugaccggcaagaucauccacgaguggugcugccggagcugcacgcugccgccccuccgcuucaagggggaggacggcugcugguacgggauggagauccggcccgugaaggagaaggaggagaaccuggucaaguccauggugagcgcgggcagcggcgagguggacuccuucagccucgggcugcugugcaucuccaucaugaucgaggaggucaugcgcagccgguggucccgcaagaugcucaugaccggcacccuggccguguuccugcuccugaucauggggcagcugaccuggaacgaccucauccggcugugcaucauggugggcgccaacgccagcgaccgcauggggaugggcacgaccuaccuggcccucauggcgaccuucaagaugcgcccgauguucgccgucgggcugcuguuccggcgccucaccucccgggaggugcugcugcucacgaucgggcugagccuggucgccuccguggagcuccccaacagccuggaggagcugggcgacgggcucgccaugggcaucaugauccugaagcugcucaccgacuuccagucccaccagcugugggccacccugcucagccugaccuucaucaagacgacccugucccuccacuacgcguggaagaccauggccauggugcugagcaucgucucccuguucccccucugccugagcaccacgucccagaagaccaccuggcugcccgugcuccugggcagccuggggugcaagccgcucgccaugcugcugaucgccgagaacaagaucuggggccgcaaguccuggccccucaacgaggggaucauggcggugggcgucgugagcauccugcugagcucccuccugaagaacgacgugccccuggccgggccccucaucgccggcggcaugcugaucgccugcuacgucaucagcggguccagcgccgaccugucccucgagaaggcggccgaggugagcugggaggaggaggccgagcacuccggcgccagccacaacauccugguggagguccaggacgacgggaccaugaagaucaaggacgaggagcgggacgacacgcugaccauccuccugaaggccacccugcucgcgguguccggcguguacccgcugagcauccccgccacccuguucgucugguacuucuggcagaagaagaagcagcgcuccggggugcugugggacacccccagcccgcccgagguggagcgggccguccucgacgacggcaucuaccgcaucaugcagcggggccugcuggggcgcucccaggugggcgugggggucuuccaggagaacguguuccacacgauguggcacgugacccggggcgccguccucauguaccaggggaagcgccuggagcccagcugggccuccgugaagaaggaccugaucagcuacggcggcggguggcggcuccagggcuccuggaacaccggggaggaggugcaggucaucgcgguggagcccggcaagaaccccaagaacgugcagaccgcccccgggacguucaagacccccgagggcgaggucggcgccaucgcccuggacuucaagcccgggaccagcggcucccccaucgugaaccgcgaggggaagaucgugggccuguacggcaacggggucgugaccacgagcggcaccuacgugagcgccaucgcgcaggccaaggccucccaggaggggccgcuccccgagaucgaggacgaggucuuccggaagcgcaaccugaccaucauggaccugcaccccggcagcgggaagacccggcgcuaccucccggccaucgugcgggaggcgaucaagcgcaagcugcggacgcugauccucgcccccacccgcguggucgccuccgagauggccgaggcccugaagggcaugcccauccgcuaccagaccaccgcggucaagagcgagcacacgggcaaggagaucguggaccugaugugccacgccaccuucaccaugcggcuccugucccccguccgcgugccgaacuacaacaugaucaucauggacgaggcccacuucaccgaccccagcuccaucgccgcccggggguacaucagcacgcgcgugggcaugggggaggcggccgccaucuucaugaccgccacgccgcccggcuccgucgaggccuucccgcagagcaacgcggugauccaggacgaggagcgggacauccccgagcgcuccuggaacagcggguacgaguggaucaccgacuuccccggcaagacggugugguucguccccuccaucaagagcggcaacgacaucgccaacugccugcggaagaacgggaagcgcgugauccagcucucccggaagaccuucgacaccgaguaccagaagaccaagaacaacgacugggacuacguggucacgaccgacaucagcgagaugggcgccaacuuccgcgccgaccgggugaucgacccgcgccggugccugaagcccgucauccugaaggacgggcccgagcgcgugauccucgcgggccccaugccggugaccgucgccuccgccgcccagcggcgcgggcggaucggccgcaaccacaacaaggagggcgaccaguacaucuacauggggcagccccugaacaacgacgaggaccacgcccacuggaccgaggcgaagaugcugcucgacaacaucaacacgcccgagggcaucauccccgcccuguucgagccggagcgggagaaguccgccgccaucgacggggaguaccgccugcgcggcgaggcccggaagaccuucguggagcucaugcgccgcggggaccugcccguguggcuguccuacaaggucgcgagcgagggcuuccaguacagcgaccgccgguggugcuucgacggcgagcgcaacaaccaggugcucgaggagaacauggacguggagaucuggaccaaggagggggagcggaagaagcugcgcccccgguggcuggacgcccgcaccuacuccgacccccucgcccugcgggaguucaaggaguucgccgccggccgccggagcgucuccggggaccugauccucgagaucggcaagcugccgcagcaccugacgcagcgcgcgcagaacgcccucgacaaccuggugaugcugcacaacagcgagcagggcgggcgggccuaccgccacgccauggaggagcuccccgacaccaucgagacccugaugcugcucgcgcugaucgccgugcugaccggcggggucacccuguucuuccuguccggccgggggcugggcaagaccagcaucggccuccugugcgugauggccuccagcgugcugcucuggauggccuccgucgagccccacuggaucgccgcgagcaucauccuggaguucuuccugauggugcuccugauccccgagccggaccgccagcggacgccccaggacaaccagcuggccuacguggucaucgggcuccuguucaugauccugaccguggccgccaacgagaugggccuccuggagaccacgaagaaggaccuggggaucggccacguggccgucgagaaccaccaccacgcgaccaugcucgacguggaccugcaccccgccuccgccuggacccuguacgccguggccaccacgaucaucaccccgaugaugcgccacaccaucgagaacaccacggcgaacaucagccucaccgccaucgccaaccaggccgccauccugauggggcuggacaagggcuggcccaucuccaagauggacaucggcgucccccuccuggcgcuggggugcuacagccaggugaacccccucacccugaccgccgccgugcugaugcucgucgcccacuacgcgaucaucggcccggggcugcaggccaaggccacgcgggaggcccagaagcgcaccgccgcgggcaucaugaagaaccccaccguggacgggaucguggccaucgaccuggaccccgucguguacgacgccaaguucgagaagcagcucggccagaucaugcugcugauccucugcaccucccagauccugcugaugcgcacgaccugggcccucugcgagagcaucacccuggccaccggcccccugacgacccucugggagggguccccgggcaaguucuggaacaccaccaucgcggugagcauggccaacaucuuccggggguccuaccuggccggcgccggccuggccuucagccucaugaagucccucgggggcgggcgccgggggacgggggcgcagggcgagacccugggcgagaaguggaagcgccagcucaaccagcuguccaagagcgaguucaacaucuacaagcgguccgggaucauggaggucgaccgcagcgaggccaaggagggccugaagcgcggggagaccacccgccacgccgugucccggggcacggccaagcugcgcugguucguggagcggaaccucgucaagcccgaggggaaggugaucgaccugggcugcggccgcgggggcuggagcuacuacugcgcggggcugaagaaggugaccgaggucaagggcuacaccaagggcgggcccggccacgaggagcccaucccgauggccaccuacggguggaaccucgugaagcugcacuccggcaaggacguguucuucacgccgcccgagaagugcgacacccugcucugcgacaucggggagagcucccccaacccgaccaucgaggagggccggacccugcgcguccugaagaugguggagcccuggcuccgggggaaccaguucugcaucaagauccugaaccccuacaugcccagcguggucgagacgcuggagcagaugcagcgcaagcacggcggcaugcucgugcggaacccgcugucccgcaacagcacccacgagauguacuggguguccugcgggaccggcaacaucgucagcgccgugaacaugaccucccggaugcugcucaaccgcuucaccauggcccaccgcaagcccacguacgagcgggacguggaccugggggccggcacccgccacgucgcgguggagcccgaggucgccaaccuggacaucaucggccagcggaucgagaacaucaagcacgagcacaagagcaccuggcacuacgacgaggacaaccccuacaagaccugggccuaccacggguccuacgaggugaagccgagcggcuccgccagcagcauggugaacggggucgugaagcuccugacgaagcccugggacgugauccccauggucacccagaucgccaugaccgacaccacgcccuucggccagcagcgcguguucaaggagaagguggacacccggaccccgaaggcgaagcgcgggaccgcccagaucauggaggucacggcccgguggcuguggggcuuccucucccgcaacaagaagccccggaucugcacccgcgaggaguucacccggaaggugcgcagcaacgccgccaucggcgcgguguucgucgacgagaaccaguggaacuccgccaaggaggccguggaggacgagcgguucugggaccuggugcagaaggagcgcgagcugcacaagcaggggaagugcgcgaccugcgucuacaacaugaugggcaagcgggagaagaagcucggggaguucggcaaggcgaaggggagccgcgccaucugguacauguggcugggcgcccgguuccuggaguucgaggcccucggcuucaugaacgaggaccacugguucucccgcgagaacagccuguccgggguggagggcgaggggcugcacaagcucggcuacauccugcgggacaucagcaagauccccgggggcaacauguacgccgacgacacggcgggcugggacacccgcaucaccgaggacgaccugcagaacgaggcccggaucaccgacaucauggagccggagcacgcccuccuggccacguccaucuucaagcugaccuaccagaacaaggugguccgcgugcagcgccccgccaagaacgggaccgugauggacgucaucagccggcgcgaccagcggggcuccggccaggugggcaccuacggccucaacacguucaccaacauggaggcgcagcugauccgccagauggagagcgaggggaucuuccugcccuccgagcucgagacccagaaccuggccgagcgggugcuggacuggcucgagaaguacggcgucgagcgccugaagcggauggccaucagcggggacgacugcguggugaagcccaucgacgaccgcuucgccaccgcccugacggcgcucaacgacaugggcaagguccggaaggacaucccgcagugggagcccuccaagggguggaacgacuggcagcagguccccuucugcagccaccacuuccaccagcugaucaugaaggacggccgcgagaucgugguccccugccggaaccaggacgagcuggugggccgcgcccgggugucccagggggccggcuggagccuccgcgagaccgccugccugggcaagagcuacgcccagauguggcagcugauguacuuccaccggcgcgaccuccggcuggcggccaacgccaucugcuccgccgucccgguggacugggugcccaccagccgcaccacgugguccauccacgcgcaccaccaguggaugaccaccgaggacaugcugagcgucuggaaccggguguggaucgaggagaaccccuggauggaggacaagacccacguguccagcuggggcgacguccccuaccucgggaagcgcgaggaccaguggugcggcucccugaucggccugacggcccgcgccaccugggccagcaacauccagguggccaucaaccaggugcggcgccucaucgggaacgagaacuaccuggacuacaugaccuccaugaagcgguucaagaacgagggcgacccggagggggcgcugugguga

SEQ ID NO: 8360 - RNA, 9879 nt, Artificial Sequence
  derived and/or modified CDS sequence (opt1) from DENV-1__FJ410196__SS-prME
agcgugaccaugcugcucaugcugaugcccaccgcccuggccuuccaccucaccacccggggcggggagccccacaugaucgugagcaagcaggagcggggcaagagccugcuguucaagaccuccgccggggugaacaugugcacccucaucgccauggaccugggcgagcugugcgaggacaccaugaccuacaagugcccccgcaucaccgagaccgagcccgacgacguggacugcuggugcaacgccacggacaccugggugaccuacgggaccugcagccagacgggcgagcaccggcgcgacaagcgguccguggcccucgcgccccacgugggccuggggcuggagacccgcaccgagaccuggaugagcuccgagggcgcguggaagcagauccagcggguggagacgugggcccuccgccaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagguggccgagacccagcacggcaccgugcugguccagaucaaguacgagggcaccgacgcgcccugcaagauccccuucagcacgcaggacgagaagggggugacccagaacggccggcugaucaccgccaacccgaucgugaccgacaaggagaagcccgucaacaucgaggccgagccgcccuucggggaguccuacaucgugaucggcgccggcgagaaggcgcugaagcucagcugguucaagaagggguccagcaucggcaagauguucgaggccacggcccgcggggcccggcgcauggccauccugggcgacaccgcgugggacuucggguccaucggcggcguguucaccagcgucgggaagcuggugcaccagaucuucggcaccgccuacgggguccucuucuccggcgucagcuggacgaugaagaucgggaucggcgugcugcugaccuggcucggccugaacucccgcagcaccucccugagcaugaccugcaucgccguggggcucgucacgcuguaccugggcgugauggugcaggccgacuccgggugcgucaucaacuggaagggccgggagcucaagugcgggagcggcaucuucgugaccaacgaggugcacaccuggaccgagcaguacaaguuccaggccgacagcccgaagcgccuguccgcggccaucggcaaggccugggaggagggggucugcggcauccggagcgccacccgccuggagaacaucauguggaagcagaucuccaacgagcucaaccacauccugcuggagaacgacaugaaguucacggugguggucggggacguggccggcauccucgcgcaggggaagaagaugauccggccccagcccauggaguacaaguacagcuggaaguccuggggcaaggccaagaucaucggcgccgacgugcagaacaccaccuucaucaucgacgggcccaacaccccggagugccccgacgaccagcgcgccuggaacaucugggaggucgaggacuacggcuucgggaucuucacgaccaacaucuggcugaagcugcgggacagcuacacccaggugugcgaccaccgccucauguccgcggccaucaaggacagcaaggccgugcacgccgacaugggcuacuggaucgaguccgagaagaacgagaccuggaagcuggcccgggcgagcuucaucgaggucaagacgugcaucuggcccaagucccacacccuguggagcaacggcgugcucgaguccgagaugaucauccccaagaucuacgggggcccgaucagccagcacaacuaccgccccggguacuucacccaggccgccggccccuggcaccuggggaagcuggagcucgacuucgaccugugcgagggcaccacgguggucguggacgagcacugcggcaaccgggggccgucccugcgcaccaccaccgugacgggcaagaucauccacgaguggugcugccggagcugcacccugccgccccuccgcuuccgcggggaggacggcugcugguacgggauggagauccgccccgucaaggagaaggaggagaaccuggugaaguccauggugagcgccggcagcggcgaggucgacuccuucagccucgggcugcugugcaucuccaucaugaucgaggaggugaugcggagccgcuggucccggcgcaugcucaugaccggcacccuggccguguucuuccugcucaucauggggcagcugacguggaacgaccugauccgccucugcaucauggucggcgcgaacgccagcgaccggauggggaugggcaccaccuaccuggcccugauggccaccuucaagaugcgcccgauguucgccgugggccuccuguuccggcgccugacgucccgggaggugcuccugcugaccaucgggcucagccuggucgcguccguggagcugcccaacagccucgaggagcugggcgacgggcuggccaugggcaucaugauccucaagcugcugaccgacuuccagucccaccagcucugggccacccugcugagccucacguucaucaagaccaccuucucccugcacuacgccuggaagaccauggcgaugguccugagcaucgugucccucuucccccugugccugagcacgaccucccagaagaccaccuggcuccccgugcugcugggcagccucgggugcaagccgcugacgauguuccugaucgccgagaacaagaucuggggccgccgguccuggccccucaacgaggggaucauggccgucggcaucgugagcauccugcugagcucccuccugaagaacgacgugccccuggccgggccccucaucgccggcggcaugcugaucgcgugcuacgucaucagcggguccagcgccgaccugucccucgagaaggccgccgaggugagcugggaggaggaggccgagcacuccggcgcgagccacaacauccugguggagguccaggacgacgggaccaugaagaucaaggacgaggagcgcgacgacacccugaccauccuccugaaggccacccugcucgccguguccggcguguacccgcugagcauccccgccacgcuguucgucugguacuucuggcagaagaagaagcagcgguccggggugcucugggacacccccagcccgcccgagguggagcgcgccguccuggacgacggcaucuaccggaucaugcagcgcggccugcuggggcggucccaggugggcgugggggucuuccaggagaacguguuccacaccauguggcacgugacccgcggcgcgguccucauguaccaggggaagcggcuggagcccagcugggccuccgugaagaaggaccugaucagcuacggcggcggguggcgccuccagggcuccuggaacacgggggaggaggugcaggucaucgccguggagcccggcaagaaccccaagaacgugcagaccgcccccgggaccuucaagacccccgagggcgaggucggcgccaucgcgcuggacuucaagcccgggacgagcggcucccccaucgugaaccgggaggggaagaucgugggccuguacggcaacggggucgugaccaccagcggcaccuacgugagcgccaucgcccaggccaaggcgucccaggaggggccgcuccccgagaucgaggacgaggucuuccgcaagcggaaccugacgaucauggaccugcaccccggcagcgggaagacccgccgguaccucccggccaucgugcgcgaggccaucaagcgcaagcugcggacccugauccucgcccccacccgcguggucgccuccgagauggcggaggcccugaagggcaugcccauccgguaccagacgaccgccgucaagagcgagcacaccggcaaggagaucguggaccugaugugccacgccaccuucacgaugcgccuccugucccccguccgggugccgaacuacaacaugaucaucauggacgaggcccacuucaccgaccccuucagcaucgcggcccgcggguacaucuccacccgggugggcaugggggaggccgccgccaucuucaugaccgcgacgccgcccggcagcgucgaggccuucccgcaguccaacgccgugauccaggacgaggagcgcgacauccccgagcggagcuggaacuccggguacgaguggaucaccgacuuccccggcaagaccgugugguucguccccagcaucaaguccggcaacgacaucgccaacugccugcgcaagaacgggaagcgggugauccagcucagccgcaagaccuucgacacggaguaccagaagaccaagaacaacgacugggacuacguggucaccaccgacaucuccgagaugggcgcgaacuuccgggccgaccgcgugaucgacccgcggcgcugccugaagcccgugauccugaaggacgggcccgagcgggucauccucgccggccccaugccggugacggucgccagcgccgcgcagcgccgggggcgcaucggccgcaaccacaacaaggagggcgaccaguacaucuacauggggcagccccugaacaacgacgaggaccacgcccacuggaccgaggccaagaugcugcucgacaacaucaacacccccgagggcaucauccccgcccuguucgagccggagcgggagaaguccgccgcgaucgacggggaguaccgccugcggggcgaggcccgcaagaccuucguggagcucaugcggcgcggggaccugcccguguggcugagcuacaaggucgccuccgagggcuuccaguacagcgaccggcgcuggugcuucgacggcgagcggaacaaccaggugcucgaggagaacauggacguggagaucuggacgaaggagggggagcgcaagaagcugcggccccgcuggcuggacgcccggaccuacagcgacccccucgcccugcgcgaguucaaggaguucgcggccggccggcgcuccgucagcuccgaccugauccucgagaucgggaagcugccgcagcaccugacccagcgggcccagaacgcccucgacaaccuggugaugcugcacaacagcgagcagggcggccgcgcguaccggcacgccauggaggagcuccccgacaccaucgagacgcugaugcugcucgcccugaucgccgugcugaccgggggcgucacccucuucuuccuguccgggcgcggccuggggaagaccagcaucggccuccugugcgugauggccuccagcgugcugcucuggauggcguccgucgagccccacuggaucgccgccagcaucauccuggaguucuuccugauggugcuccugauccccgagccggaccggcagcgcacgccccaggacaaccagcuggccuacguggucaucggccuccuguucaugauccugacgguggccgcgaacgagauggggcuccuggagaccaccaagaaggaccugggcaucgggcacguggccgucgagaaccaccaccacgccgccaugcucgacguggaccugcaccccgccuccgcguggacccuguacgccguggccacgaccaucaucaccccgaugaugcgccacaccaucgagaacacgaccgccaacaucagccucaccgccaucgcgaaccaggccgccauccugaugggccuggacaagggguggcccaucuccaagauggacaucggcgucccccuccuggcccugggcugcuacagccaggugaacccccucacccugacggcggccgugcugaugcucgucgcccacuacgccaucaucgggccgggccugcaggccaaggcgacccgggaggcccagaagcgcaccgccgccgggaucaugaagaaccccaccguggacggcaucguggccaucgaccuggaccccgucguguacgacgcgaaguucgagaagcagcucgggcagaucaugcugcugauccucugcacgucccagauccugcugaugcggaccaccugggcccucugcgagagcaucacccuggccacgggcccccugaccacccucugggagggcuccccggggaaguucuggaacaccacgaucgccgugagcauggccaacaucuuccgcggcuccuaccuggcgggggccggccuggccuucagccucaugaagucccugggcgggggccggcgcgggaccggcgcccagggggagacccugggcgagaaguggaagcggcagcucaaccagcuguccaagagcgaguucaacaccuacaagcgcuccggcaucauggaggucgaccggagcgaggcgaaggaggggcugaagcgcggcgagacgaccaagcacgccgugucccgggggaccgccaagcuccgcugguucguggagcggaaccuggucaagcccgagggcaaggugaucgaccuggggugcggccgcggcggguggagcuacuacugcgccggccugaagaaggugaccgaggucaagggguacacgaagggcgggcccggccacgaggagcccaucccgauggccaccuacggcuggaaccucgugaagcugcacuccgggaaggacguguucuucaucccgcccgagaagugcgacacccugcucugcgacaucggcgagagcucccccaacccgaccaucgaggaggggcggacgcugcgcguccugaagaugguggagcccuggcuccggggcaaccaguucugcaucaagauccugaaccccuacaugcccagcguggucgagacccuggagcagaugcagcgcaagcacgggggcaugcucgugcggaacccgcugucccgcaacagcacccacgagauguacuggguguccugcggcaccgggaacaucgucagcgcggugaacaugaccucccgcaugcugcucaaccgguucacgauggcccaccgcaagcccaccuacgagcgggacguggaccugggcgccgggacccgccacgucgccguggagcccgagguggccaaccuggacaucaucggccagcggaucgagaacaucaagcacgagcacaagagcaccuggcacuacgacgaggacaaccccuacaagacgugggcguaccacggcuccuacgaggucaagccgagcggguccgccagcagcauggugaacggcgucgugaagcuccugaccaagcccugggacgugauccccauggucacccagaucgccaugaccgacacgacccccuucgggcagcagcgcguguucaaggagaagguggacacccggaccccgaaggccaagcgcggcacggcccagaucauggaggucaccgcgaaguggcuguggggguuccucucccggaacaagaagccccgcaucugcacccgggaggaguucacccgcaaggugcggagcaacgccgccaucggcgccguguucgucgacgagaaccaguggaacuccgcgaaggaggccguggaggacgagcgcuucugggaccuggugcaccgggagcgcgagcugcacaagcagggcaagugcgccacgugcgucuacaacaugauggggaagcgggagaagaagcucggcgaguucgggaaggccaagggcagccgcgccaucugguacauguggcugggggcgcgguuccuggaguucgaggcccucggcuucaugaacgaggaccacugguucucccgcgagaacagccuguccggcguggagggggagggccugcacaagcucggguacauccugcggggcaucagcaagauccccgggggcaacauguacgccgacgacaccgccggcugggacacccgcaucaccgaggacgaccugcagaacgaggcccgcaucacggacaucauggagccggagcacgcgcuccuggccaaguccaucuucaagcugaccuaccagaacaaggugguccgggugcagcgccccgccaagaacgggaccgugauggacgucaucagccggcgcgaccagcggggcuccggccagguggggaccuacggccucaacacguucaccaacauggaggcccagcugauccgccagauggagagcgaggggaucuucucccccagcgagcuggagacccccaaccucgccgagcgggugcuggacuggcuggagaaguacggcgucgagcgccucaagcggauggcgaucuccggggacgacugcguggugaagccgaucgacgaccgcuucgccaccgcccugacggcccugaacgacaugggcaagguccggaaggacaucccccagugggagcccagcaagggguggaacgacuggcagcagguccccuucugcucccaccacuuccaccagcucaucaugaaggacggccgcgagaucguggucccgugccggaaccaggacgagcuggugggccgcgcccgggugagccagggggcgggcuggagccugcgcgagaccgccugccucgggaaguccuacgcccagauguggcagcugauguacuuccaccggcgcgaccugcggcucgccgcgaacgccaucugcagcgccguccccguggacuggauccccaccucccgcaccacguggagcauccacgcccaccaccaguggaugaccaccgaggacaugcuguccguguggaaccgcgucuggaucgaggagaaccccuggauggaggacaagacccacaucagcuccuggggcgacgugccguaccuggggaagcgggaggaccaguggugcggcagccucaucggccugacggcccgcgcgaccugggccaccaacauccagguggccaucaaccagguccggcgccugaucgggaacgagaacuaccucgacuacaugaccuccaugaagcgguucaagaacgagagcgaccccgagggcgcccugugguga

SEQ ID NO: 8361 - RNA, 9879 nt, Artificial Sequence
  derived and/or modified CDS sequence (opt1) from DENV-1__FJ432734__SS-prME
agcgugaccaugcugcucaugcugaugcccaccgcccuggccuuccaccucaccacccgcggcggggagccccacaugaucgugagcaagcaggagcggggcaagagccugcuguucaagaccagcgcgggggugaacaugugcacccucaucgccauggaccugggcgagcugugcgaggacacgaugaccuacaagugcccccgcaucaccgaggccgagcccgacgacguggacugcuggugcaacgccaccgacacgugggugaccuacgggaccugcagccagaccggcgagcaccggcgcgacaagcgguccguggcccucgcgccccacgugggccuggggcuggagacgcgcaccgagaccuggaugagcuccgagggcgccuggaagcagauccagcgggucgagaccugggugcuccgccaccccggguucacggugaucgcccuguuccuggcccacgcgaucggcaccagcaucacccagaaggggaucaucuucauccuccugaugcuggucacccccuccauggccaugcggugcgugggcaucggcagccgcgacuucguggaggggcucuccggcgccacgugggucgacguggugcuggagcacgggagcugcgucaccaccauggccaaggacaagcccacccuggacaucgagcuccugaagacggaggugaccaaccccgccgugcugcggaagcucugcaucgaggcgaagaucuccaacaccaccacggacagccgcugcccgacccagggcgaggccacccuggucgaggagcaggacgccaacuucgugugccggcgcaccuucguggaccggggcugggggaacggcugcgggcuguucggcaaggggucccucaucacgugcgccaaguucaagugcgucaccaagcuggagggcaagaucgugcaguacgagaaccugaaguacagcgugaucgucaccgugcacaccggcgaccagcaccaggucgggaacgaguccacggagcacggcaccaccgccaccaucacgccccaggcgcccacgaccgagauccagcucaccgacuacggggcccugacccuggacugcagcccccgcacgggccucgacuucaacgagauggugcugcugaccaugaaggagaaguccuggcucgugcacaagcagugguuccuggaccugccccuccccuggaccagcggggccagcaccucccaggagacguggaaccggcaggaccugcuggucaccuucaagaccgcccacgccaagaagcaggagguggugguccucggcagccaggagggcgcgaugcacaccgcccugacgggggccaccgagauccagaccuccggcaccacgaccaucuucgccgggcaccugaagugccgccucaagauggacaagcugacccugaagggcaugagcuacgugaugugcaccggguccuucaagcucgagaaggagguggccgagacgcagcacggcaccguccuggugcagaucaaguacgagggcaccgacgcgcccugcaagauccccuucagcacccaggacgagaagggggugacgcagaacggccggcugaucaccgccaacccgaucgucaccgacaaggagaagcccgugaacaucgaggccgagccgcccuucggggaguccuacaucgugaucggcgccggcgagaaggcgcugaagcucagcugguucaagaagggguccagcaucggcaagauguucgaggccaccgcccgcggggcccggcgcauggccauccugggcgacacggcgugggacuucggguccaucggcggcgucuucaccagcguggggaagcuggugcaccagaucuucggcaccgccuacgggguccucuucuccggcgugagcuggaccaugaagaucgggaucggcgugcugcugacguggcucggccugaacucccgcagcaccucccugagcaugaccugcaucgccgucgggcucgugacccuguaccugggcgugaugguccaggccgacuccgggugcgugaucaacuggaagggccgggagcucaagugcgggagcggcaucuucgugacgaacgagguccacaccuggaccgagcaguacaaguuccaggccgacagcccgaagcgccuguccgcggccaucggcaaggccugggaggagggggugugcggcauccggagcgccacccgccuggagaacaucauguggaagcagaucuccaacgagcucaaccacauccugcuggagaacgacaugaagcucaccguggucgugggggacguggccggcauccuggggcagggcaagaagaugauccggccccagcccauggaguacaaguacagcuggaaguccuggggcaaggcgaagaucaucggggccgacgcccagaacacgaccuucaucaucgacggccccaacaccccggagugccccgacgaccagcgcgccuggaacaucugggaggucgaggacuacggguucggcauguucaccacgaacaucuggcugaagcuccgggacagcuacacccaggugugcgaccaccgccugauguccgcggccaucaaggacagcaaggccgugcacgccgacaugggcuacuggaucgaguccgagaagaacgagaccuggaagcuggcccgggcgagcuucaucgaggucaagaccugcaucuggcccaagucccacacgcucuggagcaacggggugcuggaguccgagaugaucauccccaagaucuacggcgggccgaucagccagcacaacuaccgccccggcuacuucacccagaccgccgggcccuggcaccugggcaagcucgagcuggacuucgaccugugcgagggcaccacgguggucguggacgagcacugcgggaaccggggcccgucccuccgcaccaccaccgugacggggaagaucauccacgaguggugcugccggagcugcacccugccgccccugcgcuuccggggcgaggacgggugcugguacggcauggagauccgccccgucaaggagaaggaggagaaccucgugaaguccauggugagcgccggcagcggggaggucgacuccuucagccugggccugcucugcaucuccaucaugaucgaggaggugaugcggagccgcuggucccggaagaugcugaugaccgggacccuggccguguucuuccuccugaucaugggccagcugacguggaacgaccucauccgccugugcaucauggucggggccaacgcgagcgaccgcaugggcaugggcaccaccuaccuggcccucauggccaccuucaagaugcggccgauguucgccguggggcugcuguuccgccggcucacgucccgcgaggugcugcugcucaccaucggccugagccuggucgccuccguggagcuccccaacagccuggaggagcugggggacggccucgcgaugggcaucaugauccugaagcugcucaccgacuuccagucccaccagcugugggccacccugcucagccugacguucaucaagaccaccuucucccugcacuacgccuggaagaccauggccaugguccucagcaucgugucccuguucccccugugccucagcacgaccucccagaagaccaccuggcugcccgugcugcucgggagccugggcugcaagccgcugacgauguuccucaucgcggagaacaagaucugggggcggaaguccuggccccugaacgagggcaucauggccgucgggaucgugagcauccugcucagcucccugcugaagaacgacgugccccucgccggcccccugaucgccggcgggaugcugaucgccugcuacgucaucagcggcuccagcgcggaccucucccuggagaaggccgccgaggugagcugggaggaggaggccgagcacuccggggccagccacaacauccugguggagguccaggacgacggcaccaugaagaucaaggacgaggagcgcgacgacacccucaccauccugcugaaggcgacccuccuggccguguccgggguguacccgcugagcauccccgccacccucuucgucugguacuucuggcagaagaagaagcagcgguccggcgugcugugggacacccccagcccgcccgagguggagcgcgccguccuggacgacggcaucuaccggaucaugcagcgcgggcugcucggccggucccaggugggggugggcgucuuccaggagaacguguuccacaccauguggcacgugacccgcggggccguccugauguaccagggcaagcggcuggagcccagcugggcguccgugaagaaggaccucaucagcuacggcgggggcuggcgccugcggggguccuggaacacgggcgaggaggugcaggucaucgccguggagcccgggaagaaccccaagaacgugcagaccgcccccggcaccuucaagacccccgagggcgaggucggggccaucgcccuggacuucaagcccggcacgagcgggucccccaucgugaaccgcgagggcaagaucgugggccucuacgggaacggcgucgugaccaccagcgggaccuacgugagcgcgaucgcccaggccaaggccucccaggagggcccgcugcccgagaucgaggacgaggucuuccggaagcgcaaccugacgaucauggaccuccaccccgggagcggcaagacccggcgcuaccugccggcgaucgugcgggaggccaucaagcgcaagcugcgcacccucauccuggcccccacccggguggucgccuccgagauggccgaggcgcugaagggcaugcccauccgcuaccagacgaccgccgucaagagcgagcacaccgggaaggagaucguggaccucaugugccacgccaccuucacgaugcggcugcugucccccguccgcgugccgaacuacaacaugaucaucauggacgaggcccacuucaccgaccccagcuccaucgccgcgcggggcuacaucagcacccgcguggggaugggcgaggccgccgccaucuucaugaccgccacgccgcccggguccgucgaggcguucccgcagagcaacgccgugauccaggacgaggagcgggacauccccgagcgcuccuggaacagcggcuacgaguggaucaccgacuuccccggcaagaccgugugguucguccccuccaucaagagcgggaacgacaucgccaacugccuccggaagaacggcaagcgcgugauccagcugucccggaagaccuucgacacggaguaccagaagaccaagaacaacgacugggacuacguggucaccaccgacaucagcgagaugggggccaacuuccgcgcggaccgggugaucgacccgcgccggugccugaagcccgugauccucaaggacggccccgagcgcgucauccuggccgggcccaugccggugacggucgccuccgccgcccagcggcgcggccggaucggccgcaaccacaacaaggagggggaccaguacaucuacaugggccagccccugaacaacgacgaggaccacgcgcacuggaccgaggccaagaugcuccuggacaacaucaacacccccgaggggaucauccccgcccuguucgagccggagcgcgagaaguccgccgccguggacggcgaguaccggcuccgcggggaggcgcggaagaccuucguggagcugaugcgccggggcgaccugcccgucuggcucuccuacaagguggccagcgagggcuuccaguacagcgaccgccgguggugcuucgacggggagcgcaacaaccaggugcuggaggagaacauggacgucgagaucuggacgaaggagggcgagcggaagaagcugcgcccccgguggcucgacgcccgcaccuacuccgacccccuggcccugcgggaguucaaggaguucgccgcggggcgccggagcguguccggcgaccucauccuggagaucggcaagcugccgcagcaccucacccagcgcgcccagaacgcccuggacaaccuggugaugcuccacaacagcgagcagggcgggcgggccuaccgccacgcgauggaggagcugcccgacaccaucgagacgcugaugcuccuggcccugaucgccguccucaccgggggcgugacccuguucuuccuguccgggcggggccucggcaagaccagcaucgggcugcugugcgugauggccuccagcguccuccuguggauggccuccguggagccccacuggaucgcggccagcaucauccuggaguucuuccucauggugcugcugauccccgagccggaccgccagcggacgccccaggacaaccagcucgccuacgucgugaucggccugcuguucaugauccucacgguggccgccaacgagauggggcugcuggagaccaccaagaaggaccucggcaucgggcacgucgcgguggagaaccaccaccacgccgccaugcuggacguggaccugcaccccgccuccgccuggacccucuacgcggucgccacgaccaucaucaccccgaugaugcgccacaccaucgagaacacgaccgccaacaucagccugaccgccaucgccaaccaggcggccauccugaugggccucgacaagggcuggcccaucuccaagauggacaucggggugccccugcuggcccucggcugcuacagccaggugaacccccugacccugacggccgcgguccucaugcugguggcccacuacgccaucaucgggccgggccugcaggccaaggccacccgcgaggcgcagaagcggaccgccgccgggaucaugaagaaccccaccguggacggcaucgucgccaucgaccucgaccccgugguguacgacgccaaguucgagaagcagcugggccagaucaugcugcucauccugugcacgucccagauccugcucaugcgcaccaccugggcgcugugcgagagcaucacccuggccacggggccccucaccacccugugggagggcuccccggggaaguucuggaacaccacgaucgccgucagcauggccaacaucuuccggggcuccuaccuggccggcgcggggcucgccuucagccugaugaagucccugggcgggggccgccgggggaccggcgcccagggcgagacccucggggagaaguggaagcgccagcugaaccagcuguccaagagcgaguucaacaccuacaagcgguccggcaucauggagguggaccgcagcgaggccaaggaggggcucaagcggggcgagacgaccaagcacgcggugucccgcgggaccgccaagcugcggugguucgucgagcgcaaccuggugaagcccgagggcaaggugaucgaccugggcugcgggcggggcggguggagcuacuacugcgccggccucaagaaggucaccgaggugaagggguacacgaagggcggccccgggcacgaggagcccaucccgauggccaccuacggcuggaaccuggugaagcugcacuccgggaaggacgucuucuucaucccgcccgagaagugcgacacccuccugugcgacaucggcgagagcucccccaacccgaccaucgaggaggggcgcacgcugcgggugcucaagaugguggagcccuggcugcgcggcaaccaguucugcaucaagauccugaaccccuacaugcccagcgucguggagacccucgagcagaugcagcggaagcacggcgggaugcuggugcgcaacccgcugucccggaacagcacccacgagauguacugggucuccugcggcaccgggaacaucgugagcgccgugaacaugaccucccgcaugcuccugaaccgcuucacgauggcgcaccggaagcccaccuacgagcgcgacgucgaccugggcaccggcacccggcacguggccguggagcccgaggucgccaaccucgacaucaucgggcagcgcaucgagaacaucaagcacgagcacaagagcacguggcacuacgacgaggacaaccccuacaagaccugggccuaccacggcuccuacgaggugaagccgagcggguccgccagcagcauggucaacggcguggugaagcugcugaccaagcccugggacgucauccccauggugacccagaucgcgaugacggacaccacccccuucgggcagcagcggguguucaaggagaaggucgacacccgcacgccgaaggccaagcggggcaccgcccagaucauggaggugaccgcccgcuggcucuggggcuuccugucccggaacaagaagccccgcaucugcacccgggaggaguucacgcgcaaggugcggagcaacgccgcgaucggggccgucuucguggacgagaaccaguggaacuccgccaaggaggccguggaggacgagcgcuucugggaccugguccaccgggagcgcgagcuccacaagcagggcaagugcgcgaccugcguguacaacaugauggggaagcgggagaagaagcugggcgaguucgggaaggccaagggcagccgcgccaucugguacauguggcugggcgcccgguuccucgaguucgaggcccugggguucaugaacgaggaccacugguucucccgcgagaacagccuguccggcguggagggggagggccuccacaagcugggguacauccugcgggacaucagcaagauccccggcggcaacauguacgcggacgacaccgccgggugggacacccgcaucacggaggacgaccuccagaacgaggccaagaucaccgacaucauggagccggagcacgcccugcuggccaaggcgaucuucaagcucaccuaccagaacaaggucgugcgcgugcagcggcccgccaagaacggcaccgucauggacgugaucucccgccgggaccagcgcgggagcggccaggugggcacguacgggcugaacaccuucaccaacauggaggcccagcugauccggcagauggaguccgagggcaucuucagccccuccgagcucgagacccccaaccuggccgagcgcgcccuggacuggcucgagaaguacggggucgagcggcugaagcgcauggcgaucagcggcgacgacugcguggugaagccgaucgacgaccgguucgccacggcccugaccgcccucaacgacauggggaagguccgcaaggacaucccccagugggagcccuccaagggcuggaacgacuggcagcagguccccuucugcagccaccacuuccaccagcugaucaugaaggacggccgggagaucguggucccgugccgcaaccaggacgagcugguggggcgggcccgcgugucccagggcgcgggguggagccuccgggagaccgccugccugggcaagagcuacgcccagauguggcagcugauguacuuccaccgccgggaccuccgccuggccgcgaacgccaucugcuccgccguccccguggacugggugcccaccagccggacgaccugguccauccacgcccaccaccaguggaugaccaccgaggacaugcugagcgucuggaaccgcguguggaucgaggagaaccccuggauggaggacaagacgcacaucuccagcugggaggacgugccguaccucgggaagcgcgaggaccaguggugcggcucccugaucggccugaccgcccgggcgaccugggccaccaacauccaggucgccaucaaccaggugcgccggcucaucgggaacgagaacuaccuggacuacaugaccagcaugaagcgcuucaagaacgagacggaccccgagggcgcccugugguga

SEQ ID NO: 8362 - RNA, 9879 nt, Artificial Sequence
  derived and/or modified CDS sequence (opt1) from DENV-1__FJ432735__SS-prME
agcgugaccaugcugcucaugcugaugcccaccgcccuggccuuccaccucacgacccgcggcggggagccccacaugaucgugagcaagcaggagcggggcaagagccugcuguucaagaccagcgcgggggugaacaugugcacccucaucgccauggaccugggggaguucugcgaggacacgaugaccuacaagugcccccgcaucaccgaggccgagcccgacgacguggacugcuggugcaacgccaccgacacgugggugaccuacgggaccugcagccagaccggggagcaccggcgcgacaagcgguccguggcccuggcgccccacgugggccucgggcuggagacgcgcaccgagaccuggaugagcuccgagggcgccuggaagcagauccagcggguggagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugcccgacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaagaccguccaguacgagaaccugaaguacagcgugaucgugaccguccacacgggcgaccagcaccagguggggaacgaguccaccgagcacggcaccaccgcgaccaucacgccccaggcccccagcaccgagauccagcugaccgacuacggggcccucacccuggacugcagcccccggacgggccuggacuucaacgagaugguccuccugaccaugaaggagaaguccuggcuggugcacaagcagugguuccucgaccugccgcugcccuggaccagcggggccuccaccagccaggagacguggaaccggaaggaccuccuggugaccuucaagaccgcccacgcgaagaagcaggaggucguggugcugggcucccaggagggcgccaugcacaccgcccucacgggggccaccgagauccagaccagcggcaccacgaccaucuucgccgggcaccugaagugccgccugaagauggacaagcucacccugaagggcauguccuacgucaugugcaccgggagcuucaagcuggagaaggagguggcggagacgcagcacggcaccgugcucguccagaucaaguacgagggcaccgacgcccccugcaagauccccuucuccacccaggacgagaagggggugacgcagaacggccggcugaucaccgccaacccgaucgugaccgacaaggagaagcccgucaacaucgaggccgagccgcccuucggggagagcuacaucgugaucggcgcgggcgagaaggcccugaagcuguccugguucaagaaggggagcuccaucggcaagauguucgaggccaccgcccgcggggcccggcgcauggcgauccucggcgacacggccugggacuucgggagcaucggcggcguguucaccuccgucgggaagcuggugcaccagaucuucggcaccgccuacggggugcuguucagcggcgucuccuggaccaugaagaucgggaucggcgugcuccugacguggcugggccucaacagccgcuccaccagccuguccaugaccugcaucgccguggggcuggucacccucuaccugggcgugauggugcaggccgacagcgggugcgucaucaacuggaagggccgggagcugaagugcgggagcggcaucuucgugacgaacgaggugcacaccuggaccgagcaguacaaguuccaggcggacuccccgaagcgccucagcgccgccaucggcaaggccugggaggagggggucugcggcauccgguccgccacccgccuggagaacaucauguggaagcagaucagcaacgagcugaaccacauccuccuggagaacgacaugaaguucaccgugguggucggggacguggcgggcauccuggcccaggggaagaagaugauccggccccagcccauggaguacaaguacuccuggaaguccuggggcaaggccaagaucaucggcgccgacgugcagaacacgaccuucaucaucgacgggcccaacaccccggagugccccgacgaccagcgcgcguggaacaucugggaggucgaggacuacggcuucgggaucuucaccacgaacaucuggcucaagcugcgggacuccuacacccaggugugcgaccaccgccugaugagcgccgccaucaaggacuccaaggccgugcacgccgacaugggcuacuggaucgagagcgagaagaacgagaccuggaagcucgcgcgggccuccuucaucgaggucaagaccugcaucuggcccaagagccacacgcugugguccaacggcgugcuggagagcgagaugaucauccccaagaucuacgggggcccgaucucccagcacaacuaccgccccggguacuucacccagaccgccggccccuggcaccucgggaagcuggagcuggacuucgaccucugcgagggcaccacgguggucguggacgagcacugcggcaaccgggggccgagccugcgcaccaccaccgugacgggcaagaucauccacgaguggugcugccgguccugcacccugccgccccugcgcuucaagggggaggacggcugcugguacgggauggagauccggcccgucaaggagaaggaggagaaccuggucaagagcauggugagcgccggcuccggcgaggucgacagcuucucccuggggcuccugugcaucagcaucaugaucgaggaggugaugcgcucccgguggagccgcaagaugcugaugaccggcacccucgccguguucuuccugcugaucauggggcagcucacguggaacgaccugauccggcugugcaucauggucggcgcgaacgccuccgaccgcauggggaugggcaccaccuaccucgcccugauggccaccuucaagaugcgcccgauguucgccgugggccuccuguuccggcgccugacgagccgggaggugcugcuccugaccaucgggcugucccucgucgcgagcguggagcugcccaacucccuggaggagcucggcgacgggcuggccaugggcaucaugauccugaagcuccugaccgacuuccagagccaccagcugugggccacccuccugucccugacguucaucaagaccaccuucagccuccacuacgccuggaagaccauggcgaugguccuguccaucgugagccuguucccccucugccuguccacgaccagccagaagaccaccuggcugcccgugcuccugggcucccuggggugcaagccgcucacgauguuccugaucgccgagaacaagaucuggggccgcaagagcuggccccugaacgaggggaucauggccgucggcaucgugagcauccuccuguccagccugcucaagaacgacgugccccuggccgggccccugaucgccggcggcaugcucaucgcgugcuacgucaucuccgggagcuccgccgaccugagccuggagaaggccgccgagguguccugggaggaggaggccgagcacagcggcgcgucccacaacauccucguggagguccaggacgacgggaccaugaagaucaaggacgaggagcgggacgacacccugaccauccugcucaaggccacccugcuggccgugagcggcguguacccgcucuccauccccgccacgcuguucgucugguacuucuggcagaagaagaagcagcgcagcggggugcugugggacacccccagcccgcccgagguggagcgggccguccucgacgacggcaucuaccgcaucaugcagcggggccugcuggggcgcagccaggugggcgugggggucuuccaggagaacguguuccacaccauguggcacgugacccggggcgcgguccugauguaccaggggaagcgccucgagcccuccugggccagcgugaagaaggaccugaucuccuacggcggcggguggcggcugcagggcagcuggaacacgggggaggaggugcaggucaucgccguggagcccggcaagaaccccaagaacgugcagaccgcccccgggaccuucaagaccuccgagggcgaggucggcgccaucgcgcucgacuucaagcccgggacgagcggcagccccaucgugaaccgcgaggggaagaucgugggccuguacggcaacggggucgugaccaccuccggcaccuacgugagcgccaucgcccaggccaaggcgucccaggaggggccccugccggagaucgaggacgaggucuuccggaagcgcaaccucacgaucauggaccugcaccccggcagcgggaagacccggcgcuaccugcccgccaucgugcgggaggccaucaagcgcaagcuccggacccugauccuggccccgacccgcguggucgccuccgagauggcggaggcccucaagggcaugcccauccgcuaccagacgaccgccgucaagagcgagcacaccggcaaggagaucguggaccugaugugccacgccaccuucacgaugcggcugcucucccccguccgcgugcccaacuacaacaugaucaucauggacgaggcccacuucaccgacccgagcuccaucgcggcccggggguacaucagcacccgcgugggcaugggggaggccgccgccaucuucaugaccgcgacgccgcccggcuccgucgaggccuucccccagagcaacgccgugauccaggacgaggagcgggacaucccggagcgcuccuggaacagcggguacgaguggaucaccgacuuccccggcaagaccgugugguucguccccuccaucaagagcggcaacgacaucgccaacugccugcggaagaacgggaagcgcgugauccagcugucccggaagaccuucgacacggaguaccagaagaccaagaacaacgacugggacuacguggucaccaccgacaucagcgagaugggcgcgaacuuccgcgccgaccgggugaucgacccccgccggugccucaagccggugauccugaaggacgggcccgagcgcgucauccuggccggccccaugcccgugacggucgccuccgccgcgcagcggcgcgggcggaucggccgcaaccacaacaaggagggcgaccaguacaucuacauggggcagccgcucaacaacgacgaggaccacgcccacuggaccgaggccaagaugcugcuggacaacaucaacacccccgagggcaucauccccgcccucuucgagcccgagcgggagaaguccgccgcgaucgacggggaguaccgccugcgcggcgaggcccggaagaccuucguggagcugaugcgccgcggggaccucccgguguggcugagcuacaaggucgccuccgagggcuuccaguacagcgaccgccgguggugcuucgacggcgagcgcaacaaccaggugcuggaggagaacauggacguggagaucuggacgaaggagggggagcggaagaagcuccgcccccgguggcuggacgcccgcaccuacuccgacccccuggcccuccgggaguucaaggaguucgcggccggccgccggagcgucuccggggaccugauccuggagaucggcaagcucccccagcaccugacccagaaggcccagaacgcccuggacaaccucgugaugcugcacaacagcgagcagggcgggcgcgcguaccggcacgccauggaggagcugccggacaccaucgagacgcucaugcugcuggcccucaucgccgugcugaccggcggggucacccuguucuuccucuccggccgcgggcugggcaagaccagcaucggccugcucugcgugauggccuccagcgugcugcuguggauggcguccgucgagccccacuggaucgccgccagcaucauccucgaguucuuccugauggugcugcucauccccgagcccgaccggcagcgcaccccgcaggacaaccagcuggccuacguggucaucgggcuccucuucaugauccugacgguggccgcgaacgagaugggccugcucgagaccaccaagaaggaccuggggaucggccacguggccgucgagaaccaccaccacgccgccaugcuggacguggaccuccaccccgccuccgcguggacccuguacgccguggccacgaccaucaucacccccaugaugcggcacaccaucgagaacacgaccgccaacaucagccugaccgccaucgcgaaccaggccgccauccucauggggcuggacaagggcuggccgaucuccaagauggacaucggcgucccccugcucgcccuggggugcuacagccaggugaacccccugacccucacggcggccgugcugaugcuggucgcccacuacgccaucaucggccccgggcuccaggccaaggcgacccgcgaggcccagaagcggaccgccgccggcaucaugaagaacccgaccguggacgggaucguggccaucgaccuggaccccgucguguacgacgcgaaguucgagaagcagcugggccagaucaugcuccugauccugugcacgucccagauccuccugaugcgcaccaccugggcccugugcgagagcaucacccucgccacgggcccccugaccacccugugggaggggucccccggcaaguucuggaacaccacgaucgccgugagcauggccaacaucuuccgcgggagcuaccucgcgggcgccggccuggccuucucccugaugaagucccucgggggcgggcggcgcggcaccggggcccagggcgagacccugggcgagaaguggaagcggcagcugaaccagcucuccaagagcgaguucaacaccuacaagcgcuccgggaucauggaggucgaccggagcgaggcgaaggagggccugaagcgcggggagacgaccaagcacgccgugucccggggcaccgccaagcugcgcugguucguggagcggaaccucgucaagccggaggggaaggugaucgaccugggcugcggccgcgggggcuggagcuacuacugcgccgggcugaagaaggugaccgaggucaagggcuacacgaagggcgggcccggccacgaggagcccauccccauggccaccuacggguggaaccuggugaagcuccacuccggcaaggacguguucuucaucccgcccgagaagugcgacacccugcugugcgacaucggggagagcucccccaaccccaccaucgaggagggccggacgcuccgcguccugaagaugguggagccguggcugcgggggaaccaguucugcaucaagauccucaaccccuacaugcccagcguggucgagacccuggagcagaugcagcgcaagcacggcggcaugcuggugcggaacccccucucccgcaacagcacccacgagauguacuggguguccugcgggaccggcaacaucgucagcgcggugaacaugaccucccggaugcugcugaaccgcuucacgauggcccaccggaagccgaccuacgagcgcgacguggaccucggggccggcacccgccacgucgccguggagcccgagguggccaaccuggacaucaucggccagcggaucgagaacaucaagcacgagcacaagagcaccuggcacuacgacgaggacaaccccuacaagacgugggcguaccacggguccuacgaggucaagcccagcggcagcgccuccagcauggugaacggggucgugaagcugcucaccaagccgugggacgugauccccauggucacccagaucgccaugaccgacacgacccccuucggccagcagcgcguguucaaggagaagguggacacccggacccccaaggccaagcgcgggacggcccagaucauggaggucaccgcgaaguggcuguggggcuuccugucccggaacaagaagccgcgcaucugcacccgggaggaguucacccgcaaggugcggagcaacgccgccaucggcgccguguucgucgacgagaaccaguggaacuccgcgaaggaggccguggaggacgagcgcuucugggaccucgugcaccgggagcgcgagcugcacaagcaggggaagugcgccacgugcgucuacaacaugaugggcaagcgggagaagaagcugggggaguucggcaaggccaaggggagccgcgccaucugguacauguggcucggcgcgcgguuccuggaguucgaggcccugggcuucaugaacgaggaccacugguucucccgcgagaacagccucuccgggguggagggcgaggggcugcacaagcugggcuacauccuccgggacaucagcaagauccccgggggcaacauguacgccgacgacaccgccggcugggacacccgcaucaccgaggacgaccugcagaacgaggccaagaucacggacaucauggagcccgagcacgcgcugcucgccaaguccaucuucaagcugaccuaccagaacaaggugguccgggugcagcgcccggccaagaacgggaccgugauggacgucaucagccggcgcgaccagcgcggcuccggccaggugggcaccuacggccugaacacguucaccaacauggaggcccagcucauccggcagauggagagcgaggggaucuucucccccagcgagcuggagacccccaaccuggccggccgcgugcucgacuggcuggagaagcacggggucgagcggcugaagcgcauggcgaucuccggcgacgacugcguggugaagcccaucgacgaccgguucgccaccgcccucacggcccugaacgacauggggaagguccgcaaggacaucccgcagugggagcccagcaagggcuggaacgacuggcagcagguccccuucugcagccaccacuuccaccagcugaucaugaaggacggccgggagaucgugguccccugccgcaaccaggacgagcucguggggcgggcccgcgugucccagggcgcgggguggagccugcgggagaccgccugccugggcaaguccuacgcccagauguggcagcucauguacuuccaccgccgggaccugcgccuggccgcgaacgccaucugcagcgccgucccgguggacugggugcccaccucccggaccacguggagcauccacgcccaccaccaguggaugaccaccgaggacaugcucuccgucuggaaccgcguguggaucgaggagaaccccuggauggaggacaagacccacaucagcuccuggggcgacgugcccuaccugggcaagcgggaggaccaguggugcggcagccugaucgggcucacggcccgcgcgaccugggccaccaacauccaggucgccaucaaccaggugcggcgccugaucggcaacgagaacuaccuggacuacaugaccuccaugaagcgcuucaagaacgagagcgacccggagggggcccucugguga

SEQ ID NO: 8363 - RNA, 9879 nt, Artificial Sequence
  derived and/or modified CDS sequence (opt1) from DENV-1__FJ432736__SS-prME
agcgugaccaugcugcucaugcugaugcccaccgcccuggccuuccaccucaccacccgcggcggggagccgcacaugaucgugagcaagcaggagcggggcaagagccugcuguucaagaccuccgcgggggugaacaugugcacccucaucgccauggaccugggcgagcugugcgaggacaccaugaccuacaagugcccccgcaucaccgaggccgagcccgacgacguggacugcuggugcaacgccaccgacacgugggugaccuacgggaccugcagccagaccggcgagcaccggcgcgacaagcgguccguggcccucgcgccccacgugggccuggggcuggagacgcgcaccgagaccuggaugagcuccgagggcgccuggaagcagauccagcggguggagaccugggcccuccgccaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcggugcugcggaagcucugcaucgaggccaagaucuccaacaccaccacggacagccgcugccccacccagggcgaggccacccugguggaggagcaggacgccaacuucgucugccggcgcaccuucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacaccggcgaccagcaccagguggggaacgaguccacggagcacggcaccaccgcgaccaucacgccccaggcccccacgaccgagauccagcucaccgacuacggggcccugacccuggacugcagcccccgcacgggccucgacuucaacgagaugguccugcugaccaugaaggagaaguccuggcucgugcacaagcagugguuccuggaccugccgcuccccuggaccagcggggccagcaccucccaggagacguggaaccggcaggaccugcuggugaccuucaagaccgcccacgcgaagaagcaggaggucguggugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgucaugugcaccggguccuucaagcucgagaaggagguggcggagacgcagcacggcaccgugcugguccagaucaaguacgagggcaccgacgcccccugcaagauccccuucagcacccaggacgagaagggggugacgcagaacggccggcugaucaccgccaacccgaucgugaccgacaaggagaagcccgucaacaucgaggccgagccgcccuucggggaguccuacaucgugaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcgucgggaagcugauccaccagaucuucggcaccgccuacgggguccuguucuccggcgugagcuggaccaugaagaucgggaucggcguccugcugacguggcucggccugaacucccgcagcaccucccugagcaugaccugcaucgccguggggcucgugacccuguaccugggcgucauggugcaggccgacuccgggugcgugaucaacuggaagggccgggagcucaagugcgggagcggcaucuucgucacgaacgaggugcacaccuggaccgagcaguacaaguuccaggcggacagcccgaagcgccuguccgccgccaucggcaaggccugggaggagggggugugcggcauccggagcgccacccgccuggagaacaucauguggaagcagaucuccaacgagcucaaccacauccugcuggagaacgacaugaagcucaccgucguggugggggacgucgcgggcauccuggggcagggcaagaagaugauccggccccagcccauggaguacaaguacagcuggaaguccuggggcaaggccaagaucaucggggccgacgcccagaacacgaccuucaucaucgacggccccaacaccccggagugccccgacgaccagcgcgcguggaacaucugggagguggaggacuacggguucggcaucuucaccacgaacaucuggcugaagcuccgggacagcuacacccaggugugcgaccaccgccugauguccgccgccaucaaggacagcaaggccguccacgccgacaugggcuacuggaucgaguccgagaagaacgagaccuggaagcuggcgcgggccagcuucaucgaggugaagaccugcaucuggcccaagucccacacgcucuggagcaacggggugcuggaguccgagaugaucauccccaagaucuacggcgggccgaucagccagcacaacuaccgccccggcuaccugacccagaccgccgggcccuggcaccucggcaagcuggagcuggacuucgaccucugcgagggcaccacggucgugguggacgagcacugcgggaaccggggcccgucccugcgcaccaccaccgucacggggaagaucauccacgaguggugcugccggagcugcacccugccgccccugcgcuuccggggcgaggacgggugcugguacggcauggagauccgccccgugaaggagaaggaggagaaccuggugaaguccauggucagcgccggcccgggggagguggacagcuucucccugggccuccugugcaucagcaucaugaucgaggaggugaugcggucccgcuggagccggaagaugcugaugaccgggacccucgccgucuucuuccugcugaucaugggccagcucacguggaacgaccugauccgccugugcaucauggugggggcgaacgccuucgaccgcaugggcaugggcaccaccuaccucgcccugauggccaccuucaagaugcggcccauguucgccguggggcuccucuuccgccggcugacgucccgcgagguccugcuccugaccaucggccugagccucguggcguccguggagcugcccaacagccuggaggagcucggggacggccuggccaugggcaucaugauccugaagcuccugaccgacuuccagucccaccagcugugggccacccuccugagccugacguucaucaagaccaccuucucccuccacuacgccuggaagaccauggcgaugguccugagcaucgugucccuguucccccucugccugagcacgaccucccagaagaccaccuggcugccgguccuccuggggagccugggcugcaagccccucacgauguuccugaucgccgagaacaagaucugggggcggaaguccuggccccugaacgagggcaucauggccguggggaucgugagcauccuccuguccagccugcucaagaacgacgucccccuggccggcccgcugaucgccggcgggaugcucaucgcgugcuacgugaucagcggcuccagcgccgaccugucccuggagaaggccgccgaggugagcugggaggaggaggccgagcacuccggggcgagccacaacauccucgucgaggugcaggacgacggcaccaugaagaucaaggacgaggagcgcgacgacacccugaccauccugcucaaggccacccugcuggccguguccggggucuacccccucagcauccccgccacgcuguucgugugguacuucuggcagaagaagaagcagcgguccggcgugcugugggacacccccagcccgcccgaggucgagcgcgccgugcuggacgacggcaucuaccggaucaugcagcgcgggcuccugggccggucccaggugggggucggcguguuccaggagaacguguuccacaccauguggcacgucacccgcggggcggugcugauguaccagggcaagcggcucgagcccagcugggccuccgugaagaaggaccugaucagcuacggcgggggcuggcgccugcggggguccuggaacacgggcgaggagguccaggugaucgccguggagcccgggaagaacccgaagaacguccagaccgcccccggcaccuucaagacccccgagggcgaggugggggccaucgcgcucgacuucaagcccggcacgagcggguccccgaucgugaaccgcgagggcaagaucgucggccuguacgggaacggcguggugaccaccagcgggaucuacgucuccgccaucgcccaggccaaggcgagccaggagggcccccugcccgagaucgaggacgagguguuccggaagcgcaaccucaccaucauggaccugcacccggggagcggcaagacgcggcgcuaccugcccgccaucgugcgggaggccaucaagcgcaagcuccgcacccugauccuggcccccacccgggucguggccuccgagauggcggaggcccucaagggcaugcccauccgcuaccagaccacggccgucaagagcgagcacaccgggaaggagaucgucgaccugaugugccacgccaccuucaccaugcggcugcucuccccggugcgcgugcccaacuacaacaugaucaucauggacgaggcccacuucacggaccccagcuccaucgcggcccggggcuacaucagcacccgcgucgggaugggcgaggccgccgccaucuucaugaccgcgacgccgcccggguccguggaggccuucccccagagcaacgccgugauccaggacgaggagcgggacauccccgagcgcuccuggaacagcggccacgaguggaucacggacuuccccggcaagaccgucugguucgugcccuccaucaagagcgggaacgacaucgccaacugccugcggaagaacggcaagcgcgugauccagcugucccggaagaccuucgacaccgaguaccagaagacgaagaacaacgacugggacuacgucgugaccaccgacaucagcgagaugggggcgaacuuccgcgccgaccgggugaucgacccccgccggugccucaagcccgucauccugaaggacggccccgagcgcgugauccuggccgggccgaugcccgugaccgucgccuccgccgcgcagcggcgcggccggaucggccgcaaccacaacaaggagggggaccaguacaucuacaugggccagccccucaacaacgacgaggaccacgcccacuggacggaggccaagaugcugcuggacaacaucaacacccccgaggggaucaucccggcccucuucgagcccgagcgcgagaaguccgccgcgguggacggcgaguaccggcugcgcggggaggcccggaagaccuucgucgagcugaugcgccggggcgaccuccccguguggcuguccuacaagguggccagcgagggcuuccaguacuccgaccgccgguggugcuucgacggggagcgcaacaaccagguccuggaggagaacauggacguggagaucuggaccaaggagggcgagcggaagaagcuccgcccccgguggcuggacgcccgcacguacagcgacccgcuggcccuccgggaguucaaggaguucgcggccgggcgccggagcguguccggcgaccugauccuggagaucggcaagcucccccagcaccugacccagcgcgcccagaacgcccuggacaaccucgucaugcugcacaacagcgagcagggcgggcgggcguaccgccacgccauggaggagcugcccgacaccaucgagacccucaugcugcuggcccucaucgccgugcugaccgggggcgugacccuguucuuccucuccgggcggggccugggcaagaccagcaucgggcugcucugcgucauggccuccagcgugcugcuguggauggcguccguggagccccacuggaucgccgccagcaucauccucgaguucuuccugaugguccugcucaucccggagcccgaccgccagcggacgccccaggacaaccagcuggccuacguggugaucggccuccucuucaugauccugaccgucgccgcgaacgagauggggcugcucgagacgaccaagaaggaccugggcaucgggcacguggccguggagaaccaccaccacgccgccaugcuggacgucgaccuccacccggccuccgcguggacccuguacgccguggccaccacgaucaucacccccaugaugcgccacaccaucgagaacaccacggccaacaucagccugaccgccaucgcgaaccaggccgccauccucaugggccuggacaagggcuggcccaucuccaagauggacaucggggugccccugcucgcccugggcugcuacagccaggucaacccgcugacccucaccgcggccgugcugaugcugguggcccacuacgccaucaucgggcccggccuccaggccaaggcgacgcgcgaggcccagaagcggaccgccgccgggaucaugaagaaccccaccgucgacggcaucguggccaucgaccuggaccccguggucuacgacgcgaaguucgagaagcagcugggccagaucaugcuccugauccugugcaccucccagauccuccugaugcgcacgaccugggcccugugcgagagcaucacccucgccaccgggccgcugacgacccugugggagggcucccccgggaaguucuggaacaccaccaucgccgugagcauggccaacaucuuccggggcuccuaccucgcgggcgccgggcuggccuucagccugaugaagucccucggcgggggccgccgggggacgggcgcccagggcgagacccugggggagaaguggaagcgccagcugaaccagcucagcaagagcgaguucaacaccuacaagcgguccggcaucauggagguggaccgcagcgaggcgaaggaggggcugaagcggggcgagaccacgaagcacgccgucucccgcgggaccgccaagcugcggugguucguggagcgcaaccuggugaagcccgagggcaaggucaucgaccucggcugcgggcggggcggguggagcuacuacugcgccggccugaagaaggugaccgaggugaagggguacaccaagggcggccccgggcacgaggagccgauccccauggccacguacggcuggaaccuggucaagcuccacuccgggaaggacguguucuucaucccgcccgagaagugcgacacccugcugugcgacaucggcgagagcuccccgaaccccaccaucgaggaggggcgcacccuccgggugcugaagauggucgagcccuggcugcgcggcaaccaguucugcaucaagauccucaaccccuacaugccgagcgugguggagacgcuggagcagaugcagcggaagcacggcgggaugcugguccgcaacccccucucccggaacagcacccacgagauguacuggguguccugcggcaccgggaacaucgugagcgcggucaacaugaccucccgcaugcugcugaaccgcuucaccauggcccaccggaagcccacguacgagcgcgacguggaccucggcaccggcacccggcacguggccgucgagcccgagguggccaaccuggacaucaucgggcagcgcaucgagaacaucaagcacgagcacaagagcaccuggcacuacgacgaggacaacccguacaagacgugggccuaccacggcuccuacgaggugaagcccagcggguccgcgagcuccauggucaacggcguggucaagcugcucaccaagcccugggacgugauccccauggugacccagaucgccaugaccgacacgaccccguucgggcagcagcgggucuucaaggagaagguggacacccgcacccccaaggccaagcggggcacggcccagaucauggaggugaccgcccgcuggcuguggggcuuccugagccggaacaagaagccccgcaucugcacccgggaggaguucacccgcaagguccggagcaacgcggccaucggggccguguucguggacgagaaccaguggaacuccgccaaggaggcggucgaggacgagcgcuucugggaccucgugcaccgggagcgcgagcugcacaagcagggcaagugcgccacgugcguguacaacaugauggggaagcgggagaagaagcugggcgaguucgggaaggccaagggcagccgcgccaucugguacauguggcucggcgcccgguuccuggaguucgaggcgcugggguucaugaacgaggaccacugguucucccgcgagaacagccucuccggcgucgagggggagggccugcacaagcugggguacauccuccgggacaucagcaagaucccgggcggcaacauguacgccgacgacaccgccgggugggacacccgcaucaccgaggacgaccugcagaacgaggccaagaucacggacaucauggagcccgagcacgcccugcucgcgaaggccaucuucaagcugaccuaccagaacaagguggugcgcguccagcggcccgccaagaacggcaccgugauggacgugaucucccgccgggaccagcgcgggagcggccaggucggcaccuacgggcugaacacguucaccaacauggaggcccagcucauccggcagauggaguccgagggcaucuucagccccuccgagcuggagaccccgaaccuggccgagcgcgcgcucgacuggcuggagaaguacgggguggagcggcugaagcgcauggccaucagcggcgacgacugcguggucaagcccaucgacgaccgguucgccaccgcccucacggcccugaacgacauggggaaggugcgcaaggacaucccccagugggagcccuccaagggcuggaacgacuggcagcaggucccguucugcagccaccacuuccaccagcugaucaugaaggacggccgggagaucgucgugcccugccgcaaccaggacgagcucguggggcgggcgcgcgucucccagggcgccggguggagccugcgggagaccgccugccugggcaaguccuacgcccagauguggcagcucauguacuuccaccgccgggaccugcgccuggcggccaacgccaucugcagcgccgugcccguggacuggguccccaccagccggaccacgugguccauccacgcccaccaccaguggaugaccaccgaggacaugcucagcguguggaaccgcguguggaucgaggagaacccguggauggaggacaagacccacaucuccagcugggaggacguccccuaccuggggaagcgcgaggaccaguggugcggcucccugaucggccucacggcgcgggccaccugggccaccaacauccagguggccaucaaccaggugcgccggcugaucgggaacgagaacuaccuggacuacaugaccagcaugaagcgcuucaagaacgaguccgaccccgagggcgcccucugguga

SEQ ID NO: 8364 - RNA, 9879 nt, Artificial Sequence
  derived and/or modified CDS sequence (opt1) from DENV-1__FJ410198__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgagaccgagcccgacgacguggacugcuggugcaacgccacggacaccugggugaccuacgggaccugcagccagacgggcgagcaccggcgcgacaagcgguccguggcccucgcgccccacgugggccuggggcuggagacccgcaccgagaccuggaugagcuccgagggcgcguggaagcagauccagcggguggagacgugggcccuccgccaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagguggccgagacccagcacggcaccgugcugguccagaucaaguacgagggcaccgacgcgcccugcaagauccccuucagcacgcaggacgagaagggggugacccagaacggccggcugaucaccgccaacccgaucgugaccgacaaggagaagcccgucaacaucgaggccgagccgcccuucggggaguccuacaucgugaucggcgccggcgagaaggcgcugaagcucagcugguucaagaagggguccagcaucggcaagauguucgaggccacggcccgcggggcccggcgcauggccauccugggcgacaccgcgugggacuucggguccaucggcggcguguucaccagcgucgggaagcuggugcaccagaucuucggcaccgccuacgggguccucuucuccggcgucagcuggacgaugaagaucgggaucggcgugcugcugaccuggcucggccugaacucccgcagcaccucccugagcaugaccugcaucgccguggggcucgucacgcuguaccugggcgugauggugcaggccgacuccgggugcgucaucaacuggaagggccgggagcucaagugcgggagcggcaucuucgugaccaacgaggugcacaccuggaccgagcaguacaaguuccaggccgacagcccgaagcgccuguccgcggccaucggcaaggccugggaggagggggucugcggcauccggagcgccacccgccuggagaacaucauguggaagcagaucuccaacgagcucaaccacauccugcuggagaacgacaugaaguucacggugguggucggggacguggccggcauccucgcgcaggggaagaagaugauccggccccagcccauggaguacaaguacagcuggaaguccuggggcaaggccaagaucaucggcgccgacgugcagaacaccaccuucaucaucgacgggcccaacaccccggagugccccgacgaccagcgcgccuggaacaucugggaggucgaggacuacggcuucgggaucuucacgaccaacaucuggcugaagcugcgggacagcuacacccaggugugcgaccaccgccucauguccgcggccaucaaggacagcaaggccgugcacgccgacaugggcuacuggaucgaguccgagaagaacgagaccuggaagcuggcccgggcgagcuucaucgaggucaagacgugcaucuggcccaagucccacacccuguggagcaacggcgugcucgaguccgagaugaucauccccaagaucuacgggggcccgaucagccagcacaacuaccgccccggguacuucacccagaccgccggccccuggcaccuggggaagcuggagcucgacuucgaccugugcgagggcacgaccguggucguggacgagcacugcggcaaccgggggccgucccugcgcaccaccacggugaccggcaagaucauccacgaguggugcugccggagcugcacccugccgccccuccgcuuccgcggggaggacggcugcugguacgggauggagauccgccccgucaaggagaaggaggagaaccuggugaaguccauggugagcgccggcagcggcgaggucgacuccuucagccucgggcugcugugcaucuccaucaugaucgaggaggugaugcggagccgcuggucccggaagaugcucaugaccggcacgcuggccguguucuuccugcucaucauggggcagcugaccuggaacgaccugauccgccucugcaucauggucggcgccaacgcgagcgaccgcauggggaugggcaccaccuaccuggcccugauggccacguucaagaugcggccgauguucgccguggggcuccuguuccgccggcugaccucccgcgaggugcuccugcugaccaucgggcucagccuggucgccuccguggagcugcccaacagccucgaggagcugggcgacgggcuggcgaugggcaucaugauccucaagcugcugaccgacuuccagucccaccagcucugggccacgcugcugagccucaccuucaucaagaccaccuucucccugcacuacgccuggaagacgauggccaugguccugagcaucgugucccucuucccccugugccugagcaccaccucccagaagaccacguggcuccccgugcugcugggcagccucgggugcaagccgcugaccauguuccugaucgcggagaacaagaucuggggccggcgcuccuggccccucaacgaggggaucauggccgucggcaucgugagcauccugcugagcucccuccugaagaacgacgugccccuggccgggccccucaucgccggcggcaugcugaucgccugcuacgucaucagcggguccagcgcggaccugucccucgagaaggccgccgaggugagcugggaggaggaggccgagcacuccggcgccagccacaacauccugguggagguccaggacgacgggaccaugaagaucaaggacgaggagcgggacgacacccugaccauccuccugaaggcgacgcugcucgccguguccggcguguacccgcugagcauccccgccacccuguucgucugguacuucuggcagaagaagaagcagcgcuccggggugcucugggacacccccagcccgcccgaggugggccgggccguccuggacgacggcaucuaccgcaucaugcagcgggggcugcugggccgcucccaggugggggugggcgucuuccaggagaacguguuccacaccauguggcacgugacgcgcggggccguccucauguaccagggcaagcgccuggagcccagcugggcguccgugaagaaggaccugaucagcuacggcgggggcuggcggcuccagggguccuggaacaccggcgaggaggugcaggucaucgccguggagcccgggaagaaccccaagaacgugcagaccgcccccggcaccuucaagacgcccgagggcgaggucggggccaucgcccuggacuucaagcccggcaccagcgggucccccaucgugaaccgcgagggcaagaucgugggccuguacgggaacggcgucgugaccaccagcgggacguacgugagcgcgaucgcccaggccaaggccucccaggagggcccgcuccccgagaucgaggacgaggucuuccggaagcgcaaccugaccaucauggaccugcaccccgggagcggcaagacccggcgcuaccucccggcgaucgugcgggaggccaucaagcgcaagcugcgcacccugauccucgcccccacgcggguggucgccuccgagauggccgaggcgcugaagggcaugcccauccgcuaccagaccaccgccgucaagagcgagcacaccgggaaggagaucguggaccugaugugccacgccacguucaccaugcggcuccugucccccguccgcgugccgaacuacaacaugaucaucauggacgaggcccacuucaccgaccccagcuccaucgccgcgcggggcuacaucagcacccgcguggggaugggcgaggccgccgccaucuucaugacggccacgccgcccggguccgucgaggcguucccgcagagcaacgccgugauccaggacgaggagcgggacauccccgagcgcuccuggaacagcggcuacgaguggaucaccgacuuccccggcaagaccgugugguucguccccuccaucaagagcgggaacgacaucgccaacugccugcggaagaacggcaagcgcgugauccagcucucccggaagacguucgacaccgaguaccagaagaccaagaacaacgacugggacuacguggucaccacggacaucagcgagaugggggccaacuuccgcgcggaccgggugaucgacccgcgccggugccugaagcccgugauccugaaggacggccccgagcgcgucauccucgccgggcccaugccggugaccgucgccuccgccgcccagcggcgcggccggaucggccgcaaccacaacaaggagggggaccaguacaucuacaugggccagccccugaacaacgacgaggaccacgcgcacuggaccgaggccaagaugcugcucgacaacaucaacacccccgaggggaucauccccgcccuguucgagccggagcgcgagaaguccgccgccaucgacggcgaguaccggcugcgcggggaggcgcggaagacguucguggagcucaugcgccggggcgaccugcccguguggcuguccuacaaggucgccagcgagggcuuccaguacagcgaccgccgguggugcuucgacggggagcgcaacaaccaggugcucgaggagaacauggacguggagaucuggaccaaggagggcgagcggaagaagcugcgcccccgguggcuggacgcccgcaccuacuccgacccccucgcccugcgggaguucaaggaguucgccgcggggcgccggagcgucuccggcgaccugauccucgagaucggcaagcugccgcagcaccugacccagcgcgcccagaacgcccucgacaaccuggugaugcugcacaacagcgagcagggcgggcgggccuaccgccacgcgauggaggagcuccccgacacgaucgagacccugaugcugcucgcccugaucgccgugcugaccgggggcgucacccucuucuuccuguccgggcggggccugggcaagaccagcaucgggcuccugugcgugauggccuccagcgugcugcucuggauggccuccgucgagccccacuggaucgcggccagcaucauccuggaguucuuccugauggugcuccugauccccgagccggaccgccagcggacgccccaggacaaccagcuggccuacguggucaucggccuccuguucaugauccugaccguggccgccaacgagauggggcuccuggagaccaccaagaaggaccugggcaucgggcacguggcggucgagaaccaccaccacgccacgaugcucgacguggaccugcaccccgccuccgccuggacccuguacgccguggcgaccaccaucaucacgccgaugaugcgccacaccaucgagaacaccaccgccaacaucagccucacggccaucgccaaccaggccgcgauccugaugggccuggacaagggcuggcccaucuccaagauggacaucggggucccccuccuggcccugggcugcuacagccaggugaacccccucacccugaccgccgccgugcugaugcucgucgcgcacuacgccaucaucgggccgggccugcaggccaaggccacccgcgaggcccagaagcggacggcggccgggaucaugaagaaccccaccguggacggcaucguggccaucgaccuggaccccgucguguacgacgccaaguucgagaagcagcucggccagaucaugcugcugauccucugcaccucccagauccugcugaugcgcaccacgugggcccucugcgagagcaucacccuggcgaccgggccccugaccacgcucugggagggcuccccggggaaguucuggaacaccaccaucgccgugagcauggccaacaucuuccggggcuccuaccuggccggcgccgggcuggcguucagccucaugaagucccugggcgggggccgccgggggaccggcgcccagggcgagacgcugggggagaaguggaagcgccagcucaaccagcuguccaagagcgaguucaacaccuacaagcgguccggcaucauggaggucgaccgcagcgaggccaaggaggggcugaagcggggcgagaccaccaagcacgccgugucccgcgggacggcgaagcuccggugguucguggagcgcaaccuggucaagcccgagggcaaggugaucgaccugggcugcgggcggggcggguggagcuacuacugcgccggccugaagaaggugaccgaggucaagggguacaccaagggcggccccgggcacgaggagcccaucccgauggccaccuacggcuggaaccucgugaagcugcacuccgggaaggacguguucuucaucccgcccgagaagugcgacacgcugcucugcgacaucggcgagagcucccccaacccgaccaucgaggaggggcgcacccugcggguccugaagaugguggagcccuggcuccgcggcaaccaguucugcaucaagauccugaaccccuacaugcccagcguggucgagacccuggagcagaugcagcggaagcacggcgggaugcucgugcgcaacccgcugucccggaacagcacccacgagauguacuggguguccugcggcacggggaacaucgucagcgccgugaacaugaccucccgcaugcugcucaaccgcuucaccauggcccaccggaagcccaccuacgagcgcgacguggaccugggcgcgggcacgcggcacgucgccguggagcccgagguggccaaccuggacaucaucgggcagcgcaucgagaacaucaagcacgagcacaagagcaccuggcacuacgacgaggacaaccccuacaagaccugggccuaccacggcuccuacgaggucaagccgagcggguccgccagcagcauggugaacggcgucgugaagcuccugaccaagcccugggacgugauccccauggucacgcagaucgcgaugaccgacaccacccccuucgggcagcagcggguguucaaggagaagguggacacgcgcaccccgaaggccaagcggggcaccgcccagaucauggaggucaccgccaaguggcuguggggcuuccucucccgcaacaagaagccccggaucugcacgcgcgaggaguucacccggaaggugcgcagcaacgccgcgaucggggccguguucgucgacgagaaccaguggaacuccgccaaggaggccguggaggacgagcgguucugggaccuggugcaccgcgagcgggagcugcacaagcagggcaagugcgcgaccugcgucuacaacaugauggggaagcgcgagaagaagcucggcgaguucgggaaggccaagggcagccgggccaucugguacauguggcugggcgcccgcuuccuggaguucgaggcccucggguucaugaacgaggaccacugguucucccgggagaacagccuguccggcguggagggggagggccugcacaagcucggguacauccugcgcgacaucagcaacauccccggcggcaacauguacgcggacgacaccgccgggugggacacgcggaucaccgaggacgaccugcagaacgaggcccgcaucaccgacaucauggagccggagcacgcccuccuggccaaguccaucuucaagcugaccuaccagaacaaggugguccgcgugcagcggcccgcgaagaacggcacggugauggacgucaucagccgccgggaccagcgcggguccggccaggugggcaccuacgggcucaacaccuucaccaacauggaggcccagcugauccggcagauggagagcgagggcaucuucucccccagcgagcuggagacgcccaaccucgccgagcgcgugcuggacuggcuggagaaguacggggucgagcggcucaagcgcauggccaucuccggcgacgacugcguggugaagccgaucgacgaccgguucgccaccgcgcugaccgcccugaacgacauggggaagguccgcaaggacaucccccagugggagcccagcaagggcuggaacgacuggcagcagguccccuucugcucccaccacuuccaccagcucaucaugaaggacggccgggagaucguggucccgugccgcaaccaggacgagcugguggggcgggcccgcgugagccagggcgccggguggagccugcgggagaccgccugccucggcaaguccuacgcgcagauguggcagcugauguacuuccaccgccgggaccugcgccucgccgccaacgccaucugcagcgcgguccccguggacuggauccccacgucccggaccaccuggagcauccacgcccaccaccaguggaugaccacggaggacaugcuguccguguggaaccgcgucuggaucgaggagaaccccuggauggaggacaagacccacaucagcuccuggggcgacgugccguaccugggcaagcgcgaggaccaguggugcggcagccucaucgggcugaccgcccgggccaccugggccaccaacauccagguggcgaucaaccagguccgccggcugaucggcaacgagaacuaccucgacuacaugacguccaugaagcgcuucaagaacgagagcgaccccgagggggcccugugguga

SEQ ID NO: 8365 - RNA, 9879 nt, Artificial Sequence
  derived and/or modified CDS sequence (opt1) from DENV-1__FJ410199__SS-prME
agcgugaccaugcugcucaugcugaugcccaccgcccuggccuuccaccucacgacccgcggcggggagccccacaugaucgugagcaagcaggagcggggcaagagccugcuguucaagaccagcgcgggggugaacaugugcacccucaucgccauggaccugggcgaguucugcgaggacacgaugaccuacaagugcccccgcaucaccgaggccgagcccgacgacguggacugcuggugcaacgccaccgacacgugggugaccuacgggaccugcagccagaccggcgagcaccggcgcgacaagcgguccguggcccuggcgccccacgugggccucgggcuggagacgcgcaccgagaccuggaugagcuccgagggcgccuggaagcagauccagcgggucgagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugcccgacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaagaccguccaguacgagaaccugaaguacagcgugaucgugaccguccacacgggcgaccagcaccagguggggaacgaguccaccgagcacggcaccaccgcgaccaucacgccccaggcccccagcaccgagauccagcugaccgacuacggggcccucacccuggacugcagcccccgcacgggccuggacuucaacgagaugguccuccugaccaugaaggagaaguccuggcuggugcacaagcagugguuccucgaccugccgcugcccuggaccagcggggccuccaccagccaggagacguggaaccggaaggaccuccuggugaccuucaagaccgcccacgcgaagaagcaggaggucguggugcugggcucccaggagggcgccaugcacaccgcccucacgggggccaccgagauccagaccagcggcaccacgaccaucuucgccgggcaccugaagugccgccugaagauggacaagcucacccugaagggcauguccuacgucaugugcaccgggagcuucaagcuggagaaggagguggcggagacgcagcacggcaccgugcucguccagaucaaguacgagggcaccgacgcccccugcaagauccccuucuccacccaggacgagaagggggugacgcagaacggccggcugaucaccgccaacccgaucgugaccgacaaggagaagcccgucaacaucgaggccgagccgcccuucggggagagcuacaucgugaucggcgcgggcgagaaggcccugaagcuguccugguucaagaaggggagcuccaucggcaagauguucgaggccaccgcccgcggggcccggcgcauggcgauccucggcgacacggccugggacuucgggagcaucggcggcguguucaccuccgucgggaagcuggugcaccagaucuucggcaccgccuacggggugcuguucagcggcgucuccuggaccaugaagaucgggaucggcgugcuccugacguggcugggccucaacagccgcuccaccagccuguccaugaccugcaucgccguggggcuggucacccucuaccugggcgugauggugcaggccgacagcgggugcgucaucaacuggaagggccgggagcugaagugcgggagcggcaucuucgugacgaacgaggugcacaccuggaccgagcaguacaaguuccaggcggacuccccgaagcgccucagcgccgccaucggcaaggccugggaggagggggucugcggcauccgguccgccacccgccuggagaacaucauguggaagcagaucagcaacgagcugaaccacauccuccuggagaacgacaugaaguucaccgugguggucggggacguggcgggcauccuggcccaggggaagaagaugauccggccccagcccauggaguacaaguacuccuggaaguccuggggcaaggccaagaucaucggcgccgacgugcagaacacgaccuucaucaucgacgggcccaacaccccggagugccccgacgaccagcgcgcguggaacaucugggaggucgaggacuacggcuucgggaucuucaccacgaacaucuggcucaagcugcgggacuccuacacccaggugugcgaccaccgccugaugagcgccgccaucaaggacuccaaggccgugcacgccgacaugggcuacuggaucgagagcgagaagaacgagaccuggaagcucgcgcgggccuccuucaucgaggucaagaccugcaucuggcccaagagccacacgcugugguccaacggcgugcuggagagcgagaugaucauccccaagaacuacgggggcccgaucucccagcacaacuaccgccccggguacuucacccagaccgccggccccuggcaccucgggaagcuggagcuggacuucgaccucugcgagggcaccacgguggucguggacgagcacugcggcaaccgggggccgagccugcgcaccaccaccgugacgggcaagaucauccacgaguggugcugccgguccugcacccugccgccccugcgcuucaagggggaggacggcugcugguacgggauggagauccggcccgucaaggagaaggaggagaaccuggucaagagcauggugagcgccggcuccggcgaggucgacagcuucucccuggggcuccugugcaucagcaucaugaucgaggaggugaugcgcucccgguggagccgcaagaugcugaugaccggcacccucgccgugcuguuccugcucaucauggggcagcugacgugguccgaccugauccggcucugcaucauggucggcgcgaacgccagcgaccgcauggggaugggcaccaccuaccuggcccugauggccaccuucaagaugcgcccgauguucgccguggggcuccuguuccggcgccugacgucccgggaggugcuccugcugaccaucgggcucagccuggucgcguccguggagcugcccaacagccucgaggagcugggcgacgggcuggccaugggcaucaugauccucaagcugcugaccgacuuccagucccaccagcucugggccacccugcugagccucacguucaucaagaccaccuucucccugcacuacgccuggaagaccauggcgaugguccugagcaucgugucccucuucccccugugccugagcacgaccucccagaagaccaccuggcuccccgugcugcugggcagccucgggugcaagccgcugacgauguuccugaucgccgagaacaagaucuggggccgcaagagcuggccccucaacgaggggaucauggccgucggcaucguguccauccugcugagcucccuccugaagaacgacgugccccuggccgggccccucaucgccggcggcaugcugaucgcgugcuacgucaucagcggguccagcgccgaccugucccucgagaaggccgccgaggugagcugggaggaggaggccgagcacuccggcgcgagccacaacauccugguggagguccaggacgacgggaccaugaagaucaaggacgaggagcgggacgacacccugaccauccuccugaaggccacccugcucgccguguccggcguguacccgcugagcauccccgccacgcuguucgucugguacuucuggcagaagaagaagcagcgcuccggggugcucugggacacccccagcccgcccgagguggagcgggccguccuggacgacggcaucuaccgcaucaugcagcggggccugcuggggcgcucccaggugggcgugggggucuuccaggagaacguguuccacaccauguggcacgugacccggggcgcgguccucauguaccaggggaagcgccuggagcccagcugggccuccgugaagaaggaccugaucagcuacggcggcggguggcggcuccagggcuccuggaacacgggggaggaggugcaggucaucgccguggagcccggcaagaaccccaagaacgugcagaccgcccccgggaccuucaagaccagcgagggcgaggucggcgccaucgcgcuggacuucaagcccgggacgagcggcucccccaucgugaaccgcgaggggaagaucgugggccuguacggcaacggggucgugaccaccagcggcaccuacguguccgccaucgcccaggccaaggcgagccaggaggggccccucccggagaucgaggacgaggucuuccggaagcgcaaccugacgaucauggaccugcaccccggcuccgggaagacccggaaguaccuccccgccaucgugcgcgaggccaucaagcggaagcugcgcacccugauccucgccccgacccggguggucgccagcgagauggcggaggcccugaagggcaugcccauccgcuaccagacgaccgccgugaaguccgagcacaccggcaaggagaucguggaccugaugugccacgccaccuucacgaugcgccuccugagccccguccgggugcccaacuacaacaugaucaucauggacgaggcccacuucaccgacccguccagcaucgcggcccgcggguacaucuccacccgggugggcaugggggaggccgccgccaucuucaugaccgcgacgccgcccggcagcgucgaggccuucccccaguccaacgccgugauccaggacgaggagcgcgacaucccggagcggagcuggaacuccggguacgaguggaucaccgacuuccccggcaagaccgugugguucguccccagcaucaaguccggcaacgacaucgccaacugccugcgcaagaacgggaagcgggugauccagcucagccgcaagaccuucgacacggaguaccagaagaccaagaacaacgacugggacuacguggucaccaccgacaucuccgagaugggcgcgaacuuccgggccgaccgcgugaucgacccccggcgcugccugaagccggugauccugaaggacgggcccgagcgggucauccucgccggccccaugcccgugacggucgccagcgccgcgcagcgccgggggcgcaucggccggaaccacaacaaggagggcgaccaguacaucuacauggggcagccgcugaacaacgacgaggaccacgcccacuggaccgaggccaagaugcugcucgacaacaucaacacccccgagggcaucauccccgcccuguucgagcccgagcgcgagaaguccgccgcgaucgacggggaguaccggcugcgcggcgaggcccgcaagaccuucguggagcucaugcggcgcggggaccugccgguguggcuguccuacaaggucgccagcgagggcuuccaguacuccgaccggcgcuggugcuucgacggcgagcggaacaaccaggugcucgaggagaacauggacguggagaucuggacgaaggagggggagcgcaagaagcugcggccccgcuggcuggacgcccggaccuacagcgacccccucgcccugcgcgaguucaaggaguucgcggccggccggcgcuccgucagcggggaccugauccucgagaucggcaagcugccccagcaccugacccagcgggcccagaacgcccucgacaaccuggugaugcugcacaacuccgagcagggcgggcgcgcguaccggcacgccauggaggagcucccggacaccaucgagacgcugaugcugcucgcccugaucgccgugcugaccggcggggucacccucuucuuccugagcggccgcgggcugggcaagaccuccaucggccuccugugcgugauggccagcuccgugcugcucuggauggcgagcgucgagccccacuggaucgccgccuccaucauccuggaguucuuccugauggugcuccugauccccgagcccgaccggcagcgcaccccgcaggacaaccagcuggccuacguggucaucgggcuccuguucaugauccugacgguggccgcgaacgagaugggccuccuggagaccaccaagaaggaccuggggaucggccacguggccgucgagaaccaccaccacgccgccaugcucgacguggaccugcaccccgccagcgcguggacccuguacgccguggccacgaccaucaucacccccaugaugcggcacaccaucgagaacacgaccgccaacaucucccucaccgccaucgcgaaccaggccgccauccugauggggcuggacaagggcuggccgaucagcaagauggacaucggcgucccccuccuggcccuggggugcuacucccaggugaacccccucacccugacggcggccgugcugaugcucgucgcccacuacgccaucaucggccccgggcugcaggccaaggcgacccgcgaggcccagaagcggaccgccgccggcaucaugaagaacccgaccguggacgggaucguggccaucgaccuggaccccgucguguacgacgcgaaguucgagaagcagcucggccagaucaugcugcugauccucugcacgagccagauccugcugaugcgcaccaccugggcccucugcgaguccaucacccuggccacgggcccccugaccacccucugggaggggagccccggcaaguucuggaacaccacgaucgccgugagcauggccaacaucuuccgcggguccuaccuggcgggcgccggccuggccuucagccucaugaagucccucgggggcgggcggcgcgggaccggggcccagggcgagacccugggcgagaaguggaagcggcagcucaaccagcugagcaaguccgaguucaacaccuacaagcgcagcgggaucauggaggucgaccgguccgaggcgaaggagggccugaagcgcggggagacgaccaagcacgccgugagccggggcaccgccaagcuccgcugguucguggagcggaaccuggucaagccggaggggaaggugaucgaccugggcugcggccgcgggggcugguccuacuacugcgccgggcugaagaaggugaccgaggucaagggcuacacgaagggcgggcccggccacgaggagcccauccccauggccaccuacggguggaaccucgugaagcugcacagcggcaaggacguguucuucaucccgcccgagaagugcgacacccugcucugcgacaucggggaguccagccccaaccccaccaucgaggagggccggacgcugcgcguccugaagaugguggagccguggcuccgggggaaccaguucugcaucaagauccugaaccccuacaugcccuccguggucgagacccuggagcagaugcagcgcaagcacggcggcaugcucgugcggaacccccugagccgcaacuccacccacgagauguacugggugagcugcgggaccggcaacaucgucuccgcggugaacaugaccagccggaugcugcucaaccgcuucacgauggcccaccggaagccgaccuacgagcgcgacguggaccugggggccggcacccgccacgucgccguggagcccgagguggccaaccuggacaucaucggccagcggaucgagaacaucaagcacgagcacaaguccaccuggcacuacgacgaggacaaccccuacaagacgugggcguaccacgggagcuacgaggucaagcccagcggcuccgccagcuccauggugaacggggucgugaagcuccugaccaagccgugggacgugauccccauggucacccagaucgccaugaccgacacgacccccuucggccagcagcgcguguucaaggagaagguggacacccggacccccaaggccaagcgcgggacggcccagaucauggaggucaccgcgaaguggcuguggggcuuccucagccggaacaagaagccgcgcaucugcacccgggaggaguucacccgcaaggugcgguccaacgccgccaucggcgccguguucgucgacgagaaccaguggaacagcgcgaaggaggccguggaggacgagcgcuucugggaccuggugcaccgggagcgcgagcugcacaagcaggggaagugcgccacgugcgucuacaacaugaugggcaagcgggagaagaagcucggggaguucggcaaggccaaggggucccgcgccaucugguacauguggcugggcgcgcgguuccuggaguucgaggcccucggcuucaugaacgaggaccacugguucagccgcgagaacucccugagcgggguggagggcgaggggcugcacaagcucggcuacauccugcgggacaucuccaagauccccgggggcaacauguacgccgacgacaccgccggcugggacacccgcaucaccgaggacgaccugcagaacgaggccaagaucacggacaucauggagcccgagcacgcgcuccuggccaagagcaucuucaagcugaccuaccagaacaaggugguccgggugcagcgcccggccaagaacgggaccgugauggacgucaucucccggcgcgaccagcgcggcagcggccaggugggcaccuacggccucaacacguucaccaacauggaggcccagcugauccggcagauggaguccgaggggaucuucagccccuccgagcuggagacccccaaccucgccggccgcgugcuggacuggcuggagaagcacggggucgagcggcucaagcgcauggcgaucagcggcgacgacugcguggugaagcccaucgacgaccgguucgccaccgcccugacggcccugaacgacauggggaagguccgcaaggacaucccgcagugggagcccagcaagggcuggaacgacuggcagcagguccccuucugcucccaccacuuccaccagcucaucaugaaggacggccgggagaucgugguccccugccgcaaccaggacgagcugguggggcgggcccgcgugagccagggcgcgggguggucccugcgggagaccgccugccucggcaagagcuacgcccagauguggcagcugauguacuuccaccgccgggaccugcgccucgccgcgaacgccaucugcuccgccgucccgguggacugggugcccaccagccggaccacgugguccauccacgcccaccaccaguggaugaccaccgaggacaugcugagcgucuggaaccgcguguggaucgaggagaaccccuggauggaggacaagacccacaucuccagcuggggcgacgugcccuaccugggcaagcgggaggaccaguggugcggcucccucaucgggcugacggcccgcgcgaccugggccaccaacauccaggucgccaucaaccaggugcggcgccugaucggcaacgagaacuaccucgacuacaugaccagcaugaagcgcuucaagaacgaguccgacccggagggggcccugugguga

SEQ ID NO: 8366 - RNA, 9879 nt, Artificial Sequence
  derived and/or modified CDS sequence (opt1) from DENV-1__FJ432739__SS-prME
agcgugaccaugcugcucaugcugaugcccaccgcccuggccuuccaccucaccacccggggcggggagccccacaugaucguguccaagcaggagcggggcaagagccugcuguucaagaccuccgcgggggugaacaugugcacccucaucgccauggaccugggcgaguucugcgaggacacgaugaccuacaagugcccccgcaucaccgaggccgagcccgacgacguggacugcuggugcaacgccaccgacacgugggucaccuacgggaccugcagccagaccggcgagcaccggcgggacaagcgguccguggcccuggcgccccacgugggccucgggcuggagacgcgcaccgagaccuggaugagcuccgagggcgccuggaagcagauccagcgggucgagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugcccgacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaagaccguccaguacgagaaccugaaguacagcgugaucgugaccguccacacgggcgaccagcaccagguggggaacgaguccaccgagcacggcaccaccgcgaccaucacgccccaggcccccagcaccgagauccagcugaccgacuacggggcccucacccuggacugcagcccccggacgggccuggacuucaacgagaugguccuccugaccaugaaggagaaggccuggcuggugcacaagcagugguuccucgaccugccgcugcccuggaccagcggggccagcaccucccaggagacguggaaccggaaggaccuccuggugaccuucaagaccgcgcacgccaagaagcaggaggucguggugcugggcagccaggagggcgccaugcacaccgcccucacgggggccaccgagauccagaccuccggcaccacgaccaucuucgcggggcaccugaagugccgccugaagauggacaagcucacccugaagggcaugagcuacgucaugugcaccggguccuucaagcuggagaaggagguggccgagacgcagcacggcaccgugcucguccagaucaaguacgagggcaccgacgcccccugcaagauccccuucagcacccaggacgagaagggggugacgcagaacggccggcugaucaccgccaacccgaucgugaccgacaaggagaagcccgucaacaucgaggcggagccgcccuucggggaguccuacaucgugaucggcgccggcgagaaggcccugaagcugagcugguucaagaagggguccagcaucggcaagauguucgaggccaccgcccgcggggcgcggcgcauggccauccucggcgacacggccugggacuucggguccaucggcggcguguucaccagcgucgggaagcuggugcaccagaucuucggcaccgccuacggggugcuguucuccggcgucagcuggaccaugaagaucgggaucggcgugcuccugacguggcugggccucaacucccgcagcaccucccugagcaugaccugcaucgccguggggcuggucacccucuaccugggcgugauggugcaggcggacuccgggugcgucaucaacuggaagggccgggagcugaagugcgggagcggcaucuucgugacgaacgaggugcacaccuggaccgagcaguacaaguuccaggccgacagcccgaagcgccucuccgccgccaucggcaaggccugggaggagggggucugcggcauccggagcgcgacccgccuggagaacaucauguggaagcagaucuccaacgagcugaaccacauccuccuggagaacgacaugaaguucaccgugguggucggggacguggccggcauccuggcccaggggaagaagaugauccggccccagcccauggaguacaaguacagcuggaaguccuggggcaaggccaagaucaucggcgcggacgugcagaacgccacguucaucaucgacgggcccaacaccccggagugccccgacgaccagcgcgccuggaacaucugggaggucgaggacuacggcuucgggaucuucaccaccaacaucuggcucaagcugcgggacagcuacacccaggugugcgaccaccgccugauguccgccgccaucaaggacagcaaggcggugcacgccgacaugggcuacuggaucgaguccgagaagaacgagaccuggaagcucgcccgggccagcuucaucgaggucaagaccugcaucuggcccaagucccacacccuguggagcaacggcgugcuggaguccgagaugaucauccccaagaucuacgggggcccgaucagccagcacaacuaccgccccggguacuucacgcagaccgccggccccuggcaccucgggaagcuggagcuggacuucgaccucugcgagggcaccaccguggucguggacgagcacugcggcaaccgggggccgucccugcgcacgaccaccgugaccggcaagaucauccacgaguggugcugccggagcugcacgcugccgccccugcgcuucaagggggaggacggcugcugguacgggauggagauccggcccgucaaggagaaggaggagaaccuggugaaguccauggugagcgcgggcagcggcgaggucgacuccuucagccuggggcuccugugcaucuccaucaugaucgaggaggugaugcgcagccgguggucccgcaagaugcugaugaccggcauccucgccguguucuuccugcugaucauggggcagcucaccuggaacgaccugauccggcugugcaucauggucggcgccaacgccagcgaccgcauggggaugggcacgacguaccucgcccugauggcgaccuucaagaugcgcccgauguucgccguggggcuccuguuccggcgccugaccucccgggaggugcugcuccugaccaucgggcugagccucgucgccuccguggagcugcccaacagccuggaggagcucggcgacgggcuggccaugggcaucaugauccugaagcuccugacggacuuccagucccaccagcugugggcgacccuccugagccugaccuucaucaagaccacguucucccuccacuacgccuggaagaccauggccaugguccugagcaucgugucccuguucccccucugccugagcaccaccucccagaagacgaccuggcugcccgugcuccugggcagccuggggugcaagccgcucaccauguuccugaucgccgagaacaagaucuggggccgcaaguccuggccccugaacgaggggaucauggccgucggcaucgugagcauccuccugagcucccugcucaagaacgacgugccccuggcggggccccugaucgccggcggcaugcucaucgccugcuacgucaucagcggguccagcgccgaccugucccuggagaaggccgcggaggugagcugggaggaggaggccgagcacuccggcgccagccacaacauccucguggagguccaggacgacgggaccaugaagaucaaggacgaggagcgggacgacacgcugaccauccugcucaaggccacccugcuggccguguccggcguguacccgcucagcauccccgcgacccuguucgucugguacuucuggcagaagaagaagcagcgcuccggggugcugugggacacccccuccccgcccgagguggagcgggccguccucgacgacggcaucuaccgcaucaugcagcggggccugcuggggcgcucccaggugggcgugggggucuuccaggagaacguguuccacacgauguggcacgugacccggggcgccguccugauguaccaggggaagcgccucgagcccagcugggccuccgugaagaaggaccugaucagcuacggcggcggguggcggcugcagggcuccuggaacaccggggaggaggugcaggucaucgccguggagcccggcaagaaccccaagaacgugcagaccgcgcccgggacguucaagaccagcgagggcgaggucggcgccaucgcccucgacuucaagcccgggaccuccggcagccccaucgugaaccgcgaggggaagaucgugggccuguacggcaacggggucgugaccacgagcggcaccuacguguccgccaucgcgcaggccaaggccagccaggaggggccccugccggagaucgaggacgaggucuuccggaagcgcaaccucaccaucauggaccugcaccccggcuccgggaagacccggcgcuaccugcccgccaucgugcgggaggccaucaagcgcaagcuccggacgcugauccuggcgccgacccgcguggucgccagcgagauggccgaggcccucaagggcaugcccauccgcuaccagaccaccgccgugaaguccgagcacacgggcaaggagaucguggaccugaugugccacgcgaccuucaccaugcggcugcucagccccguccgcgugcccaacuacaacaugaucaucauggacgaggcccacuucaccgacccguccagcaucgccgcccggggguacaucuccacgcgcgugggcaugggggaggccgcggccaucuucaugaccgccacgccgcccggcagcgucgaggccuucccccaguccaacgcggugauccaggacgaggagcgggacaucccggagcgcagcuggaacuccggguacgaguggaucaccgacuuccccggcaagacggugugguucguccccagcaucaaguccggcaacgacaucgccaacugccugcggaagaacgggaagcgcgugauccagcugagccggaagaccuucgacaccgaguaccagaagaccaagaacaacgacugggacuacguggucacgaccgacaucuccgagaugggcgccaacuuccgcgccgaccgggugaucgacccccgccggugccucaagccggugauccugaaggacgggcccgagcgcgucauccuggccggccccaugcccgugaccgucgcgagcgccgcccagcggcgcgggcggaucggccgcaaccacaacaaggagggcgaccaguacaucuacauggggcagccgcucaacaacgacgaggaccacgcccacuggaccgaggccaagaugcugcuggacaacaucaacacgcccgagggcaucauccccgcccucuucgagcccgagcgggagaaguccgccgccaucgacggggaguaccgccugcgcggcgaggcccggaagaccuucguggagcugaugcgccgcggggaccucccgguguggcugagcuacaaggucgccagcgagggcuuccaguacuccgaccgccgguggugcuucgacggcgagcgcaacaaccaggugcuggaggagaacauggacguggagaucuggaccaaggagggggagcggaagaagcuccgcccccgguggcuggacgcgcgcaccuacagcgacccccuggcccuccgggaguucaaggaguucgccgccggccgccgguccgucagcggggaccugauccuggagaucggcaagcucccccagcaccugacgcagcgcgcgcagaacgcccuggacaaccucgugaugcugcacaacuccgagcagggcgggcgggccuaccgccacgccauggaggagcugccggacaccaucgagacccucaugcugcuggcccucaucgcggugcugaccggcggggucacgcuguucuuccucagcggccgggggcugggcaagaccuccaucggccugcucugcgugauggccagcuccgugcugcuguggauggccagcgucgagccccacuggaucgccgccuccaucauccucgaguucuuccugauggugcugcucauccccgagcccgaccgccagcggaccccgcaggacaaccagcuggcguacguggucaucgggcuccucuucaugauccugaccguggccgccaacgagaugggccugcucgagaccacgaagaaggaccuggggaucggccacguggccgucgagaaccaccaccacgccgcgaugcuggacguggaccuccaccccgccagcgccuggacccuguacgccguggccaccaccaucaucacgcccaugaugcgccacaccaucgagaacaccaccgcgaacaucucccugacggccaucgccaaccaggccgcgauccucauggggcuggacaagggcuggccgaucagcaagauggacaucggcgucccccugcucgcccuggggugcuacucccaggugaacccccugacccucaccgccgccgugcugaugcuggucgcccacuacgcgaucaucggccccgggcuccaggccaaggccacccgggaggcccagaagcgcacggccgcgggcaucaugaagaacccgaccguggacgggaucguggccaucgaccuggaccccgucguguacgacaccaaguucgagaagcagcugggccagaucaugcuccugauccugugcaccagccagauccuccugaugcgcacgaccugggcccugugcgaguccaucacccucgccaccggcccccugacgacccugugggaggggagccccggcaaguucuggaacaccaccaucgccguguccauggcgaacaucuuccgggggagcuaccucgccggcgccggccuggccuucagccugaugaagucccucgggggcgggcgccggggcacgggggcgcagggcgagacccugggcgagaaguggaagcgccagcugaaccagcucagcaaguccgaguucaacaccuacaagcggagcgggaucauggaggucgaccgcuccgaggccaaggagggccugaagcgcggggagaccacgaagcacgccgugagccgcggcaccgccaagcugcggugguucguggagcgcaaccucgucaagccggaggggaaggugaucgaccugggcugcggccgcggcgggugguccuacuacugcgccgggcugaagaaggugaccgaggucaagggguacaccaagggcgggcccggccacgaggagcccauccccauggcgacguacggguggaaccuggugaagcuccacagcggcaaggacguguucuucaucccgcccgagaagugcgacacccugcugugcgacaucggggaguccagccccaaccccaccaucgaggagggccgcacccuccggguccugaagaugguggagccguggcugcgcgggaaccaguucugcaucaagauccucaaccccuacaugcccuccguggucgagacgcuggagcagaugcagcggaagcacggcggcaugcuggugcgcaacccccucagccggaacuccacccacgagauguacugggugagcugcgggaccggcaacaucgucuccgccgugaacaugaccagccgcaugcugcugaaccgguucaccauggcccaccgcaagccgacguacgagcgcgacguggaccucggggccggcacccggcacgucgccguggagcccgagguggcgaaccuggacaucaucggccagcgcaucgagaacaucaagcacgagcacaaguccaccuggcacuacgacgaggacaaccccuacaagaccugggccuaccacgggagcuacgaggucaagcccuccggcagcgccagcuccauggugaacggggucgugaagcugcucacgaagccgugggacgugauccccauggucacccagaucgccaugaccgacaccacgcccuucggccagcagcggguguucaaggagaagguggacacccgcacccccaaggccaagcgggggaccgcgcagaucauggaggucacggccaaguggcuguggggcuuccugagccgcaacaagaagccgcggaucugcacccgcgaggaguucacccggaaggugcgcuccaacgccgccaucggcgcgguguucgucgacgagaaccaguggaacagcgccaaggaggccguggaggacgagcgguucugggaccucgugcaccgcgagcgggagcugcacaagcaggggaagugcgcgaccugcgucuacaacaugaugggcaagcgcgagaagaagcugggggaguucggcaaggccaaggggucccgggcgaucugguacauguggcucggcgcccgcuuccuggaguucgaggcccugggcuucaugaacgaggaccacugguucagccgggagaacucccucagcgggguggagggcgaggggcugcacaagcugggcuacauccuccgcgacaucuccaagauccccgggggcaacauguacgccgacgacacggccggcugggacacccggaucaccgaggacgaccugcagaacgaggcgaagaucaccgacaucauggagcccgagcacgcccugcucgccaagagcaucuucaagcugacguaccagaacaaggugguccgcgugcagcggccggccaagaacgggaccgugauggacgucaucucccgccgcgaccagcggggcagcggccaggugggcaccuacggccugaacaccuucacgaacauggaggcccagcucauccgccagauggaguccgaggggaucuucagccccuccgagcuggagacccccaaccuggcgggccgggugcucgacuggcuggagaagcacggggucgagcgccugaagcggauggccaucagcggcgacgacugcguggugaagcccaucgacgaccgcuucgccaccgcccucaccgcccugaacgacauggggaagguccggaaggacaucccgcagugggagcccuccaagggcuggaacgacuggcagcagguccccuucugcagccaccacuuccaccagcugaucaugaaggacggccgcgagaucgugguccccugccggaaccaggacgagcucguggggcgcgcgcgggugagccagggcgccggguggucccugcgcgagacggccugccugggcaagagcuacgcccagauguggcagcucauguacuuccaccggcgcgaccugcggcuggcggccaacgccaucugcuccgccgucccgguggacugggugcccaccagccgcaccaccugguccauccacgcccaccaccaguggaugacgaccgaggacaugcucagcgucuggaaccggguguggaucgaggagaaccccuggauggaggacaagacccacaucuccagcuggggcgacgugcccuaccugggcaagcgcgaggaccaguggugcggcucccugaucgggcucaccgcgcgggccacgugggccaccaacauccaggucgccaucaaccaggugcgccgccugaucggcaacgagaacuaccuggacuacaugaccagcaugaagcgguucaagaacgagaucgacccggagggggcccucugguga

SEQ ID NO: 8367 - RNA, 9879 nt, Artificial Sequence
  derived and/or modified CDS sequence (opt1) from DENV-1__FJ410201__SS-prME
agcgugaccaugcugcucaugcugaugcccaccgcccuggccuuccaccucaccacccgcggcggggagccccacaugaucgugagcaagcaggagcggggcaagagccugcuguucaagaccagcgccggggugaacaugugcacccucaucgccauggaccugggcgagcugugcgaggacacgaugaccuacaagugcccccgcaucaccgaggccgagcccgacgacguggacugcuggugcaacgccaccgacacgugggugaccuacgggaccugcagccagaccggcgagcaccggcgcgacaagcgguccguggcccucgcgccccacgugggccuggggcuggagacgcgcaccgagaccuggaugagcuccgagggcgccuggaagcagauccagcgggucgagaccugggcccuccgccaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcggugcugcggaagcucugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacaccggcgaccagcaccagguggggaacgaguccacggagcacggcaccaccgcgaccaucacgccccaggcccccacgaccgagauccagcucaccgacuacggggcccugacccuggacugcagcccccgcacgggccucgacuucaacgagaugguccugcugaccaugaaggagaaguccuggcucgugcacaagcagugguuccuggaccugccccuccccuggaccagcggggccagcaccucccaggagacguggaaccggcaggaccugcuggugaccuucaagaccgcccacgcgaagaagcaggaggucguggugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgucaugugcaccggguccuucaagcucgagaaggagguggcggagacgcagcacggcaccgugcugguccagaucaaguacgagggcaccgacgcccccugcaagauccccuucagcacccaggacgagaagggggugacgcagaacggccggcugaucaccgccaacccgaucgugaccgacaaggagaagcccgucaacaucgaggccgagccgcccuucggggaguccuacaucgugaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcgucgggaagcuggugcaccagaucuucggcaccgccuacgggguccucuucuccggcgucagcuggaccaugaagaucgggaucggcgugcugcugacguggcucggccugaacucccgcagcaccucccugagcaugaccugcaucgccguggggcucgucacccuguaccugggcgugauggugcaggccgacuccgggugcgucaucaacuggaagggccgggagcucaagugcgggagcggcaucuucgugacgaacgaggugcacaccuggaccgagcaguacaaguuccaggcggacagcccgaagcgccuguccgccgccaucggcaaggccugggaggagggggucugcggcauccggagcgccacccgccuggagaacaucauguggaagcagaucuccaacgagcucaaccacauccugcuggagaacgacaugaagcucaccgugguggucggggacguggcgggcauccuggggcagggcaagaagaugauccggccccagcccauggaguacaaguacagcuggaaguccuggggcaaggccaagaucaucggggccgacgcccagaacacgaccuucaucaucgacggccccaacaccccggagugccccgacgaccagcgcgcguggaacaucugggagguggaggacuacggguucggcaucuucaccacgaacaucuggcugaagcuccgggacagcuacacccaggucugcgaccaccgccugauguccgccgccaucaaggacagcaaggccgugcacgccgacaugggcuacuggaucgaguccgagaagaacgagaccuggaagcuggcgcgggccagcuucaucgaggugaagaccugcaucuggcccaagucccacacgcucuggagcaacgggguccuggaguccgagaugaucauccccaagaucuacggcgggccgaucagccagcacaacuaccgccccggcuacuucacccagaccgccgggcccuggcaccugggcaagcucgagcuggacuucgaccugugcgagggcaccacggugguggucgacgagcacugcgggaaccggggcccgucccuccgcaccaccaccgugacggggaagaucauccacgaguggugcugccggagcugcacccugccgccccugcgcuuccggggcgaggacgggugcugguacggcauggagauccgccccgugaaggagaaggaggagaaccucgucaaguccauggugagcgccggcagcggggagguggacuccuucagccugggccugcucugcaucuccaucaugaucgaggaggucaugcggagccgcuggucccggaagaugcugaugaccgggacccuggccguguucuuccuccugaucaugggccagcugacguggaacgaccucauccgccugugcaucauggugggggcgaacgccagcgaccgcaugggcaugggcaccaccuaccuggcccucauggccaccuucaagaugcggccgauguucgccgucgggcugcuguuccgccggcucacgucccgcgaggugcugcugcucaccaucggccugagccugguggcguccgucgagcuccccaacagccuggaggagcugggggacggccucgccaugggcaucaugauccugaagcugcucaccgacuuccagucccaccagcugugggccacccugcucagccugacguucaucaagaccaccuucucccugcacuacgccuggaagaccauggcgauggugcucagcaucgucucccuguucccccugugccucagcacgaccucccagaagaccaccuggcugcccgugcugcucgggagccugggcugcaagccgcugacgauguuccucaucgccgagaacaagaucugggggcggaaguccuggccccugaacgagggcaucauggccguggggaucgucagcauccugcucagcucccugcugaagaacgacgugccccucgccggcccccugaucgccggcgggaugcugaucgcgugcuacgugaucagcggcuccagcgccgaccucucccuggagaaggccgccgaggucagcugggaggaggaggccgagcacuccggggcgagccacaacauccugguggaggugcaggacgacggcaccaugaagaucaaggacgaggagcgcgacgacacccucaccauccugcugaaggccacccuccuggccgucuccgggguguacccgcugagcauccccgccacccucuucgugugguacuucuggcagaagaagaagcagcgguccggcguccugugggacacccccagcccgcccgagguggagcgcgccgugcuggacgacggcaucuaccggaucaugcagcgcgggcugcucggccggucccaggucggggugggcguguuccaggagaacgucuuccacaccauguggcacgugacccgcggggcggugcugauguaccagggcaagcggcuggagcccagcugggccuccgucaagaaggaccucaucagcuacggcgggggcuggcgccugcggggguccuggaacacgggcgaggagguccaggugaucgccgucgagcccgggaagaaccccaagaacgugcagaccgcccccggcaccuucaagacccccgagggcgaggugggggccaucgcgcuggacuucaagcccggcacgagcgggucccccaucgucaaccgcgagggcaagaucgugggccucuacgggaacggcguggucaccaccagcgggaccuacgugagcgccaucgcccaggccaaggcgucccaggagggcccgcugcccgagaucgaggacgagguguuccggaagcgcaaccugacgaucauggaccuccaccccgggagcggcaagacccggcgcuaccugccggccaucguccgggaggccaucaagcgcaagcugcgcacccucauccuggcccccacccgggugguggccuccgagauggcggaggcccugaagggcaugcccauccgcuaccagacgaccgccgucaagagcgagcacaccgggaaggagaucguggaccucaugugccacgccaccuucacgaugcggcugcugucccccgugcgcgucccgaacuacaacaugaucaucauggacgaggcccacuucaccgaccccagcuccaucgcggcccggggcuacaucagcacccgcguggggaugggcgaggccgccgccaucuucaugaccgcgacgccgcccggguccguggaggccuucccgcagagcaacgccgucauccaggacgaggagcgggacauccccgagcgcuccuggaacagcggcuacgaguggaucaccgacuuccccggcaagaccgugugguucgugcccuccaucaagagcgggaacgacaucgccaacugccuccggaagaacggcaagcgcgucauccagcugucccggaagaccuucgacacggaguaccagaagaccaagaacaacgacugggacuacguggugaccaccgacaucagcgagaugggggcgaacuuccgcgccgaccgggucaucgacccgcgccggugccugaagcccgugauccucaaggacggccccgagcgcgugauccuggccgggcccaugccggucacgguggccuccgccgcgcagcggcgcggccggaucggccgcaaccacaacaaggagggggaccaguacaucuacaugggccagccccugaacaacgacgaggaccacgcccacuggaccgaggccaagaugcuccuggacaacaucaacacccccgaggggaucauccccgcccuguucgagccggagcgcgagaaguccgccgcggucgacggcgaguaccggcuccgcggggaggcccggaagaccuucguggagcugaugcgccggggcgaccugcccguguggcucuccuacaaggucgccagcgagggcuuccaguacagcgaccgccgguggugcuucgacggggagcgcaacaaccaggugcuggaggagaacauggacguggagaucuggacgaaggagggcgagcggaagaagcugcgcccccgguggcucgacgcccgcaccuacuccgacccccuggcccugcgggaguucaaggaguucgcggccgggcgccggagcgucuccggcgaccucauccuggagaucggcaagcugccgcagcaccucacccagcgcgcccagaacgcccuggacaaccuggugaugcuccacaacagcgagcagggcgggcgggcguaccgccacgccauggaggagcugcccgacaccaucgagacgcugaugcuccuggcccugaucgccgugcucaccgggggcgucacccuguucuuccuguccgggcggggccucggcaagaccagcaucgggcugcugugcgugauggccuccagcgugcuccuguggauggcguccgucgagccccacuggaucgccgccagcaucauccuggaguucuuccucauggugcugcugauccccgagccggaccgccagcggacgccccaggacaaccagcucgccuacguggucaucggccugcuguucaugauccucacgguggccgcgaacgagauggggcugcuggagaccaccaagaaggaccucggcaucgggcacguggccgucgagaaccaccaccacgccgccaugcuggacguggaccugcaccccgccuccgcguggacccucuacgccguggccacgaccaucaucaccccgaugaugcgccacaccaucgagaacacgaccgccaacaucagccugaccgccaucgcgaaccaggccgccauccugaugggccucgacaagggcuggcccaucuccaagauggacaucggggucccccugcuggcccucggcugcuacagccaggugaacccccugacccugacggcggccgugcucaugcuggucgcccacuacgccaucaucgggccgggccugcaggccaaggcgacccgcgaggcccagaagcggaccgccgccgggaucaugaagaaccccaccguggacggcaucguggccaucgaccucgaccccgucguguacgacgcgaaguucgagaagcagcugggccagaucaugcugcucauccugugcacgucccagauccugcucaugcgcaccaccugggcccugugcgagagcaucacccuggccacggggccccucaccacccugugggagggcuccccggggaaguucuggaacaccacgaucgccgugagcauggccaacaucuuccggggcuccuaccuggcgggcgccgggcucgccuucagccugaugaagucccugggcgggggccgccgggggaccggcgcccagggcgagacccucggggagaaguggaagcgccagcugaaccagcuguccaagagcgaguucaacaccuacaagcgguccggcaucauggaggucgaccgcagcgaggcgaaggaggggcucaagcggggcgagacgaccaagcacgccgugucccgcgggaccgccaagcugcggugguucguggagcgcaaccuggucaagcccgagggcaaggugaucgaccugggcugcgggcggggcggguggagcuacuacugcgccggccucaagaaggugaccgaggucaagggguacacgaagggcggccccgggcacgaggagcccaucccgauggccaccuacggcuggaaccuggugaagcugcacuccgggaaggacguguucuucaucccgcccgagaagugcgacacccuccugugcgacaucggcgagagcucccccaacccgaccaucgaggaggggcgcacgcugcggguccucaagaugguggagcccuggcugcgcggcaaccaguucugcaucaagauccugaaccccuacaugcccagcguggucgagacccucgagcagaugcagcggaagcacggcgggaugcuggugcgcaacccgcugucccggaacagcacccacgagauguacuggguguccugcggcaccgggaacaucgucagcgcggugaacaugaccucccgcaugcuccugaaccgcuucacgauggcccaccggaagcccaccuacgagcgcgacguggaccugggcaccggcacccggcacgucgccguggagcccgagguggccaaccucgacaucaucgggcagcgcaucgagaacaucaagcacgagcacaagagcacguggcacuacgacgaggacaaccccuacaagaccugggccuaccacggcuccuacgaggucaagccgagcggguccgcgagcagcauggugaacggcgucgugaagcugcugaccaagcccugggacgugauccccauggucacccagaucgccaugacggacaccacccccuucgggcagcagcggguguucaaggagaagguggacacccgcacgccgaaggccaagcggggcaccgcccagaucauggaggucaccgcccgcuggcucuggggcuuccugucccggaacaagaagccccgcaucugcacccgggaggaguucacgcgcaaggugcggagcaacgcggccaucggggccguguucgucgacgagaaccaguggaacuccgccaaggaggcgguggaggacgagcgcuucugggaccuggugcaccgggagcgcgagcuccacaagcagggcaagugcgcgaccugcgucuacaacaugauggggaagcgggagaagaagcugggcgaguucgggaaggccaagggcagccgcgccaucugguacauguggcugggcgcccgguuccucgaguucgaggcgcugggguucaugaacgaggaccacugguucucccgcgagaacagccuguccggcguggagggggagggccuccacaagcugggguacauccugcgggacaucagcaagauccccggcggcaacauguacgccgacgacaccgccgggugggacacccgcaucacggaggacgaccuccagaacgaggccaagaucaccgacaucauggagccggagcacgcccugcuggcgaaggccaucuucaagcucaccuaccagaacaaggugguccgcgugcagcggcccgccaagaacggcaccgugauggacgucaucucccgccgggaccagcgcgggagcggccaggugggcacguacgggcugaacaccuucaccaacauggaggcccagcugauccggcagauggaguccgagggcaucuucagccccuccgagcucgagacccccaaccuggccgagcgcgcgcuggacuggcucgagaaguacgggguggagcggcugaagcgcauggccaucagcggcgacgacugcgucgugaagccgaucgacgaccgguucgccacggcccugaccgcccucaacgacauggggaaggugcgcaaggacaucccccagugggagcccuccaagggcuggaacgacuggcagcagguccccuucugcagccaccacuuccaccagcugaucaugaaggacggccgggagaucguggugccgugccgcaaccaggacgagcuggucgggcgggcgcgcgugucccagggcgccggguggagccuccgggagaccgccugccugggcaagagcuacgcccagauguggcagcugauguacuuccaccgccgggaccuccgccuggcggccaacgccaucugcuccgccgugcccgucgacugggugcccaccagccggacgaccugguccauccacgcccaccaccaguggaugaccaccgaggacaugcugagcguguggaaccgcgucuggaucgaggagaaccccuggauggaggacaagacgcacaucuccagcugggaggacgugccguaccucgggaagcgcgaggaccaguggugcggcucccugaucggccugaccgcgcgggccaccugggccaccaacauccagguggccaucaaccagguccgccggcucaucgggaacgagaacuaccugaacuacaugaccagcaugaagcgcuucaagaacgaguccgaccccgagggcgcccugugguga

SEQ ID NO: 8368 - RNA, 9879 nt, Artificial Sequence
  derived and/or modified CDS sequence (opt1) from DENV-1__FJ410203__SS-prME
agcgugaccaugcugcucaugcugaugcccaccgcccuggccuuccaccucaccacccgcggcggggagccccacaugaucgugagcaagcaggagcggggcaagagccugcuguucaagaccuccgccggggugaacaugugcacccucaucgccauggaccugggcgagcugugcgaggacacgaugaccuacaagugcccccgcaucaccgaggccgagcccgacgacguggacugcuggugcaacgccaccgacacgugggugaccuacgggaccugcagccagaccggcgagcaccggcgcgacaagcgguccguggcccucgcgccccacgugggccuggggcuggagacgcgcaccgagaccuggaugagcuccgagggcgccuggaagcagauccagcgggucgagaccugggcccuccgccaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcggugcugcggaagcucugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacaccggcgaccagcaccagguggggaacgaguccacggagcacggcaccaccgcgaccaucacgccccaggcccccacgaccgagauccagcucaccgacuacggggcccugacccuggacugcagcccccgcacgggccucgacuucaacgagaugguccugcugaccaugaaggagaaguccuggcucgugcacaagcagugguuccuggaccugccccuccccuggaccagcggggccagcaccucccaggagacguggaaccggcaggaccugcuggugaccuucaagaccgcccacgcgaagaagcaggaggucguggugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgucaugugcaccggguccuucaagcucgagaaggagguggcggagacgcagcacggcaccgugcugguccagaucaaguacgagggcaccgacgcccccugcaagauccccuucagcacccaggacgagaagggggugacgcagaacggccggcugaucaccgccaacccgaucgugaccgacaaggagaagcccgucaacaucgaggccgagccgcccuucggggaguccuacaucgugaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcgucgggaagcugauccaccagaucuucggcaccgccuacgggguccucuucuccggcgugagcuggaccaugaagaucgggaucggcguccugcugacguggcucggccugaacucccgcagcaccucccugagcaugaccugcaucgccguggggcucgugacccuguaccugggcgucauggugcaggccgacuccgggugcgugaucaacuggaagggccgggagcucaagugcgggagcggcaucuucgucacgaacgaggugcacaccuggaccgagcaguacaaguuccaggcggacagcccgaagcgccuguccgccgccaucggcaaggccugggaggagggggugugcggcauccggagcgccacccgccuggagaacaucauguggaagcagaucuccaacgagcucaaccacauccugcuggagaacgacaugaagcucaccgucguggugggggacgucgcgggcauccuggggcagggcaagaagaugauccggccccagcccauggaguacaaguacagcuggaaguccuggggcaaggccaagaucaucggggccgacgcccagaacacgaccuucaucaucgacggccccaacaccccggagugccccgacgaccagcgcgcguggaacaucugggagguggaggacuacggguucggcaucuucaccacgaacaucuggcugaagcuccgggacagcuacacccaggugugcgaccaccgccugauguccgccgccaucaaggacagcaaggccguccacgccgacaugggcuacuggaucgaguccgagaagaacgagaccuggaagcuggcgcgggccagcuucaucgaggugaagaccugcaucuggcccaagucccacacgcucuggagcaacggggugcuggaguccgagaugaucauccccaagaucuacggcgggccgaucagccagcacaacuaccgccccggcuacuucacccagaccgccgggcccuggcaccugggcaagcucgagcuggacuucgaccugugcgagggcaccacggucgugguggacgagcacugcgggaaccggggcccgucccuccgcaccaccaccgucacggggaagaucauccacgaguggugcugccggagcugcacccugccgccccugcgcuuccggggcgaggacgggugcugguacggcauggagauccgccccgugaaggagaaggaggagaaccucgugaaguccauggucagcgccggcagcggggagguggacuccuucagccugggccugcucugcaucuccaucaugaucgaggaggugaugcggagccgcuggucccggaagaugcugaugaccgggacccuggccgucuucuuccuccugaucaugggccagcugacguggaacgaccucauccgccugugcaucauggugggggcgaacgccuucgaccgcaugggcaugggcaccaccuaccuggcccucauggccaccuucaagaugcggccgauguucgccguggggcugcuguuccgccggcucacgagccgcgagguccugcugcucaccaucggccugucccugguggcgagcguggagcuccccaacucccuggaggagcugggggacggccucgccaugggcaucaugauccugaagcugcucaccgacuuccagagccaccagcugugggccacccugcucucccugacguucaucaagaccaccuucagccugcacuacgccuggaagaccauggcgaugguccucuccaucgugagccuguucccccugugccucuccacgaccagccagaagaccaccuggcugcccguccugcucgggucccugggcugcaagccgcugacgauguuccucaucgccgagaacaagaucugggggcggaaguccuggccccugaacgagggcaucauggccguggggaucguguccauccugcucagcagccugcugaagaacgacgucccccucgccggcccccugaucgccggcgggaugcugaucgcgugcuacgugaucuccggcagcuccgccgaccucagccuggagaaggccgccgagguguccugggaggaggaggccgagcacagcggggcgucccacaacauccuggucgaggugcaggacgacggcaccaugaagaucaaggacgaggagcgcgacgacacccucaccauccugcugaaggccacccuccuggccgugagcggggucuacccgcuguccauccccgccacccucuucgugugguacuucuggcagaagaagaagcagcggagcggcgugcugugggacacccccagcccgcccgaggucgagcgcgccgugcuggacgacggcaucuaccggaucaugcagcgcgggcugcucggccggagccaggugggggucggcguguuccaggagaacguguuccacaccauguggcacgucacccgcggggcggugcugauguaccagggcaagcggcuggagcccuccugggccagcgugaagaaggaccucaucuccuacggcgggggcuggcgccugcgggggagcuggaacacgggcgaggagguccaggugaucgccguggagcccgggaagaaccccaagaacguccagaccgcccccggcaccuucaagacccccgagggcgaggugggggccaucgcgcuggacuucaagcccggcacguccgggagccccaucgugaaccgcgagggcaagaucgucggccucuacgggaacggcguggugaccaccuccgggaccuacgucagcgccaucgcccaggccaaggcgagccaggagggcccgcugcccgagaucgaggacgagguguuccggaagcgcaaccugacgaucauggaccuccaccccggguccggcaagacccggcgcuaccugccggccaucgugcgggaggccaucaagcgcaagcugcgcacccucauccuggcccccacccgggucguggccagcgagauggcggaggcccugaagggcaugcccauccgcuaccagacgaccgccgugaaguccgagcacaccgggaaggagaucgucgaccucaugugccacgccaccuucacgaugcggcugcugagccccgugcgcgugccgaacuacaacaugaucaucauggacgaggcccacuucaccgaccccuccagcaucgcggcccggggcuacaucuccacccgcgucgggaugggcgaggccgccgccaucuucaugaccgcgacgccgcccgggagcguggaggccuucccgcaguccaacgccgugauccaggacgaggagcgggacauccccgagcgcagcuggaacuccggccacgaguggaucaccgacuuccccggcaagaccgucugguucgugcccagcaucaaguccgggaacgacaucgccaacugccuccggaagaacggcaagcgcgugauccagcugagccggaagaccuucgacacggaguaccagaagaccaagaacaacgacugggacuacgucgugaccaccgacaucuccgagaugggggcgaacuuccgcgccgaccgggugaucgacccgcgccggugccugaagcccgucauccucaaggacggccccgagcgcgugauccuggccgggcccaugccggugacggucgccagcgccgcgcagcggcgcggccggaucggccgcaaccacaacaaggagggggaccaguacaucuacaugggccagccccugaacaacgacgaggaccacgcccacuggaccgaggccaagaugcuccuggacaacaucaacacccccgaggggaucauccccgcccuguucgagccggagcgcgagaaguccgccgcgguggacggcgaguaccggcuccgcggggaggcccggaagaccuucgucgagcugaugcgccggggcgaccugcccguguggcucagcuacaagguggccuccgagggcuuccaguacagcgaccgccgguggugcuucgacggggagcgcaacaaccagguccuggaggagaacauggacguggagaucuggacgaaggagggcgagcggaagaagcugcgcccccgguggcucgacgcccgcaccuacagcgacccccuggcccugcgggaguucaaggaguucgcggccgggcgccgguccgugagcggcgaccucauccuggagaucggcaagcugccgcagcaccucacccagcgcgcccagaacgcccuggacaaccuggucaugcuccacaacuccgagcagggcgggcgggcguaccgccacgccauggaggagcugcccgacaccaucgagacgcugaugcuccuggcccugaucgccgugcucaccgggggcgugacccuguucuuccugagcgggcggggccucggcaagaccuccaucgggcugcugugcgucauggccagcuccgugcuccuguggauggcgagcguggagccccacuggaucgccgccuccaucauccuggaguucuuccucaugguccugcugauccccgagccggaccgccagcggacgccccaggacaaccagcucgccuacguggugaucggccugcuguucaugauccucacggucgccgcgaacgagauggggcugcuggagaccaccaagaaggaccucggcaucgggcacguggccguggagaaccaccaccacgccgccaugcuggacgucgaccugcaccccgccagcgcguggacccucuacgccguggccacgaccaucaucaccccgaugaugcgccacaccaucgagaacacgaccgccaacaucucccugaccgccaucgcgaaccaggccgccauccugaugggccucgacaagggcuggcccaucagcaagauggacaucggggugccccugcuggcccucggcugcuacucccaggucaacccccugacccugacggcggccgugcucaugcugguggcccacuacgccaucaucgggccgggccugcaggccaaggcgacccgcgaggcccagaagcggaccgccgccgggaucaugaagaaccccaccgucgacggcaucguggccaucgaccucgaccccguggucuacgacgcgaaguucgagaagcagcugggccagaucaugcugcucauccugugcacgagccagauccugcucaugcgcaccaccugggcccugugcgaguccaucacccuggccacggggccccucaccacccugugggagggcagcccggggaaguucuggaacaccacgaucgccguguccauggccaacaucuuccggggcagcuaccuggcgggcgccgggcucgccuucucccugaugaagucccugggcgggggccgccgggggaccggcgcccagggcgagacccucggggagaaguggaagcgccagcugaaccagcugagcaaguccgaguucaacaccuacaagcggagcggcaucauggagguggaccgcuccgaggcgaaggaggggcucaagcggggcgagacgaccaagcacgccgucagccgcgggaccgccaagcugcggugguucguggagcgcaaccuggugaagcccgagggcaaggucaucgaccugggcugcgggcggggcgggugguccuacuacugcgccggccucaagaaggugaccgaggugaagggguacacgaagggcggccccgggcacgaggagcccaucccgauggccaccuacggcuggaaccuggucaagcugcacagcgggaaggacguguucuucaucccgcccgagaagugcgacacccuccugugcgacaucggcgaguccagccccaacccgaccaucgaggaggggcgcacgcugcgggugcucaagauggucgagcccuggcugcgcggcaaccaguucugcaucaagauccugaaccccuacaugcccuccgugguggagacccucgagcagaugcagcggaagcacggcgggaugcugguccgcaacccgcugagccggaacuccacccacgagauguacugggugagcugcggcaccgggaacaucguguccgcggucaacaugaccagccgcaugcuccugaaccgcuucacgauggcccaccggaagcccaccuacgagcgcgacguggaccugggcaccggcacccggcacguggccgucgagcccgagguggccaaccucgacaucaucgggcagcgcaucgagaacaucaagcacgagcacaaguccacguggcacuacgacgaggacaaccccuacaagaccugggccuaccacggcagcuacgaggugaagccguccgggagcgcguccagcauggucaacggcguggucaagcugcugaccaagcccugggacgugauccccauggugacccagaucgccaugacggacaccacccccuucgggcagcagcgggucuucaaggagaagguggacacccgcacgccgaaggccaagcggggcaccgcccagaucauggaggugaccgcccgcuggcucuggggcuuccugagccggaacaagaagccccgcaucugcacccgggaggaguucacgcgcaagguccgguccaacgcggccaucggggccguguucguggacgagaaccaguggaacagcgccaaggaggcggucgaggacgagcgcuucugggaccuggugcaccgggagcgcgagcuccacaagcagggcaagugcgcgaccugcguguacaacaugauggggaagcgggagaagaagcugggcgaguucgggaaggccaagggcucccgcgccaucugguacauguggcugggcgcccgguuccucgaguucgaggcgcugggguucaugaacgaggaccacugguucagccgcgagaacucccugagcggcgucgagggggagggccuccacaagcugggguacauccugcgggacaucuccaagauccccggcggcaacauguacgccgacgacaccgccgggugggacacccgcaucacggaggacgaccuccagaacgaggccaagaucaccgacaucauggagccggagcacgcccugcuggcgaaggccaucuucaagcucaccuaccagaacaagguggugcgcguccagcggcccgccaagaacggcaccgugauggacgugaucagccgccgggaccagcgcggguccggccaggucggcacguacgggcugaacaccuucaccaacauggaggcccagcugauccggcagauggagagcgagggcaucuucucccccagcgagcucgagacccccaaccuggccgagcgcgcgcuggacuggcucgagaaguacgggguggagcggcugaagcgcauggccaucuccggcgacgacugcguggucaagccgaucgacgaccgguucgccacggcccugaccgcccucaacgacauggggaaggugcgcaaggacaucccccagugggagcccagcaagggcuggaacgacuggcagcagguccccuucugcucccaccacuuccaccagcugaucaugaaggacggccgggagaucgucgugccgugccgcaaccaggacgagcugguggggcgggcgcgcgucagccagggcgccggguggucccuccgggagaccgccugccugggcaagagcuacgcccagauguggcagcugauguacuuccaccgccgggaccuccgccuggcggccaacgccaucugcagcgccgugcccguggacuggguccccaccucccggacgaccuggagcauccacgcccaccaccaguggaugaccaccgaggacaugcuguccguguggaaccgcguguggaucgaggagaaccccuggauggaggacaagacgcacaucagcuccugggaggacgucccguaccucgggaagcgcgaggaccaguggugcggcagccugaucggccugaccgcgcgggccaccugggccaccaacauccagguggccaucaaccaggugcgccggcucaucgggaacgagaacuaccuggacuacaugaccuccaugaagcgcuucaagaacgagagcgaccccgagggcgcccugugguga

SEQ ID NO: 8369 - RNA, 9879 nt, Artificial Sequence
  derived and/or modified CDS sequence (opt1) from DENV-1__FJ410204__SS-prME
agcgugaccaugcugcucaugcugaugcccaccgcccuggccuuccaccucaccacccgcggcggggagccccacaugaucgugagcaagcaggagcggggcaagagccugcuguucaagaccuccgcgggggugaacaugugcacccucaucgccauggaccugggcgagcugugcgaggacacgaugaccuacaagugcccccgcaucaccgaggccgagcccgacgacguggacugcuggugcaacgccaccgacacgugggucaccuacgggaccugcagccagaccggcgagcaccggcgcgacaagcgguccguggcccucgcgccccacgugggccuggggcuggagacgcgcaccgagaccuggaugagcuccgagggcgccuggaagcagauccagcgggucgagaccugggcccuccgccaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcggugcugcggaagcucugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacaccggcgaccagcaccagguggggaacgaguccacggagcacggcaccaccgcgaccaucacgccccaggcccccacgaccgagauccagcucaccgacuacggggcccugacccuggacugcagcccccgcacgggccucgacuucaacgagaugguccugcugaccaugaaggagaaguccuggcucgugcacaagcagugguuccuggaccugccccuccccuggaccagcggggccagcaccucccaggagacguggaaccggcaggaccugcuggugaccuucaagaccgcccacgcgaagaagcaggaggucguggugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgucaugugcaccggguccuucaagcucgagaaggagguggcggagacgcagcacggcaccgugcugguccagaucaaguacgagggcaccgacgcccccugcaagauccccuucagcacccaggacgagaagggggugacgcagaacggccggcugaucaccgccaacccgaucgugaccgacaaggagaagcccgucaacaucgaggccgagccgcccuucggggaguccuacaucgugaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcgucgggaagcugauccaccagaucuucggcaccgccuacggggugcuguucuccggcgugagcuggaccaugaagaucgggaucggcguccugcugacguggcucggccugaacucccgcagcaccucccugagcaugaccugcaucgccguggggcucgugacccuguaccugggcgucauggugcaggccgacuccgggugcgugaucaacuggaagggccgggagcucaagugcgggagcggcaucuucgucacgaacgagguguacaccuggaccgagcaguacaaguuccaggcggacagcccgaagcgccuguccgccgccaucggcaaggccugggaggagggggugugcggcauccggagcgccacccgccuggagaacaucauguggaagcagaucuccaacgagcucaaccacauccugcuggagaacgacaugaagcucaccgucguggugggggacgucgcgggcauccuggggcagggcaagaagaugauccggccccagcccauggaguacaaguacagcuggaaguccuggggcaaggccaagaucaucggggccgacgcccagaacacgaccuucaucaucgacggccccaacaccccggagugccccgacgaccagcgcgcguggaacaucugggagguggaggacuacggguucggcaucuucaccacgaacaucuggcugaagcuccgggacagcuacacccaggugugcgaccaccgccugauguccgccgccaucaaggacagcaaggccguccacgccgacaugggcuacuggaucgaguccgagaagaacgagaccuggaagcuggcgcgggccagcuucaucgaggugaagaccugcaucuggcccaagucccacacgcucuggagcaacggggugcuggaguccgagaugaucauccccaagaucuacggcgggccgaucagccagcacaacuaccgccccggcuacuucacccagaccgccgggcccuggcaccugggcaagcucgagcuggacuucgaccugugcgagggcaccacggucgugguggacgagcacugcgggaaccggggcccgucccuccgcaccaccaccgucacggggaagaucauccacgaguggugcugccggagcugcacccugccgccccugcgcuuccggggcgaggacgggugcugguacggcauggagauccgccccgugaaggagaaggaggagaaccucgugaaguccauggucagcgccggcagcggggagguggacuccuucagccugggccugcucugcaucuccaucaugaucgaggaggugaugcggagccgcuggucccggaagaugcugaugaccgggacccuggccgucuucuuccuccugaucaugggccagcugacguggaacgaccucauccgccugugcaucauggugggggcgaacgccuucgaccgcaugggcaugggcaccaccuaccuggcccucauggccaccuucaagaugcggccgauguucgccguggggcugcuguuccgccggcucacgagccgcgagguccugcugcucaccaucggccugucccugguggcgagcguggagcuccccaacucccuggaggagcugggggacggccucgccaugggcaucaugauccugaagcugcucaccgacuuccagagccaccagcugugggccacccugcucucccugacguucaucaagaccaccuucagccugcacuacgccuggaagaccauggcgaugguccucuccaucgugagccuguucccccugugccucuccacgaccagccagaagaccaccuggcugcccguccugcucgggucccugggcugcaagccgcugacgauguuccucaucgccgagaacaagaucugggggcggaaguccuggccccugaacgagggcaucauggccguggggaucguguccauccugcucagcagccugcugaagaacgacgucccccucgccggcccccugaucgccggcgggaugcugaucgcgugcuacgugaucuccggcagcuccgccgaccucagccuggagaaggccgccgagguguccugggaggaggaggccgagcacagcggggcgucccacaacauccuggucgaggugcaggacgacggcaccaugaagaucaaggacgaggagcgcgacgacacccucaccauccugcugaaggccacccuccuggccgugagcggggucuacccgcuguccauccccgccacccucuucgugugguacuucuggcagaagaagaagcagcggagcggcgugcugugggacacccccagcccgcccgaggucgagcgcgccgugcuggacgacggcaucuaccggaucaugcagcgcgggcugcucggccggagccaggugggggucggcguguuccaggagaacguguuccacaccauguggcacgucacccgcggggcggugcugauguaccagggcaagcggcuggagcccuccugggccagcgugaagaaggaccucaucuccuacggcgggggcuggcgccugcgggggagcuggaacacgggcgaggagguccaggugaucgccguggagcccgggaagaaccccaagaacguccagaccgcccccggcaccuucaagacccccgagggcgaggugggggccaucgcgcuggacuucaagcccggcacguccgggagccccaucgugaaccgcgagggcaagaucgucggccucuacgggaacggcguggugaccaccuccgggaccuacgucagcgccaucgcccaggccaaggcgagccaggagggcccgcugcccgagaucgaggacgagguguuccggaagcgcaaccugacgaucauggaccuccaccccggguccggcaagacccggcgcuaccugccggccaucgugcgggaggccaucaagcgcaagcugcgcacccucauccuggcccccacccgggucguggccagcgagauggcggaggcccugaagggcaugcccauccgcuaccagacgaccgccgugaaguccgagcacaccgggaaggagaucgucgaccucaugugccacgccaccuucacgaugcggcugcugagccccgugcgcgugccgaacuacaacaugaucaucauggacgaggcccacuucaccgaccccuccagcaucgcggcccggggcuacaucuccacccgcgucgggaugggcgaggccgccgccaucuucaugaccgcgacgccgcccgggagcguggaggccuucccgcaguccaacgccgugauccaggacgaggagcgggacauccccgagcgcagcuggaacuccggccacgaguggaucaccgacuuccccggcaagaccgucugguucgugcccagcaucaaguccgggaacgacaucgccaacugccuccggaagaacggcaagcgcgugauccagcugagccggaagaccuucgacacggaguaccagaagaccaagaacaacgacugggacuacgucgugaccaccgacaucuccgagaugggggcgaacuuccgcgccgaccgggugaucgacccgcgccggugccugaagcccgucauccucaaggacggccccgagcgcgugauccuggccgggcccaugccggugacggucgccagcgccgcgcagcggcgcggccggaucggccgcaaccacaacaaggagggggaccaguacaucuacaugggccagccccugaacaacgacgaggaccacgcccacuggaccgaggccaagaugcuccuggacaacaucaacacccccgaggggaucauccccgcccuguucgagccggagcgcgagaaguccgccgcgguggacggcgaguaccggcuccgcggggaggcccggaagaccuucgucgagcugaugcgccggggcgaccugcccguguggcucagcuacaagguggccuccgagggcuuccaguacagcgaccgccgguggugcuucgacggggagcgcaacaaccagguccuggaggagaacauggacguggagaucuggacgaaggagggcgagaccaagaagcugcggcaccgcuggcccgacgcccggcaguacagcgacccccucgggcugcgcgaguucaaggaguucgccgcgggccggcgcuccgugagcggcgaccugauccucgagaucgggaagcugccgcagcaccugacccagcgggcccagaacgcccucgacaaccuggucaugcugcacaacuccgagcagggcgggcgcgccuaccggcacgcgauggaggagcuccccgacaccaucgagacgcugaugcugcucgcccugaucgccgugcugaccggcggggugacccucuucuuccugagcggccgcggccuggggaagaccuccaucggccuccugugcgucauggccagcuccgugcugcucuggauggccagcguggagccccacuggaucgcggccuccaucauccuggaguucuuccugaugguccuccugauccccgagccggaccggcagcgcacgccccaggacaaccagcuggccuacguggugaucgggcuccuguucaugauccugacggucgccgccaacgagaugggccuccuggagaccaccaagaaggaccuggggaucggccacguggcgguggagaaccaccaccacgccgccaugcucgacgucgaccugcaccccgccagcgccuggacccuguacgcgguggccacgaccaucaucaccccgaugaugcggcacaccaucgagaacacgaccgccaacaucucccucaccgccaucgccaaccaggcggccauccugaugggccuggacaagggguggcccaucagcaagauggacaucggcgugccccuccuggcccuggggugcuacucccaggucaacccccucacccugacggccgcggugcugaugcucguggcccacuacgccaucaucggcccggggcugcaggccaaggccacccgcgaggcgcagaagcgcaccgccgccggcaucaugaagaaccccaccgucgacggcaucguggccaucgaccuggaccccguggucuacgacgccaaguucgagaagcagcucgggcagaucaugcugcugauccucugcacgagccagauccugcugaugcggaccaccugggcgcucugcgaguccaucacccuggccacgggcccccugaccacccucugggaggggagcccgggcaaguucuggaacaccacgaucgccguguccauggccaacaucuuccgcggcagcuaccuggccggggcgggccuggccuucucccucaugaagucccucgggggcgggcggcgcgggaccggcgcccagggggagacccugggcgagaaguggaagcggcagcucaaccagcugagcaaguccgaguucaacaccuacaagcgcagcgggaucauggagguggaccgguccgaggccaaggagggccugaagcgcggggagacgaccaagcacgcggucagccggggcaccgccaagcuccgcugguucguggagcggaaccuggugaagcccgagggcaaggucaucgaccuggggugcggccgcgggggcugguccuacuacugcgccgggcugaagaaggugaccgaggugaagggcuacacgaagggcgggcccggccacgaggagcccaucccgauggccaccuacggguggaaccucgucaagcugcacagcggcaaggacguguucuucaucccgcccgagaagugcgacacccugcucugcgacaucggggaguccagccccaacccgaccaucgaggagggccggacgcugcgcgugcugaagauggucgagcccuggcuccggggcaaccaguucugcaucaagauccugaaccccuacaugcccuccgugguggagacccuggagcagaugcagcgcaagcacgggggcaugcucguccggaacccgcugagccgcaacuccacccacgagauguacugggugagcugcgggaccggcaacaucguguccgccgucaacaugaccagccggaugcugcucaaccgcuucacgauggcgcaccgcaagcccaccuacgagcgggacguggaccugggcaccgggacccgccacguggccgucgagcccgagguggccaaccuggacaucaucggccagcggaucgagaacaucaagcacgagcacaaguccacguggcacuacgacgaggacaaccccuacaagaccugggccuaccacgggagcuacgaggugaagccguccggcagcgccuccagcauggucaacgggguggucaagcuccugaccaagcccugggacgugauccccauggugacccagaucgcgaugacggacaccacccccuucggccagcagcgcgucuucaaggagaagguggacacccggacgccgaaggccaagcgcggcaccgcccagaucauggaggugaccgcccgguggcuguggggguuccucagccgcaacaagaagccccggaucugcacccgcgaggaguucacgcggaagguccgcuccaacgccgcgaucggcgccguguucguggacgagaaccaguggaacagcgccaaggaggccgucgaggacgagcgguucugggaccuggugcaccgcgagcgggagcugcacaagcaggggaagugcgcgaccugcguguacaacaugaugggcaagcgcgagaagaagcucggggaguucggcaaggccaagggcucccgggccaucugguacauguggcugggggcccgcuuccuggaguucgaggcccucggcuucaugaacgaggaccacugguucagccgggagaacucccugagcggggucgagggcgaggggcugcacaagcucggcuacauccugcgcgacaucuccaagauccccggcgggaacauguacgcggacgacaccgccggcugggacacccggaucacggaggacgaccugcagaacgaggccaagaucaccgacaucauggagccggagcacgcccuccuggccaaggcgaucuucaagcugaccuaccagaacaagguggugcgcguccagcgccccgccaagaacgggaccgugauggacgugaucagccggcgcgaccagcggggcuccggccaggucgggacguacggccucaacaccuucaccaacauggaggcccagcugauccgccagauggagagcgaggggaucuucucccccagcgagcuggagacccccaaccucgccgagcgggcccuggacuggcuggagaaguacggcguggagcgccucaagcggauggcgaucuccggggacgacugcguggucaagccgaucgacgaccgcuucgccacggcccugaccgcccugaacgacaugggcaaggugcggaaggacaucccccagugggagcccagcaagggcuggaacgacuggcagcagguccccuucugcucccaccacuuccaccagcucaucaugaaggacgggcgcgagaucgucgugccgugccggaaccaggacgagcuggugggccgcgcccgggucagccagggggcgggcuggucccugcgcgagaccgccugccucggcaagagcuacgcccagauguggcagcugauguacuuccaccggcgcgaccugcggcucgccgcgaacgccaucugcagcgccgugcccguggacuggguccccaccucccgcacgaccuggagcauccacgcccaccaccaguggaugaccaccgaggacaugcuguccguguggaaccggguguggaucgaggagaaccccuggauggaggacaagacgcacaucagcuccugggaggacgucccguaccugggcaagcgcgaggaccaguggugcggcagccucaucgggcugaccgcccgcgcgaccugggccaccaacauccagguggccaucaaccaggugcggcgccugaucggcaacgagaacuaccucgacuacaugaccuccaugaagcgguucaagaacgagagcgaccccgagggggcccugugguga

SEQ ID NO: 8370 - RNA, 9879 nt, Artificial Sequence
  derived and/or modified CDS sequence (opt1) from DENV-1__FJ432742__SS-prME
agcgugaccaugcugcucaugcugaugcccaccgcccuggccuuccaccucaccacccggggcggggagccccacaugaucgugaccaagcaggagcggggcaagagccugcuguucaagaccagcgccggggugaacaugugcacccucaucgccauggaccugggcgagcugugcgaggacaccaugaccuacaagugcccccggaucaccgaggccgagcccgacgacguggacugcuggugcaacgccaccgacaccugggugaccuacgggaccugcagccagacgggcgagcaccggcgcgacaagcggagcguggcccucgcgccccacgugggccuggggcuggagacccgcaccgagaccuggauguccagcgagggcgccuggaagcagauccagcgggucgagacgugggcccuccgccaccccggguucaccgugaucgcccuguuccuggcgcacgccaucggcaccuccaucacccagaaggggaucaucuucauccuccugaugcuggugacgcccagcauggccaugcggugcgucggcaucggcucccgcgacuucguggaggggcucagcggcgccaccuggguggacgucgugcuggagcacggguccugcgugaccaccauggccaaggacaagcccacgcuggacaucgagcuccugaagaccgaggucaccaaccccgcggugcugcggaagcucugcaucgaggccaagaucagcaacaccacgaccgacucccgcugccccacccagggcgaggccacccugauggaggagcaggacgccaacuucgugugccggcgcacguucgucgaccggggcugggggaacggcugcgggcuguucggcaaggggagccucaucacgugcgccaaguucaagugcgugaccaagcuggagggcaagaucgugcaguacgagaaccugaaguacuccgucaucgugaccgugcacacgggcgaccagcaccaggucgggaacgagagcaccgagcacggcaccaccgcgaccaucacgccccaggcccccaccuccgagauccagcucaccgacuacggggcccugacccuggacugcagcccccgcacgggccucgacuucaacgagauggugcugcugaccaugaaggagaaguccuggcucguccacaagcagugguuccuggaccugccgcuccccuggaccagcggggccagcaccucccaggagacguggaaccggcaggaccugcuggugaccuucaagaccgcccacgcgaagaagcaggagguggucgugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgugaugugcaccggguccuucaagcucgagaaggaggucgcggagacgcagcacggcaccgugcuggugcagaucaaguacgagggcaccgacgcccccugcaagauccccuucagcacccaggacgagaagggggucacgcagaacggccggcugaucaccgccaacccgaucgugaccgacaaggagaagcccgugaacaucgaggccgagccgcccuucggggaguccuacaucgucaucggcgcgggcgagaaggcccugaagcucagcugguucaagaagggguccagcaucggcaagauguucgaggccaccgcccgcggggcccggcgcauggcgauccugggcgacacggccugggacuucggguccgugggcggcguguucaccagcgucgggaagcuggugcaccagaucuucggcaccgccuacgggguccuguucuccggcgucagcuggaccaugaagaucgggaucggcgugcugcugacguggcucggccugaacucccgcagcaccucccugagcaugaccugcaucgccguggggcucgucacccuguaccugggcgugauggugcaggccgacuccgggugcgucaucaacuggaagggccgggagcucaagugcgggagcggcaucuucgugacgaacgaggugcacaccuggaccgagcaguacaaguuccaggcggacagcccgaagcgccuguccgccgccaucggcaaggccugggaggagggggucugcggcauccggagcgccacccgccuggagaacaucauguggaagcagaucuccaacgagcucaaccacauccugcuggagaacgacaugaaguucaccgugguggucggggacguggugggcauccucgcgcaggggaagaagaugauccggccccagcccauggagcacaaguacagcuggaaguccuggggcaaggccaagaucaucggcgccgacguccagaacacgaccuucaucaucgacgggcccaacaccccggagugccccgacgaccagcgcgccuggaacaucugggagguggaggacuacggcuucgggaucuucaccacgaacaucuggcugaagcugcgggacagcuacacccaggugugcgaccaccgccucauguccgcggccaucaaggacagcaaggccguccacgccgacaugggcuacuggaucgaguccgagaagaacgagaccuggaagcuggcccgggcgagcuucaucgaggugaagaccugcaucuggcccaagucccacacgcuguggagcaacggcgugcucgaguccgagaugaucauccccaagaucuacgggggcccgaucagccagcacaacuaccgccccggguacuucacccagaccgccggccccuggcaccuggggaagcuggagcucgacuucgaccugugcgagggcaccacggucgugguggacgagcacugcggcaaccgggggccgucccugcgcaccaccaccgucacgggcaagaucauccacgaguggugcugccggagcugcacccugccgccccuccgcuucaagggggaggacggcugcugguacgggauggagauccggcccgugaaggagaaggaggagaaccuggugaaguccauggucagcgccggcagcggcgagguggacuccuucagccucgggcugcugugcaucuccaucaugaucgaggaggugaugcgcagccgguggucccgcaagaugcucaugaccggcacccuggccgucuuccugcuccugaucauggggcagcugacguggaacgaccucauccggcugugcaucauggugggcgccaacgcgagcgaccgcauggggaugggcaccaccuaccuggcccucauggccaccuucaagaugcgcccgauguucgccguggggcugcuguuccggcgccucacgucccgggagguccugcugcucaccaucgggcugagccugguggccuccgucgagcuccccaacagccuggaggagcugggcgacgggcucgcgaugggcaucaugauccugaagcugcucaccgacuuccagucccaccagcugugggccacccugcucagccugacguucaucaagaccacccugucccuccacuacgccuggaagaccauggccauggugcugagcaucgugucccuguucccccucugccugagcacgaccucccagaagaccaccuggcugcccguccuccugggcagccuggggugcaagccgcucacgauguuccugaucaccgagaacaagaucuggggccgcaaguccuggccccugaacgaggggaucauggcggugggcguggucagcauccuccugagcucccugcucaagaacgacgugccccuggccgggccccugaucgccggcggcaugcucaucgccugcuacgugaucagcggguccagcgccgaccugucccuggagaaggcggccgaggucagcugggaggaggaggccgagcacuccggcgccagccacaacauccucguggaggugcaggacgacgggaccaugaagaucaaggacgaggagcgggacgacacccugaccauccugcucaaggccacgcugcuggcggucuccggcguguacccgcucagcauccccgccacccuguucgugugguacuucuggcagaagaagaagcagcgcuccgggguccugugggacacccccagcccgcccgagguggagcgggccgugcuggacgacggcaucuaccgcaucaugcagcggggccuccuggggcgcucccaggucggcguggggguguuccaggagaacgucuuccacaccauguggcacgugacgcggggcgccgugcugauguaccaggggaagcgccucgagcccagcugggccuccgucaagaaggaccugaucagcuacggcggcggguggcggcugcagggcuccuggaacaccggggaggagguccaggugaucgcggucgagcccggcaagaaccccaagaacgugcagaccgcccccgggaccuucaagacgcccgagggcgaggugggcgccaucgcccucgacuucaagcccgggaccagcggcucccccaucgucaaccgcgaggggaagaucgugggccuguacggcaacgggguggucaccaccagcggcacguacgugagcgccaucgcgcaggccaaggccucccaggaggggccgcugcccgagaucgaggacgagguguuccggaagcgcaaccucaccaucauggaccugcaccccggcagcgggaagacccggcgcuaccugccggccaucguccgggaggcgaucaagcgcaagcuccggacccugauccuggcccccacgcgcgugguggccuccgagauggccgaggcccucaagggcaugcccauccgcuaccagaccaccgcggucaagagcgagcacaccggcaaggagaucguggaccugaugugccacgccacguucaccaugcggcugcucucccccgugcgcgucccgaacuacaacaugaucaucauggacgaggcccacuucaccgaccccagcuccaucgccgcccggggguacaucagcacccgcgugggcaugggggaggcggccgccaucuucaugacggccacgccgcccggcuccguggaggccuucccgcagagcaacgcggucauccaggacgaggagcgggacauccccgagcgcuccuggaacagcggguacgaguggaucaccgacuuccccggcaagaccgugugguucgugcccuccaucaagagcggcaacgacaucgccaacugccugcggaagaacgggaagcgcgucauccagcugucccggaagacguucgacaccgaguaccagaagaccaagaacaacgacugggacuacguggugaccacggacaucagcgagaugggcgccaacuuccgcgccgaccgggucaucgacccgcgccggugccucaagcccgugauccugaaggacgggcccgagcgcgucauccuggcgggccccaugccggugaccguggccuccgccgcccagcggcgcgggcggaucggccgcaaccacaacaaggagggcgaccaguacaucuacauggggcagccccucaacaacgacgaggaccacgcccacuggaccgaggcgaagaugcugcuggacaacaucaacacccccgagggcaucauccccgcccucuucgagccggagcgggagaaguccgccgccaucgacggggaguaccgccugcgcggcgaggcccggaagacguucgucgagcugaugcgccgcggggaccuccccguguggcuguccuacaagguggcgagcgagggcuuccaguacagcgaccgccgguggugcuucgacggcgagcgcaacaaccagguccuggaggagaacauggacguggagaucuggaccaaggagggggagcggaagaagcuccgcccccgguggcuggacgcccgcaccuacuccgacccccuggcccuccgggaguucaaggaguucgccgccggccgccggagcguguccggggaccugauccuggagaucggcaagcucccgcagcaccugacccagcgcgcgcagaacgcccuggacaaccucgucaugcugcacaacagcgagcagggcgggcgggccuaccgccacgccauggaggagcugcccgacacgaucgagacccucaugcugcuggcgcucaucgccgugcugaccggcggggugacccuguucuuccucuccggccgggggcugggcaagaccagcaucggccugcucugcgucauggccuccagcgugcugcuguggauggccuccguggagccccacuggaucgccgcgagcaucauccucgaguucuuccugaugguccugcucauccccgagccggaccgccagcggacgccccaggacaaccagcuggccuacguggugaucgggcuccucuucaugauccugaccgucgccgccaacgagaugggccugcucgagaccaccaagaaggaccuggggaucggccacguggccguggagaaccaccaccacgcgacgaugcuggacgucgaccuccaccccgccuccgccuggacccuguacgccguggccaccaccaucaucacgccgaugaugcgccacaccaucgagaacaccaccgcgaacaucagccugacggccaucgccaaccaggccgccauccucauggggcuggacaagggcuggcccaucuccaagauggacaucggcgugccccugcucgcgcuggggugcuacagccaggucaacccccugacccucaccgccgccgugcugaugcugguggcccacuacgcgaucaucggcccggggcuccaggccaaggccacccgggaggcccagaagcgcacggccgcgggcaucaugaagaaccccaccgucgacgggaucguggccaucgaccuggaccccguggucuacgacgccaaguucgagaagcagcugggccagaucaugcuccugauccugugcaccucccagauccuccugaugcgcaccacgugggcccugugcgagagcaucacccucgccaccggcccccugaccacgcugugggagggguccccgggcaaguucuggaacaccaccaucgcggugagcauggccaacaucuuccggggguccuaccucgccggcgccggccuggccuucagccugaugaagucccucgggggcgggcgccggggcaccggggcgcagggcgagacgcugggcgagaaguggaagcgccagcugaaccagcucuccaagagcgaguucaacaucuacaagcgguccgggaucauggagguggaccgcagcgaggccaaggagggccugaagcgcggggagaccacccgccacgccgucucccggggcaccgccaagcugcgcugguucguggagcggaaccuggugaagcccgaggggaaggucaucgaccucggcugcggccgcgggggcuggagcuacuacugcgcggggcugaagaaggugacggaggugaagggcuacaccaagggcgggcccggccacgaggagcccaucccgauggccaccuacggguggaaccuggucaagcuccacuccggcaaggacguguucuucacgccgcccgagaagugcgacacgcugcugugcgacaucggggagagcucccccaacccgaccaucgaggagggccggacccuccgcgugcugaagauggucgagcccuggcugcgggggaaccaguucugcaucaagauccucaaccccuacaugcccagcgugguggagacccuggagcagaugcagcgcaagcacggcggcaugcugguccggaacccgcucucccgcaacagcacccacgagauguacuggguguccugcgggacgggcaacaucgugagcgccgucaacaugaccucccggaugcugcugaaccgcuucaccauggcccaccgcaagcccaccuacgagcgggacguggaccucggggccggcacgcgccacguggcggucgagcccgagguggccaaccuggacaucaucggccagcggaucgagaacaucaagcacgagcacaagagcaccuggcacuacgacgaggacaaccccuacaagaccugggccuaccacggguccuacgaggucaagccgagcggcuccgccagcagcauggugaacgggguggucaagcugcucaccaagcccugggacgugauccccauggugacgcagaucgccaugaccgacaccacccccuucggccagcagcgcgucuucaaggagaagguggacacgcggaccccgaaggcgaagcgcgggaccgcccagaucauggaggugaccgcccgguggcuguggggcuuccugucccgcaacaagaagccccggaucugcacgcgcgaggaguucacccggaagguccgcagcaacgccgccaucggcgcgguguucguggacgagaaccaguggaacuccgccaaggaggccgucgaggacgagcgguucugggaccucgugcagaaggagcgcgagcugcacaagcaggggaagugcgcgaccugcguguacaacaugaugggcaagcgggagaagaagcugggggaguucggcaaggcgaaggggagccgcgccaucugguacauguggcucggcgcccgguuccuggaguucgaggcccugggcuucaugaacgaggaccacugguucucccgcgagaacagccucuccggggucgagggcgaggggcugcacaagcugggcuacauccuccgggacaucagcaagauccccgggggcaacauguacgccgacgacaccgcgggcugggacacgcgcaucaccgaggacgaccugcagaacgaggccaagaucaccgacaucauggagccggagcacgcccugcucgccaccuccaucuucaagcugacguaccagaacaagguggugcggguccagcgccccgccaagaacgggaccgugauggacgugaucagccgccgggaccagcgcggcuccgggcaggucggcaccuacggccugaacaccuucacgaacauggaggcgcagcucauccggcagauggagagcgaggggaucuuccugcccuccgagcuggagacccccaaccucgccgagcgcgugcuggacuggcuggagaaguacggcguggagcggcucaagcgcauggccaucagcggggacgacugcgucgugaagccgaucgacgaccgguucgccaccgcccugaccgcgcugaacgacaugggcaaggugcgcaaggacaucccccagugggagcccuccaagggguggaacgacuggcagcagguccccuucugcagccaccacuuccaccagcucaucaugaaggacggccgggagaucguggugccgugccgcaaccaggacgagcuggucggccgggcccgcgugucccagggggccggcuggagccugcgggagacggccugccucggcaagagcuacgcccagauguggcagcugauguacuuccaccgccgggaccugcgccucgcggccaacgccaucugcuccgccgugcccgucgacugggugcccaccagccggaccaccugguccauccacgcgcaccaccaguggaugacgaccgaggacaugcugagcguguggaaccgcgucuggaucgaggagaaccccuggauggaggacaagacccacguguccagcuggggcgacgugccguaccuggggaagcgggaggaccaguggugcggcucccucaucggccugaccgcccgcgccaccugggccagcaacauccaggucgccaucaaccaggugcgccggcugaucgggaacgagaacuaccucgacuacaugacguccaugaagcgcuucaagaacgagggcgaccccgagggggcgcugugguga

SEQ ID NO: 8371 - RNA, 9879 nt, Artificial Sequence
  derived and/or modified CDS sequence (opt1) from DENV-1__FJ410205__SS-prME
agcgugaccaugcugcugaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgagaccgagcccgacgacguggacugcuggugcaacgccacggacaccugggugaccuacgggaccugcagccagacgggcgagcaccggcgggacaagcgguccguggcccucgcgccccacgugggccuggggcuggagacccgcaccgagaccuggaugagcuccgagggcgccuggaagcagauccagcgggucgagacgugggcccuccggcaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagcuggccgagacccagcacggcaccgugcuggugcagaucaaguacgagggcaccgacgcgcccugcaagauccccuucagcacgcaggacgagaagggggucacccagaacggccggcugaucaccgccaacccgaucgugaccgacaaggagaagcccgugaacaucgaggccgagccgcccuucggggaguccuacaucgucaucggcgccggcgagaaggcgcucaagcugagcugguucaagaagggguccagcaucggcaagauguucgaggccacggcccgcggggcccggcgcauggccauccugggcgacaccgcgugggacuucggguccaucggcggcguguucaccagcgccgggaagcucgugcaccagaucuucggcaccgccuacgggguccuguucuccggcgugagcuggacgaugaagaucgggaucggcgugcugcucaccuggcugggccugaacucccgcagcaccucccucagcaugaccugcaucgccgucgggcuggugacgcuguaccucggcgugaugguccaggccgacuccgggugcgugaucaacuggaagggccgggagcugaagugcgggagcggcaucuucgugaccaacgagguccacaccuggaccgagcaguacaaguuccaggcggacagcccgaagcgccuguccgccgccaucggcaaggccugggaggagggggugugcggcauccggagcgccacccgccucgagaacaucauguggaagcagaucuccaacgagcugaaccacauccugcucgagaacgacaugaaguucacgguggucgugggggacguggcgggcauccuggcccaggggaagaagaugauccggccccagcccauggaguacaaguacagcuggaaguccuggggcaaggccaagaucaucggcgccgacguccagaacaccaccuucaucaucgacgggcccaacaccccggagugccccgacgaccagcgcgcguggaacaucugggagguggaggacuacggcuucgggaucuucacgaccaacaucuggcugaagcuccgggacagcuacacccaggugugcgaccaccgccugauguccgccgccaucaaggacagcaaggccguccacgccgacaugggcuacuggaucgaguccgagaagaacgagaccuggaagcuggcgcgggccagcuucaucgaggugaagacgugcaucuggcccaagucccacacccucuggagcaacggcgugcuggaguccgagaugaucauccccaagaucuacgggggcccgaucagccagcacaacuaccgccccggguacuucacccagaccgccggccccuggcaccuggggaagcucgagcuggacuucgaccugugcgagggcacgaccgucgugguggacgagcacugcggcaaccgggggccgucccuccgcaccaccacggucaccggcaagaucauccacgaguggugcugccggagcugcacccugccgccccugcgcuuccgcggggaggacggcugcugguacgggauggagauccgccccgugaaggagaaggaggagaaccucgugaaguccauggucagcgccggcagcggcgagguggacuccuucagccuggggcugcucugcaucuccaucaugaucgaggaggugaugcggagccgcuggucccggaagaugcugaugaccggcacgcuggccgucuucuuccuccugaucauggggcagcugaccuggaacgaccucauccgccugugcaucauggugggcgcgaacgccagcgaccgcauggggaugggcaccaccuaccuggcccucauggccacguucaagaugcggccgauguucgccgugggccugcuguuccgccggcucaccucccgcgagguccugcugcucaccaucgggcugagccugguggcguccguggagcuccccaacagccuggaggagcugggcgacgggcucgccaugggcaucaugauccugaagcugcucaccgacuuccagucccaccagcugugggccacgcugcucagccugaccuucaucaagaccaccuucucccugcacuacgccuggaagacgauggcgaugguccucagcaucgugucccuguucccccugugccucagcaccaccucccagaagaccacguggcugcccguccugcucggcagccuggggugcaagccgcugaccauguuccucaucgccgagaacaagaucuggggccggcgcuccuggccccugaacgaggggaucauggccgugggcaucgugagcauccugcucagcucccugcugaagaacgacgucccccucgccgggccccugaucgccggcggcaugcugaucgcgugcuacgugaucagcggguccagcgccgaccucucccuggagaaggccgccgaggugagcugggaggaggaggccgagcacuccggcgcgagccacaacauccuggucgaggugcaggacgacgggaccaugaagaucaaggacgaggagcgggacgacacccucaccauccugcugaaggccacgcuccuggccguguccggcgucuacccgcugagcauccccgccacccucuucgugugguacuucuggcagaagaagaagcagcgcuccggggugcugugggacacccccagcccgcccgaggucgagcgggccgugcuggacgacggcaucuaccgcaucaugcagcggggccugcucgggcgcucccaggugggcgucgggguguuccaggagaacguguuccacaccauguggcacgucacgcggggcgcggugcugauguaccaggggaagcgccuggagcccagcugggccuccgugaagaaggaccucaucagcuacggcggcggguggcggcugcagggcuccuggaacaccggggaggagguccaggugaucgccguggagcccggcaagaaccccaagaacguccagaccgcccccgggaccuucaagacgcccgagggcgaggugggcgccaucgcgcuggacuucaagcccgggaccagcggcucccccaucgugaaccgcgaggggaagaucgucggccucuacggcaacgggguggugaccaccagcggcacguacgucagcgccaucgcccaggccaaggcgucccaggaggggccgcugcccgagaucgaggacgagguguuccggaagcgcaaccugaccaucauggaccuccaccccggcagcgggaagacccggcgcuaccugccggccaucgugcgggaggccaucaagcgcaagcugcgcacccucauccuggcccccacgcgggucguggccuccgagauggcggaggcccugaagggcaugcccauccgcuaccagaccaccgccgucaagagcgagcacaccggcaaggagaucgucgaccucaugugccacgccacguucaccaugcggcugcugucccccgugcgcgugccgaacuacaacaugaucaucauggacgaggcccacuucaccgaccccagcuccaucgcggcccggggguacaucagcacccgcgucggcaugggggaggccgccgccaucuucaugacggcgacgccgcccggcuccguggaggccuucccgcagagcaacgccgugauccaggacgaggagcgggacauccccgagcgcuccuggaacagcggguacgaguggaucaccgacuuccccggcaagaccgucugguucgugcccuccaucaagagcggcaacgacaucgccaacugccuccggaagaacgggaagcgcgugauccagcugucccggaagacguucgacaccgaguaccagaagaccaagaacaacgacugggacuacgucgugaccacggacaucagcgagaugggcgcgaacuuccgcgccgaccgggugaucgacccgcgccggugccugaagcccgucauccucaaggacgggcccgagcgcgugauccuggccggccccaugccggugaccgucgccuccgccgcgcagcggcgcgggcggaucggccgcaaccacaacaaggagggcgaccaguacaucuacauggggcagccccugaacaacgacgaggaccacgcccacuggaccgaggccaagaugcuccuggacaacaucaacacccccgagggcaucauccccgcccuguucgagccggagcgcgagaaguccgccgcgaucgacggggaguaccggcuccgcggcgaggcccggaagacguucguggagcugaugcgccgcggggaccugcccgucuggcucuccuacaagguggccagcgagggcuuccaguacagcgaccgccgguggugcuucgacggcgagcgcaacaaccaggugcuggaggagaacauggacgucgagaucuggaccaaggagggggagcggaagaagcugcgcccccgguggcucgacgcccgcaccuacuccgacccccuggcccugcgggaguucaaggaguucgcggccggccgccggagcguguccggggaccucauccuggagaucggcaagcugccgcagcaccucacccagcgcgcccagaacgcccuggacaaccuggugaugcuccacaacagcgagcagggcgggcgggcguaccgccacgccauggaggagcugcccgacacgaucgagacccugaugcuccuggcccugaucgccguccucaccggcggggugacccuguucuuccuguccggccgggggcucggcaagaccagcaucggccugcugugcgugauggccuccagcguccuccuguggauggcguccguggagccccacuggaucgccgccagcaucauccuggaguucuuccucauggugcugcugauccccgagccggaccgccagcggacgccccaggacaaccagcucgccuacgucgugaucgggcugcuguucaugauccucaccguggccgcgaacgagaugggccugcuggagaccaccaagaaggaccucgggaucggccacgucgccguggagaaccaccaccacgccgccaugcuggacguggaccugcaccccgccuccgcguggacgcucuacgccgucgccaccaccaucaucaccccgaugaugcgccacacgaucgagaacaccaccgccaacaucagccugaccgccaucgcgaaccaggccgccauccugauggggcucgacaagggcuggcccaucuccaagauggacaucggcgugccccugcuggcccucgggugcuacagccaggugaacccccugacgcugaccgcggccguccucaugcugguggcccacuacgccaucaucggcccggggcugcaggccaaggcgacccgcgaggcccagaagcggaccgccgccggcaucaugaagaaccccacgguggacgggaucgucgccaucgaccucgaccccgugguguacgacgcgaaguucgagaagcagcugggccagaucaugcugcucauccugugcaccucccagauccugcucaugcgcaccaccugggcccugugcgagagcaucacgcuggccaccggcccccucaccacccugugggagggguccccgggcaaguucuggaacacgaccaucgccgucagcauggccaacaucuuccggggguccuaccuggcgggcgccggccucgccuucagccugaugaagucccucgggggcgggcgccgggggaccggggcccagggcgagacccucggcgagaaguggaagcgccagcugaaccagcuguccaagagcgaguucaacacguacaagcgguccgggaucauggagguggaccgcagcgaggcgaaggagggccucaagcgcggggagaccaccaagcacgccgugucccgcggcaccgccaagcugcggugguucgucgagcgcaaccuggugaagcccgaggggaaggugaucgaccugggcugcggccgcgggggcuggagcuacuacugcgccgggcucaagaaggucacggaggugaagggcuacaccaagggcggccccggccacgaggagcccaucccgauggccaccuacggguggaaccuggugaagcugcacuccggcaaggacgucuucuucaucccgcccgagaagugcgacacccuccugugcgacaucggggagagcucccccaacccgacgaucgaggagggccgcacccugcgggugcucaagaugguggagcccuggcugcgcgggaaccaguucugcaucaagauccugaaccccuacaugcccagcgucguggagacccucgagcagaugcagcggaagcacggcggcaugcuggugcgcaacccgcugucccggaacagcacccacgagauguacugggucuccugcgggaccggcaacaucgugagcgcggugaacaugacgucccgcaugcuccugaaccgcuucaccauggcccaccggaagcccaccuacgagcgcgacgucgaccugggggccggcacccggcacguggccguggagcccgaggucgccaaccucgacaucaucggccagcgcaucgagaacaucaagcacgagcacaagagcacguggcacuacgacgaggacaaccccuacaagaccugggcguaccacggguccuacgaggugaagccgagcggcuccgccagcagcauggugaacggggucgugaagcugcugaccaagcccugggacgucauccccauggugacccagaucgccaugacggacaccacccccuucggccagcagcggguguucaaggagaaggucgacacccgcacgccgaaggccaagcgggggaccgcccagaucauggaggugaccgcgaaguggcucuggggcuuccugucccgcaacaagaagccccggaucugcacccgcgaggaguucacgcggaaggugcgcagcaacgccgccaucggcgccgucuucguggacgagaaccaguggaacuccgcgaaggaggccguggaggacgagcgguucugggaccugguccaccgcgagcgggagcuccacaagcaggggaagugcgcgaccugcguguacaacaugaugggcaagcgcgagaagaagcugggggaguucggcaaggccaaggggagccgggccaucugguacauguggcugggcgcgcgcuuccucgaguucgaggcccugggcuucaugaacgaggaccacugguucucccgggagaacagccuguccgggguggagggcgaggggcuccacaagcugggcuacauccugcgcgacaucagcaagauccccgggggcaacauguacgccgacgacaccgccggcugggacacccggaucacggaggacgaccuccagaacgaggcccgcaucaccgacaucauggagccggagcacgcgcugcuggccaaguccaucuucaagcucaccuaccagaacaaggucgugcgcgugcagcggcccgccaagaacgggaccgucauggacgugaucagccgccgggaccagcgcggcuccggccagguggggacguacggccugaacaccuucaccaacauggaggcccagcugauccggcagauggagagcgaggggaucuucucccccagcgagcucgagacccccaaccuggccgagcgcguccuggacuggcucgagaaguacggcguggagcggcugaagcgcauggcgaucuccggggacgacugcguggucaagccgaucgacgaccgguucgccacggcccugaccgcccucaacgacaugggcaaggugcgcaaggacaucccccagugggagcccagcaagggguggaacgacuggcagcagguccccuucugcucccaccacuuccaccagcugaucaugaaggacggccgggagaucgucgugccgugccgcaaccaggacgagcuggugggccgggcccgcgucagccagggggcgggcuggagccuccgggagaccgccugccuggggaaguccuacgcccagauguggcagcugauguacuuccaccgccgggaccuccgccuggccgcgaacgccaucugcagcgccgugcccguggacuggauccccaccucccggacgaccuggagcauccacgcccaccaccaguggaugaccaccgaggacaugcuguccgucuggaaccgcguguggaucgaggagaaccccuggauggaggacaagacgcacaucagcuccuggggcgacgugccguaccucgggaagcgcgaggaccaguggugcggcagccugaucggccugaccgcccgggcgaccugggccaccaacauccaggucgccaucaaccaggugcgccggcucaucgggaacgagaacuaccuggacuacaugaccuccaugaagcgcuucaagaacgagagcgaccccgagggcgcccugugguga

SEQ ID NO: 8372 - RNA, 9879 nt, Artificial Sequence
  derived and/or modified CDS sequence (opt1) from DENV-1__FJ410207__SS-prME
agcgugaccaugcugcucaugcugaugcccaccgcccuggccuuccaccucaccacccgcggcggggagccgcacaugaucgugagcaagcaggagcggggcaagagccugcuguucaagaccagcgcgggggugaacaugugcacccucaucgccauggaccugggcgaguucugcgaggacaccaugaccuacaagugcccccgcaucaccgaggccgagcccgacgacguggacugcuggugcaacgccaccgacaccugggugaccuacgggaccugcagccagaccggcgagcaccggcgcgacaagcgguccguggcccuggcgccccacgugggccucgggcuggagacgcgcaccgagaccuggaugagcuccgagggcgccuggaagcagauccagcgggucgagaccugggcccugcgccacccgggguucauggugaucgcccucuuccuggcgcacgccaucggcacgagcaucacccagaaggggaucaucuucauccugcucaugcuggugacccccuccauggccaugcggugcgucggcaucggcagccgcgacuucguggaggggcuguccggcgccaccuggguggacgucgugcucgagcacgggagcugcgugacgaccauggccaaggacaagcccacccuggacaucgagcugcucaagaccgaggucacgaaccccgcggugcugcggaagcugugcaucgaggccaagaucuccaacaccaccaccgacagccgcugcccgacgcagggcgaggccacccucguggaggagcaggacgccaacuucgucugccggcgcaccuucguggaccggggcugggggaacggcugcgggcuguucggcaaggggucccugaucacgugcgccaaguucaagugcgugacgaagcucgagggcaagaccguccaguacgagaaccugaaguacagcgugaucgugaccguccacaccggcgaccagcaccagguggggaacgaguccacggagcacggcaccaccgcgaccaucacgccccaggcccccagcacggagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccagcggggccuccaccagccaggagaccuggaaccggaaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcauguccuacgucaugugcaccgggagcuucaagcuggagaaggagguggcggagacccagcacggcacggugcucguccagaucaaguacgagggcaccgacgcccccugcaagauccccuucuccacccaggacgagaagggggugacccagaacggccggcugaucacggccaacccgaucgugaccgacaaggagaagcuggucaacaucgaggccgagccgcccuucggggagagcuacaucgugaucggcgcgggcgagaaggcccugaagcucuccugguucaagaaggggagcuccaucggcaagauguucgaggccaccgcccgcggggcccggcgcauggcgauccugggcgacaccgccugggacuucgggagcaucggcggcguguucacguccgucgggaagcuggugcaccagaucuucggcaccgccuacggggugcuguucagcggcgucuccuggaccaugaagaucgggaucggcgugcugcugaccuggcucggccugaacagccgcuccacgagccuguccaugaccugcaucgccguggggcucgucacccuguaccugggcgugauggugcaggccgacagcgggugcgucaucaacuggaagggccgggagcucaagugcgggagcggcaucuucgugaccaacgaggugcacacguggaccgagcaguacaaguuccaggcggacucccccaagcgccugagcgccgccaucggcaaggccugggaggagggggucugcggcauccgguccgccacccgccuggagaacaucauguggaagcagaucagcaacgagcucaaccacauccugcuggagaacgacaugaaguucaccgugguggucggggacguggcgggcauccucgcccaggggaagaagaugauccggccgcagcccauggaguacaaguacuccuggaaguccuggggcaaggccaagaucaucggcgccgacgugcagaacaccacguucaucaucgacgggcccaacacccccgagugcccggacgaccagcgcgcguggaacaucugggaggucgaggacuacggcuucgggaucuucaccaccaacaucuggcugaagcugcgggacagcuacacccaggugugcgaccaccgccucaugagcgccgccaucaaggacuccaaggccgugcacgccgacaugggcuacuggaucgagagcgagaagaacgagaccuggaagcuggcgcgggccuccuucaucgaggucaagaccugcaucuggcccaagagccacacccugugguccaacggcgugcucgagagcgagaugaucauccccaagaucuacgggggccccaucucccagcacaacuaccgcccgggguacuucacgcagaccgccggccccuggcaccuggggaagcuggagcucgacuucgaccugugcgagggcaccaccguggucguggacgagcacugcggcaaccgggggcccagccugcgcacgaccaccgugaccggcaagaucauccacgaguggugcugccgguccugcacgcucccgccccugcgcuucaagggggaggacggcugcugguacgggauggagauccggcccgucaaggagaaggaggagaaccuggugaaguccauggugagcgccggcuccggcgaggucgacagcuucucccucgggcugcugugcaucagcaucaugaucgaggaggugaugcgcucccgguggagccgcaagaugcucaugaccggcacccuggccguguucuuccugcucaucauggggcagcugaccuggaacgaccugauccggcucugcaucauggucggcgcgaacgccuccgaccgcauggggaugggcacgaccuaccuggcccugauggccaccuucaagaugcgccccauguucgccgugggccuccuguuccggcgccugaccagccgggaggugcuccugcugacgaucgggcucucccuggucgcgagcguggagcugccgaacucccucgaggagcugggcgacgggcuggccaugggcaucaugauccucaagcugcugaccgacuuccagagccaccagcucugggccacccugcugucccucaccuucaucaagacgaccuucagccugcacuacgccuggaagaccauggcgaugguccuguccaucgugagccucuucccccugugccuguccaccacgagccagaagaccaccuggcuccccgugcugcugggcucccucgggugcaagccccugaccauguuccugaucgccgagaaccgcaucuggggccgcaagagcuggccgcucaacgaggggaucauggccgucggcaucgugagcauccugcuguccagccuccugaagaacgacgugccccuggccgggccccucaucgccggcggcaugcugaucgcgugcuacgucaucuccgggagcuccgccgaccugagccucgagaaggccgccgagguguccugggaggaggaggccgagcacagcggcgcgucccacaacauccugguggagguccaggacgacgggacgaugaagaucaaggacgaggagcgcgacgacacccugaccauccuccugaaggccacccugcucgccgugagcggcguguacccccuguccaucccggccacccuguucgucugguacuucuggcagaagaagaagcagcggagcggggugcucugggacacgcccagcccgcccgagguggagcgcgccguccuggacgacggcaucuaccggaucaugcagcgcggccugcuggggcggagccaggugggcgugggggucuuccaggagaacguguuccacaccauguggcacgugacccgcggcgcgguccucauguaccaggggaagcggcuggagccguccugggccagcgugaagaaggaccugaucuccuacggcggcggguggcgccuccagggcagcuggaacaccggggaggaggugcaggucaucgccguggagcccggcaagaaccccaagaacgugcagacggcccccgggaccuucaagaccuccgagggcgaggucggcgccaucgcgcuggacuucaagccggggaccagcggcagccccaucgugaaccgggaggggaagaucgugggccuguacggcaacggggucgugacgaccuccggcaccuacgugagcgccaucgcccaggccaaggcgucccaggaggggccccuccccgagaucgaggacgaggucuuccgcaagcggaaccugaccaucauggaccugcacccgggcagcgggaagacgcgccgguaccuccccgccaucgugcgcgaggccaucaagcggaagcugcgcacccugauccucgcccccacccgcguggucgccuccgagauggcggaggcccugaagggcaugccgauccgguaccagaccacggccgucaagagcgagcacaccggcaaggagaucguggaccugaugugccacgccaccuucaccaugcgccuccugucccccguccgggugcccaacuacaacaugaucaucauggacgaggcccacuucacggaccccagcuccaucgcggcccgcggguacaucagcacccgggugggcaugggggaggccgccgccaucuucaugaccgcgaccccgcccggcuccgucgaggccuucccccagagcaacgccgugauccaggacgaggagcgcgacauccccgagcgguccuggaacagcggguacgaguggaucacggacuucccgggcaagaccgugugguucguccccuccaucaagagcggcaacgacaucgccaacugccugcgcaagaacgggaagcgggugauccagcucucccgcaagaccuucgacaccgaguaccagaagacgaagaacaacgacugggacuacguggucaccaccgacaucagcgagaugggcgcgaacuuccgggccgaccgcgugaucgacccccggcgcugccugaagcccgugauccugaaggacgggccggagcgggucauccucgccggccccaugcccgugaccgucgccuccgccgcgcagcgccgggggcgcaucggccggaaccacaacaaggagggcgaccaguacaucuacauggggcagccccugaacaacgacgaggaccacgcccacuggacggaggccaagaugcugcucgacaacaucaacaccccggagggcaucauccccgcccuguucgagcccgagcgcgagaaguccgccgcgaucgacggggaguaccgccugcggggcgaggcccgcaagaccuucguggagcucaugcggcgcggggaccugcccguguggcugagcuacaaggucgccuccgagggcuuccaguacagcgaccggcgcuggugcuucgacggcgagcggaacaaccaggugcucgaggagaacauggacguggagaucuggaccaaggagggggagcgcaagaagcugcggccgcgcuggcuggacgcccggacguacuccgacccccucgcccugcgcgaguucaaggaguucgcggccggccggcgcagcgucuccggggaccugauccucgagaucggcaagcugccccagcaccugacccagcgggcccagaacgcccucgacaaccuggugaugcugcacaacagcgagcagggcgggcgcgcguaccggcacgccauggaggagcuccccgacaccaucgagacccugaugcugcucgcccugaucgccgugcugacgggcggggucacccucuucuuccuguccggccgcgggcugggcaagaccagcaucggccuccugugcgugauggccuccagcgugcugcucuggauggcguccgucgagccgcacuggaucgccgccagcaucauccuggaguucuuccugauggugcuccugauccccgagcccgaccggcagcgcacgccccaggacaaccagcuggccuacguggucaucgggcuccuguucaugauccugaccguggccgcgaacgagaugggccuccuggagacgaccaagaaggaccuggggaucggccacguggccgucgagaaccaccaccacgccgccaugcucgacguggaccugcacccggccuccgcguggacccuguacgccguggccaccacgaucaucacccccaugaugcggcacaccaucgagaacaccacggccaacaucagccucaccgccaucgcgaaccaggccgccauccugauggggcuggacaagggcuggcccaucuccaagauggacaucggcgucccgcuccuggcccuggggugcuacagccaggugaacccccucacccugaccgcggccgugcugaugcucgucgcccacuacgccaucaucggccccgggcugcaggccaaggcgacgcgcgaggcccagaagcgcaccgccgccggcaucaugaagaaccccaccguggacgggaucguggccaucgaccuggacccggucguguacgacgcgaaguucgagaagcagcucggccagaucaugcugcugauccucugcaccucccagauccugcugaugcggacgaccugggcccucugcgagagcaucacccuggccaccggcccccugacgacccucugggaggggucccccggcaaguucuggaacaccaccaucgccgugagcauggccaacaucuuccgcgggagcuaccuggcgggcgccggccuggccuucucccucaugaagucccucgggggcgggcggcgcgggacgggggcccagggcgagacccugggcgagaaguggaagcggcagcucaaccagcuguccaagagcgaguucaacaccuacaagcgcuccgggaucauggaggucgaccggagcgaggcgaaggagggccugaagcgcggggagaccacgaagcacgccgugucccggggcaccgccaagcuccgcugguucguggagcggaaccuggucaagcccgaggggaaggugaucgaccugggcugcggccgcgggggcuggagcuacuacugcgccgggcugaagaaggugaccgaggucaagggcuacaccaagggcgggccgggccacgaggagcccauccccauggccacguacggguggaaccucgugaagcugcacuccggcaaggacguguucuucacgccgcccgagaagugcgacacccugcucugcgacaucggggagagcucccccaaccccaccaucgaggagggccggacgcugcgcguccugaagaugguggagcccuggcuccgggggaaccaguucugcaucaagauccugaaccccuacaugcccagcguggucgagacccuggagcagaugcagcgcaagcacggcggcaugcucgugcggaacccccugucccgcaacagcacccacgagauguacuggguguccugcgggaccggcaacaucgucagcgcggugaacaugaccucccggaugcugcucaaccgcuucacgauggcccaccgcaagcccaccuacgagcgggacguggaccugggggccggcacccgccacgucgccguggagccggagguggccaaccuggacaucaucggccagcggaucgagaacaucaagcacgagcacaagagcaccuggcacuacgacgaggacaaccccuacaagacgugggcguaccacggguccuacgaggucaagcccagcggcagcgccuccagcauggugaacggggucgugaagcuccugaccaagcccugggacgugaucccgauggucacccagaucgccaugaccgacacgacccccuucggccagcagcgcguguucaaggagaagguggacacccggacccccaaggccaagcgcgggacggcccagaucauggaggucaccgcgaaguggcuguggggcuuccucucccggaacaagaagccccgcaucugcacccgggaggaguucacccgcaaggugcggagcaacgccgccaucggcgccguguucgucgacgagaaccaguggaacuccgcgaaggaggccguggaggacgagcgcuucugggaccuggugcaccgggagcgcgagcugcacaagcaggggaagugcgccacgugcgucuacaacaugaugggcaagcgggagaagaagcucggggaguucggcaaggccaaggggagccgcgccaucugguacauguggcugggcgcgcgguuccuggaguucgaggcccucggcuucaugaacgaggaccacugguucucccgcgagaacagccuguccgggguggagggcgaggggcugcacaagcucggcuacauccugcgggacaucagcaagauccccggcgggaacauguacgccgacgacaccgccgggugggacacccgcaucaccgaggacgaccugcagaacgaggccaagaucacggacaucauggagcccgagcacgcgcuccuggccaaguccaucuucaagcugaccuaccagaacaaggugguccgggugcagcgccccgccaagaacgggaccgugauggacgucaucagccgccgggaccagcgcggcuccggccaggugggcaccuacggccucaacacguucaccaacauggaggcccagcugauccggcagauggagagcgaggggaucuucuccccgagcgagcuggagacccccaaccucgccggccgcgugcuggacuggcuggagaagcacggggucgagcggcucaagcgcauggcgaucuccggcgacgacugcguggugaagcccaucgacgaccgguucgccaccgcccugacggcccugaacgacauggggaagguccgcaaggacaucccccagugggagccgagcaagggcuggaacgacuggcagcagguccccuucugcagccaccacuuccaccagcucaucaugaaggacggccgggagaucgugguccccugccgcaaccaggacgagcugguggggcgggcccgcgugucccagggcgcgggguggagccugcgggagaccgccugccucggcaaguccuacgcccagauguggcagcugauguacuuccaccgccgggaccugcgccucgccgcgaacgccaucugcagcgccguccccguggacugggugccgaccucccggaccacguggagcauccacgcccaccaccaguggaugaccaccgaggacaugcuguccgucuggaaccgcguguggaucgaggagaaccccuggauggaggacaagacccacaucagcuccuggggcgacgugcccuaccugggcaagcgggaggaccaguggugcggcagccucaucgggcugacggcccgcgcgaccugggccaccaacauccaggucgccaucaaccaggugcgccggcugaucggcaacgagaacuaccucgacuacaugaccuccaugaagcgcuucaagaacgagagcgaccccgagggggcccugugguga

SEQ ID NO: 8373 - RNA, 9879 nt, Artificial Sequence
  derived and/or modified CDS sequence (opt1) from DENV-1__FJ432744__SS-prME
agcgugaccaugcugcucaugcugaugcccaccgcccuggccuuccaccucaccacccgcggcggggagccccacaugaucguguccaagcaggagcggggcaagagccugcuguucaagaccuccgcgggggugaacaugugcacccucaucgccauggaccugggggaguucugcgaggacacgaugaccuacaagugcccccgcaucaccgaggccgagcccgacgacguggacugcuggugcaacgccaccgacacgugggucaccuacgggaccugcagccagaccggggagcaccggcgcgacaagcgguccguggcccuggcgccccacgugggccucgggcuggagacgcgcaccgagaccuggaugagcuccgagggcgccuggaagcagauccagcgggucgagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugcccgacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaagaccguccaguacgagaaccugaaguacagcgugaucgugaccguccacacgggcgaccagcaccagguggggaacgaguccaccgagcacggcaccaccgcgaccaucacgccccaggcccccagcaccgagauccagcugaccgacuacggggcccucacccuggacugcagcccccgcacgggccuggacuucaacgagaugguccuccugaccaugaaggagaaggccuggcuggugcacaagcagugguuccucgaccugccgcugcccuggaccagcggggccagcaccucccaggagacguggaaccggaaggaccuccuggugaccuucaagaccgcgcacgccaagaagcaggaggucguggugcugggcagccaggagggcgccaugcacaccgcccucacgggggccaccgagauccagaccuccggcaccacgaccaucuucgcggggcaccugaagugccgccugaagauggacaagcucacccugaagggcaugagcuacgucaugugcaccggguccuucaagcuggagaaggagguggccgagacgcagcacggcaccgugcucguccagaucaaguacgagggcaccgacgcccccugcaagauccccuucagcacccaggacgagaagggggugacgcagaacggccggcugaucaccgccaacccgaucgugaccgacaaggagaagcccgucaacaucgaggcggagccgcccuucggggaguccuacaucgugaucggcgccggcgagaaggcccugaagcugagcugguucaagaagggguccagcaucggcaagauguucgaggccaccgcccgcggggcgcggcgcauggccauccucggcgacacggccugggacuucggguccaucggcggcguguucaccagcgucgggaagcuggugcaccagaucuucggcaccgccuacggggugcuguucuccggcgucagcuggaccaugaagaucgggaucggcgugcuccugacguggcugggccucaacucccgcagcaccucccugagcaugaccugcaucgccguggggcuggucacccucuaccugggcgugauggugcaggcggacuccgggugcgucaucaacuggaagggccgggagcugaagugcgggagcggcaucuucgugacgaacgaggugcacaccuggaccgagcaguacaaguuccaggccgacagcccgaagcgccucuccgccgccaucggcaaggccugggaggagggggucugcggcauccggagcgcgacccgccuggagaacaucauguggaagcagaucuccaacgagcugaaccacauccuccuggagaacgacaugaaguucaccgugguggucggggacguggccggcauccuggcccaggggaagaagaugauccggccccagcccauggaguacaaguacagcuggaaguccuggggcaaggccaagaucaucggcgcggacgugcagaacgccacguucaucaucgacgggcccaacaccccggagugccccgacgaccagcgcgccuggaacaucugggaggucgaggacuacggcuucgggaucuucaccaccaacaucuggcucaagcugcgggacagcuacacccaggugugcgaccaccgccugauguccgccgccaucaaggacagcaaggcggugcacgccgacaugggcuacuggaucgaguccgagaagaacgagacguggaagcucgcccgggccagcuucaucgaggucaagaccugcaucuggcccaagucccacacccuguggagcaacggcgugcuggaguccgagaugaucauccccaagaucuacgggggcccgaucagccagcacaacuaccgccccggguacuucacgcagaccgccggccccuggcaccucgggaagcuggagcuggacuucgaccucugcgagggcaccaccguggucguggacgagcacugcggcaaccgggggccgucccugcgcacgaccaccgugaccggcaagaucauccacgaguggugcugccggagcugcacgcugccgccccugcgcuucaagggggaggacggcugcugguacgggauggagauccggcccgucaaggagaaggaggagaaccuggugaaguccauggugagcgcgggcagcggcgaggucgacuccuucagccuggggcuccugugcaucuccaucaugaucgaggaggugaugcgcagccgguggucccgcaagaugcugaugaccggcauccucgccguguucuuccugcugaucauggggcagcucaccuggaacgaccugauccggcugugcaucauggucggcgccaacgccagcgaccgcauggggaugggcaccacguaccucgcccugauggcgaccuucaagaugcgcccgauguucgccgugggccuccuguuccggcgccugaccucccgggaggugcugcuccugaccaucgggcugagccucgucgccuccguggagcugcccaacagccuggaggagcucggcgacgggcuggccaugggcaucaugauccugaagcuccugacggacuuccagucccaccagcugugggcgacccuccugagccugaccuucaucaagaccacguucucccuccacuacgccuggaagaccauggccaugguccugagcaucgugucccuguucccccucugccugagcaccaccucccagaagacgaccuggcugcccgugcuccugggcagccuggggugcaagccgcucaccauguuccugaucgccgagaacaagaucuggggccgcaaguccuggccccugaacgaggggaucauggccgucggcaucgugagcauccuccugagcucccugcucaagaacgacgugccccuggcggggccccugaucgccggcggcaugcucaucgccugcuacgucaucagcggguccagcgccgaccugucccuggagaaggccgcggaggugagcugggaggaggaggccgagcacuccggcgccagccacaacauccucguggagguccaggacgacgggaccaugaagaucaaggacgaggagcgggacgacacgcugaccauccugcucaaggccacccugcuggccguguccggcguguacccgcucagcauccccgcgacccuguucgucugguacuucuggcagaagaagaagcgccgguccggggugcugugggacacccccuccccgcccgagguggagcgcgccguccucgacgacggcaucuaccggaucaugcagcgcggccugcuggggcggucccaggugggcgugggggucuuccaggagaacguguuccacacgauguggcacgugacccgcggcgccguccugauguaccaggggaagcggcucgagcccagcugggccuccgugaagaaggaccugaucagcuacggcggcggguggcgccugcagggcuccuggaacaccggggaggaggugcaggucaucgccguggagcccggcaagaaccccaagaacgugcagaccgcgcccgggacguucaagaccagcgagggcgaggucggcgccaucgcccucgacuucaagcccgggaccuccggcagccccaucgugaaccgggaggggaagaucgugggccuguacggcaacggggucgugaccacgagcggcaccuacguguccgccaucgcgcaggccaaggccagccaggaggggccccugccggagaucgaggacgaggucuuccgcaagcggaaccucaccaucauggaccugcaccccggcuccgggaagacccgccgguaccugcccgccaucgugcgcgaggccaucaagcggaagcuccgcacgcugauccuggcgccgacccgcguggucgccagcgagauggccgaggcccucaagggcaugcccauccgguaccagaccaccgccgugaaguccgagcacacgggcaaggagaucguggaccugaugugccacgcgaccuucaccaugcgccugcucagccccguccgggugcccaacuacaacaugaucaucauggacgaggcccacuucaccgacccguccagcaucgccgcccgcggguacaucuccacgcgggugggcaugggggaggccgcggccaucuucaugaccgccacgccgcccggcagcgucgaggccuucccccaguccaacgcggugauccaggacgaggagcgcgacaucccggagcggagcuggaacuccggguacgaguggaucaccgacuuccccggcaagacggugugguucguccccagcaucaaguccggcaacgacaucgccaacugccugcgcaagaacgggaagcgggugauccagcugagccgcaagaccuucgacaccgaguaccagaagaccaagaacaacgacugggacuacguggucacgaccgacaucuccgagaugggcgccaacuuccgggccgaccgcgugaucgacccccggcgcugccucaagccggugauccugaaggacgggcccgagcgggucauccuggccggccccaugcccgugaccgucgcgagcgccgcccagcgccgggggcgcaucggccggaaccacaacaaggagggcgaccaguacaucuacauggggcagccgcucaacaacgacgaggaccacgcccacuggaccgaggccaagaugcugcuggacaacaucaacacgcccgagggcaucauccccgcccucuucgagcccgagcgcgagaaguccgccgccaucgacggggaguaccgccugcggggcgaggcccgcaagaccuucguggagcugaugcggcgcggggaccucccgguguggcugagcuacaaggucgccagcgagggcuuccaguacuccgaccggcgcuggugcuucgacggcgagcggaacaaccaggugcuggaggagaacauggacguggagaucuggaccaaggagggggagcgcaagaagcuccggccccgcuggcuggacgcgcggaccuacagcgacccccuggcccuccgcgaguucaaggaguucgccgccggccggcgcuccgucagcggggaccugauccuggagaucggcaagcucccccagcaccugacgcagcgggcgcagaacgcccuggacaaccucgugaugcugcacaacuccgagcagggcgggcgcgccuaccggcacgccauggaggagcugccggacaccaucgagacccucaugcugcuggcccucaucgcggugcugaccggcggggucacgcuguucuuccucagcggccgcgggcugggcaagaccuccaucggccugcucugcgugauggccagcuccgugcugcuguggauggccagcgucgagccccacuggaucgccgccuccaucauccucgaguucuuccugauggugcugcucauccccgagcccgaccggcagcgcaccccgcaggacaaccagcuggcguacguggucaucgggcuccucuucaugauccugaccguggccgccaacgagaugggccugcucgagaccacgaagaaggaccuggggaucggccacguggccgucgagaaccaccaccacgccgcgaugcuggacguggaccuccaccccgccagcgccuggacccuguacgccguggccaccaccaucaucacgcccaugaugcggcacaccaucgagaacaccaccgcgaacaucucccugacggccaucgccaaccaggccgcgauccucauggggcuggacaagggcuggccgaucagcaagauggacaucggcgucccccugcucgcccuggggugcuacucccaggugaacccccugacccucaccgccgccgugcugaugcuggucgcccacuacgcgaucaucggccccgggcuccaggccaaggccacccgcgaggcccagaagcgcacggccgcgggcaucaugaagaacccgaccguggacgggaucguggccaucgaccuggaccccgucguguacgacaccaaguucgagaagcagcugggccagaucaugcuccugauccugugcaccagccagauccuccugaugcggacgaccugggcccugugcgaguccaucacccucgccaccggcccccugacgacccugugggaggggagccccggcaaguucuggaacaccaccaucgccguguccauggcgaacaucuuccgcgggagcuaccucgccggcgccggccuggccuucagccugaugaagucccucgggggcgggcggcgcggcacgggggcgcagggcgagacccugggcgagaaguggaagcggcagcugaaccagcucagcaaguccgaguucaacaccuacaagcgcagcgggaucauggaggucgaccgguccgaggccaaggagggccugaagcgcggggagaccacgaagcacgccgugagccggggcaccgccaagcugcgcugguucguggagcggaaccucgucaagccggaggggaaggugaucgaccugggcugcggccgcgggggcugguccuacuacugcgccgggcugaagaaggugaccgaggucaagggcuacaccaagggcgggcccggccacgaggagcccauccccauggcgacguacggguggaaccuggugaagcuccacagcggcaaggacguguucuucaucccgcccgagaagugcgacacccugcugugcgacaucggggaguccagccccaaccccaccaucgaggagggccggacccuccgcguccugaagaugguggagccguggcugcgggggaaccaguucugcaucaagauccucaaccccuacaugcccuccguggucgagacgcuggagcagaugcagcgcaagcacggcggcaugcuggugcggaacccccucagccgcaacuccacccacgagauguacugggugagcugcgggaccggcaacaucgucuccgccgugaacaugaccagccggaugcugcugaaccgcuucaccauggcccaccgcaagccgacguacgagcgggacguggaccucggggccggcacccgccacgucgccguggagcccgagguggcgaaccuggacaucaucggccagcggaucgagaacaucaagcacgagcacaaguccaccuggcacuacgacgaggacaaccccuacaagaccugggccuaccacgggagcuacgaggucaagcccuccggcagcgccagcuccauggugaacggggucgugaagcugcucacgaagccgugggacgugauccccauggucacccagaucgccaugaccgacaccacgcccuucggccagcagcgcguguucaaggagaagguggacacccggacccccaaggccaagcgcgggaccgcgcagaucauggaggucacggccaaguggcuguggggcuuccugagccggaacaagaagccgcgcaucugcacccgggaggaguucacccgcaaggugcgguccaacgccgccaucggcgcgguguucgucgacgagaaccaguggaacagcgccaaggaggccguggaggacgagcgcuucugggaccucgugcaccgggagcgcgagcugcacaagcaggggaagugcgcgaccugcgucuacaacaugaugggcaagcgggagaagaagcugggggaguucggcaaggccaaggggucccgcgcgaucugguacauguggcucggcgcccgguuccuggaguucgaggcccugggcuucaugaacgaggaccacugguucagccgcgagaacucccucagcgggguggagggcgaggggcugcacaagcugggcuacauccuccgggacaucuccaagauccccgggggcaacauguacgccgacgacacggccggcugggacacccgcaucaccgaggacgaccugcagaacgaggcgaagaucaccgacaucauggagcccgagcacgcccugcucgccaagagcaucuucaagcugacguaccagaacaaggugguccgggugcagcgcccggccaagaacgggaccgugauggacgucaucucccgccgggaccagcgcggcagcggccaggugggcaccuacggccugaacaccuucacgaacauggaggcccagcucauccggcagauggaguccgaggggaucuucagccccuccgagcuggagacccccaaccuggcgggccgcgugcucgacuggcuggagaagcacggggucgagcggcugaagcgcauggccaucagcggcgacgacugcguggugaagcccaucgacgaccgguucgccaccgcccucaccgcccugaacgacauggggaagguccgcaaggacaucccgcagugggagcccuccaagggcuggaacgacuggcagcagguccccuucugcagccaccacuuccaccagcugaucaugaaggacggccgggagaucgugguccccugccgcaaccaggacgagcucguggggcgggcgcgcgugagccagggcgccggguggucccugcgggagacggccugccugggcaagagcuacgcccagauguggcagcucauguacuuccaccgccgggaccugcgccuggcggccaacgccaucugcuccgccgucccgguggacugggugcccaccagccggaccaccugguccauccacgcccaccaccaguggaugacgaccgaggacaugcucagcgucuggaaccgcguguggaucgaggagaaccccuggauggaggacaagacccacaucuccagcuggggcgacgugcccuaccugggcaagcgggaggaccaguggugcggcucccugaucgggcucaccgcgcgcgccacgugggccaccaacauccaggucgccaucaaccaggugcgccggcugaucggcaacgagaacuaccuggacuacaugaccagcaugaagcgcuucaagaacgagaucgacccggagggggcccucugguga

SEQ ID NO: 8374 - RNA, 9879 nt, Artificial Sequence
  derived and/or modified CDS sequence (opt1) from DENV-1__FJ547060__SS-prME
agcgugaccaugcugcucaugcugaugcccaccgcccuggccuuccaccucaccacccggggcggggagccccacaugaucgugaccaagcaggagcggggcaagagccugcuguucaagaccagcgccggggugaacaugugcacccucaucgccauggaccugggggagcugugcgaggacaccaugaccuacaagugcccccggaucaccgaggccgagcccgacgacguggacugcuggugcaacgccaccgacaccugggugaccuacgggaccugcagccagacgggggagcaccggcgcgacaagcggagcguggcccucgcgccccacgugggccuggggcuggagacccgcaccgagaccuggauguccagcgagggcgccuggaagcagauccagcggguggagacgugggcccuccgccaccccggguucaccgugaucgcccuguuccuggcgcacgccaucggcaccuccaucacccagaaggggaucaucuucauccuccugaugcuggugacgcccagcauggccaugcggugcgucggcaucggcucccgcgacuucguggaggggcucagcggcgccaccuggguggacgucgugcuggagcacggguccugcgugaccaccauggccaaggacaagcccacgcuggacaucgagcuccugaagaccgaggucaccaaccccgcggugcugcggaagcucugcaucgaggccaagaucagcaacaccacgaccgacucccgcugccccacccagggcgaggccacccugauggaggagcaggacgccaacuucgugugccggcgcacguucgucgaccggggcugggggaacggcugcgggcuguucggcaaggggagccucaucacgugcgccaaguucaagugcgugaccaagcuggagggcaagaucgugcaguacgagaaccugaaguacuccgucaucgugaccgugcacacgggcgaccagcaccaggucgggaacgagagcaccgagcacggcaccaccgcgaccaucacgccccaggcccccaccuccgagauccagcucaccgacuacggggcccugacccuggacugcagcccccgcacgggccucgacuucaacgagauggugcugcugaccaugaaggagaaguccuggcucguccacaagcagugguuccuggaccugccgcuccccuggaccagcggggccagcaccucccaggagacguggaaccggcaggaccugcuggugaccuucaagaccgcccacgcgaagaagcaggagguggucgugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgugaugugcaccggguccuucaagcucgagaaggaggucgcggagacgcagcacggcaccgugcuggugcagaucaaguacgagggcaccgacgcccccugcaagauccccuucagcacccaggacgagaagggggucacgcagaacggccggcugaucaccgccaacccgaucgugaccgacaaggagaagcccgugaacaucgaggccgagccgcccuucggggaguccuacaucgucaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcguggggaagcugguccaccagaucuucggcaccgccuacgggguccuguucuccggcgugagcuggaccaugaagaucgggaucggcguccugcugacguggcucggccugaacucccgcagcaccucccugagcaugaccugcaucgccguggggcucgugacccuguaccugggcgucauggugcaggccgacuccgggugcgugaucaacuggaagggccgggagcucaagugcgggagcggcaucuucgucacgaacgaggugcacaccuggaccgagcaguacaaguuccaggcggacagcccgaagcgccuguccgccgccaucggcaaggccugggaggagggggugugcggcauccggagcgccacccgccuggagaacaucauguggaagcagaucuccaacgagcucaaccacauccugcuggagaacgacaugaaguucaccgucguggugggggacgucgugggcauccucgcgcaggggaagaagaugauccggccccagcccauggagcacaaguacagcuggaaguccuggggcaaggccaagaucaucggcgccgacgugcagaacacgaccuucaucaucgacgggcccaacaccccggagugccccgacgaccagcgcgccuggaacaucugggaggucgaggacuacggcuucgggaucuucaccacgaacaucuggcugaagcugcgggacagcuacacccaggugugcgaccaccgccucauguccgcggccaucaaggacagcaaggccgugcacgccgacaugggcuacuggaucgaguccgagaagaacgagaccuggaagcuggcccgggcgagcuucaucgaggucaagaccugcaucuggcccaagucccacacgcuguggagcaacggcgugcucgaguccgagaugaucauccccaagaucuacgggggcccgaucagccagcacaacuaccgccccggguacuucacccagaccgccggccccuggcaccuggggaagcuggagcucgacuucgaccugugcgagggcaccacgguggucguggacgagcacugcggcaaccgggggccgucccugcgcaccaccaccgugacgggcaagaucauccacgaguggugcugccggagcugcacccugccgccccuccgcuucaagggggaggacggcugcugguacgggauggagauccggcccgucaaggagaaggaggagaaccuggugaaguccauggugagcgccggcagcggcgaggucgacuccuucagccucgggcugcugugcaucuccaucaugaucgaggaggugaugcgcagccgguggucccgcaagaugcucaugaccggcacccuggccguguuccugcuccugaucauggggcagcugacguggaacgaccucauccggcugugcaucauggucggcgccaacgcgagcgaccgcauggggaugggcaccaccuaccuggcccucauggccaccuucaagaugcgcccgauguucgccgugggccugcuguuccggcgccucacgucccgggaggugcugcugcucaccaucgggcugagccuggucgccuccguggagcuccccaacagccuggaggagcugggcgacgggcucgcgaugggcaucaugauccugaagcugcucaccgacuuccagucccaccagcugugggccacccugcucagccugacguucaucaagaccacccugucccuccacuacgccuggaagaccauggccaugguccugagcaucgugucccuguucccccucugccugagcacgaccucccagaagaccaccuggcugcccgugcuccugggcagccuggggugcaagccgcucacgauguuccugaucgcggagaacaagaucuggggccgcaaguccuggccccugaacgaggggaucauggccgucggcguggugagcauccuccugagcucccugcucaagaacgacgucccccuggccgggccccugaucgccggcggcaugcucaucgccugcuacgugaucagcggguccagcgcggaccugucccuggagaaggccgccgaggugagcugggaggaggaggccgagcacuccggcgccagccacaacauccucgucgaggugcaggacgacgggaccaugaagaucaaggacgaggagcgggacgacacccugaccauccugcucaaggcgacccugcuggccguguccggcgucuacccgcucagcauccccgccacgcuguucgugugguacuucuggcagaagaagaagcagcgcuccggggugcugugggacacccccagcccgcccgaggucgagcgggccgugcuggacgacggcaucuaccgcaucaugcagcggggccuccuggggcgcucccaggugggcgucgggguguuccaggagaacguguuccacaccauguggcacgucacccggggcgccgugcugauguaccaggggaagcgccucgagcccagcugggcguccgugaagaaggaccugaucagcuacggcggcggguggcggcugcagggcuccuggaacacgggggaggagguccaggugaucgccguggagcccggcaagaaccccaagaacguccagaccgcccccgggaccuucaagacccccgagggcgaggugggcgccaucgcccucgacuucaagcccgggacgagcggcucccccaucgugaaccgcgaggggaagaucgucggccuguacggcaacgggguggugaccaccagcggcaccuacgucagcgcgaucgcccagacgaaggccucccaggaggggccgcugcccgagaucgaggacgagguguuccggaagcgcaaccucaccaucauggaccugcaccccggcagcgggaagacccggcgcuaccugccggccaucgugcgggaggcgaucaagcgcaagcuccggacccugauccuggcccccacgcgcgucguggccuccgagauggccgaggcccucaagggcaugcccauccgcuaccagaccaccgcggucaagagcgagcacaccggcaaggagaucgucgaccugaugugccacgccacguucaccaugcggcugcucucccccgugcgcgugccgaacuacaacaugaucaucauggacgaggcccacuucaccgaccccagcuccaucgccgcccggggguacaucagcacccgcgucggcaugggggaggcggccgccaucuucaugacggccacgccgcccggcuccguggaggccuucccgcagagcaacgcggugauccaggacgaggagcgggacauccccgagcgcuccuggaacagcggguacgaguggaucaccgacuuccccggcaagaccgucugguucgugcccuccaucaagagcggcaacgacaucgccaacugccugcggaagaacgggaagcgcgugauccagcugucccggaagacguucgacaccgaguaccagaagaccaagaacaacgacugggacuacgucgugaccacggacaucagcgagaugggcgccaacuuccgcgccgaccgggugaucgacccgcgccggugccucaagcccgucauccugaaggacgggcccgagcgcgugauccuggcgggccccaugccggucaccguggccuccgccgcccagcggcgcgggcggaucggccgcaaccacaacaaggagggcgaccaguacaucuacauggggcagccccucaacaacgacgaggaccacgcccacuggaccgaggcgaagaugcugcuggacaacaucaacacccccgagggcaucauccccgcccucuucgagccggagcgggagaaguccgccgccaucgacggggaguaccgccugcgcggcgaggcccggaagacguucguggagcugaugcgccgcggggaccuccccgucuggcuguccuacaagguggcgagcgagggcuuccaguacagcgaccgccgguggugcuucgacggcgagcgcaacaaccaggugcuggaggagaacauggacgucgagaucuggaccaaggagggggagcggaagaagcuccgcccccgguggcuggacgcccgcaccuacuccgacccccuggcccuccgggaguucaaggaguucgccgccggccgccggagcguguccggggaccugauccuggagaucggcaagcucccgcagcaccugacccagcgcgcgcagaacgcccuggacaaccucgugaugcugcacaacagcgagcagggcgggcgggccuaccgccacgccauggaggagcugcccgacacgaucgagacccucaugcugcuggcgcucaucgccguccugaccggcggggugacccuguucuuccucuccggccgggggcugggcaagaccagcaucggccugcucugcgugauggccuccagcguccugcuguggauggccuccguggagccccacuggaucgccgcgagcaucauccucgaguucuuccugauggugcugcucauccccgagccggaccgccagcggacgccccaggacaaccagcuggccuacgucgugaucgggcuccucuucaugauccugaccguggccgccaacgagaugggccugcucgagaccaccaagaaggaccuggggaucggccacgucgccguggagaaccaccaccacgcgacgaugcuggacguggaccuccaccccgccuccgccuggacccuguacgccgucgccaccaccaucaucacgccgaugaugcgccacaccaucgagaacaccaccgcgaacaucagccugacggccaucgccaaccaggccgccauccucauggggcuggacaagggcuggcccaucuccaagauggacaucggcgugccccugcucgcgcuggggugcuacagccaggugaacccccugacccucaccgccgccguccugaugcugguggcccacuacgcgaucaucggcccggggcuccaggccaaggccacccgggaggcccagaagcgcacggccgcgggcaucaugaagaaccccaccguggacgggaucgucgccaucgaccuggaccccgugguguacgacgccaaguucgagaagcagcugggccagaucaugcuccugauccugugcaccucccagauccuccugaugcgcaccacgugggcccugugcgagagcaucacccucgccaccggcccccugaccacgcugugggagggguccccgggcaaguucuggaacaccaccaucgcggucagcauggccaacaucuuccggggguccuaccucgccggcgccggccuggccuucagccugaugaagucccucgggggcgggcgccggggcaccggggcgcagggcgagacgcugggcgagaaguggaagcgccagcugaaccagcucuccaagagcgaguucaacaucuacaagcgguccgggaucauggagguggaccgcagcgaggccaaggagggccugaagcgcggggagaccacccgccacgccgugucccggggcaccgccaagcugcgcugguucgucgagcggaaccuggugaagcccgaggggaaggugaucgaccucggcugcggccgcgggggcuggagcuacuacugcgcggggcugaagaaggucacggaggugaagggcuacaccaagggcgggcccggccacgaggagcccaucccgauggccaccuacggguggaaccuggugaagcuccacuccggcaaggacgucuucuucacgccgcccgagaagugcgacacgcugcugugcgacaucggggagagcucccccaacccgaccaucgaggagggccggacccuccgcgugcugaagaugguggagcccuggcugcgggggaaccaguucugcaucaagauccucaaccccuacaugcccagcgucguggagacccuggagcagaugcagcgcaagcacggcggcaugcuggugcggaacccgcucucccgcaacagcacccacgagauguacugggucuccugcgggacgggcaacaucgugagcgccgugaacaugaccucccggaugcugcugaaccgcuucaccauggcccaccgcaagcccaccuacgagcgggacgucgaccucggggccggcacgcgccacguggcgguggagcccgaggucgccaaccuggacaucaucggccagcggaucgagaacaucaagcacgagcacaagagcaccuggcacuacgacgaggacaaccccuacaagaccugggccuaccacggguccuacgaggugaagccgagcggcuccgccagcagcauggucaacgggguggugaagcugcucaccaagcccugggacgucauccccauggugacgcagaucgccaugaccgacaccacccccuucggccagcagcgcguguucaaggagaaggucgacacgcggaccccgaaggcgaagcgcgggaccgcccagaucauggaggugaccgcccgguggcuguggggcuuccugucccgcaacaagaagccccggaucugcacgcgcgaggaguucacccggaaggugcgcagcaacgccgccaucggcgcggucuucguggacgagaaccaguggaacuccgccaaggaggccguggaggacgagcgguucugggaccucguccagaaggagcgcgagcugcacaagcaggggaagugcgcgaccugcguguacaacaugaugggcaagcgggagaagaagcugggggaguucggcaaggcgaaggggagccgcgccaucugguacauguggcucggcgcccgguuccuggaguucgaggcccugggcuucaugaacgaggaccacugguucucccgcgagaacagccucuccgggguggagggcgaggggcugcacaagcugggcuacauccuccgggacaucagcaagauccccgggggcaacauguacgccgacgacaccgcgggcugggacacgcgcaucaccgaggacgaccugcagaacgaggccaagaucaccgacaucauggagccggagcacgcccugcucgccaccuccaucuucaagcugacguaccagaacaaggucgugcgggugcagcgccccgccaagaacgggaccgucauggacgugaucagccgccgggaccagcgcggcuccggccaggugggcaccuacggccugaacaccuucacgaacauggaggcgcagcucguccggcagauggagagcgaggggaucuucucccccugcgagcuggagauccccaaccuggccgagcgcgugcucgacuggcuggagaaguacggcguggagcggcugaagcgcauggccaucagcggggacgacugcgucgugaagccgaucgacgaccgguucgccaccgcccucaccgcgcugaacgacaugggcaaggugcgcaaggacgucccccagugggagcccuccaagggguggaacgacuggcagcagguccccuucugcagccaccacuuccaccagcugaucaugaaggacggccgggagaucguggucccgugccgcaaccaggacgagcucgugggccgggcccgcgugucccagggggccggcuggagccugcgggagaccgccugccugggcaagagcuacgcccagauguggcagcucauguacuuccaccgccgggaccugcgccuggcggccaacgccaucugcuccgccguccccguggacugggugcccacgagccggaccaccugguccauccacgcgcaccaccaguggaugaccacggaggacaugcucagcgucuggaaccgcguguggaucgaggagaaccccuggauggaggacaagacccacguguccagcuggggcgacgucccguaccuggggaagcgggaggaccaguggugcggcucccugaucggccucaccgcccgcgccaccugggccagcaacauccagguggccaucaaccaggugcgccggcugaucgggaacgagaacuaccuggacuacaugaccuccaugaagcgcuucaagaacgagggcgaccccgagggggcgcucugguga

SEQ ID NO: 8375 - RNA, 9879 nt, Artificial Sequence
  derived and/or modified CDS sequence (opt1) from DENV-1__FJ432745__SS-prME
agcgugaccaugcugcucaugcugaugcccaccgcccuggccuuccaccucaccacccggggcggggagccccacaugguggugagcaagcaggagcggggcaagagccugcuguucaagaccagcgcgggggugaacaugugcacccucaucgccauggaccugggcgagcugugcgaggacaccaugaccuacaagugcccccggaucaccgaggccgagcccgacgacguggacugcuggugcaacgccaccgacacgugggugaccuacgggaccugcagccagaccggcgagcaccggcgcgacaagcgguccguggcccucgcgccccacgugggccuggggcuggagacgcgcaccgagaccuggaugagcuccgagggcgccuggaagcagauccagcggguggagaccugggcccuccgccaccccggguucacggugaucgcccuguuccuggcgcacgccaucggcaccagcaucacccagaaggggaucaucuucauccuccugaugcuggucacccccuccauggccaugcggugcgugggcaucggcagccgcgacuucguggaggggcucuccggcgccacgugggucgacguggugcuggagcacgggagcugcgucaccaccauggccaaggacaagcccacccuggacaucgagcuccugaagacggaggugaccaaccccgcgauccugcggaagcucugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacaccggcgaccagcaccagguggggaacgaguccacggagcacggcaccaccgcgaccaucacgccccaggcccccacgaccgagauccagcucaccgacuacggggcccugacccuggacugcagcccccgcacgggccucgacuucaacgagaugguccugcugaccaugaaggagaaguccuggcucgugcacaagcagugguuccuggaccugccccuccccuggaccagcggggccagcaccucccaggagacguggaaccggcaggaccugcuggugaccuucaagaccgcccacgcgaagaagcaggaggucguggugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgucaugugcaccggguccuucaagcucgagaaggagguggcggagacgcagcacggcaccgugcugguccagaucaaguacgagggcaccgacgcccccugcaagauccccuucagcacccaggacgagaagggggugacgcagaacggccggcugaucaccgccaacccgaucgugaccgacaaggagaagcccgucaacaucgaggccgagccgcccuucggggaguccuacaucgugaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcgucgggaagcuggugcaccagaucuucggcaccgccuacgggguccuguucuccggcgucagcuggaccaugaagaucgggcugggcgugcugcucacguggcugggccugaacucccgcagcaccucccucagcaugaccugcaucgccguggggcuggucacccuguaccucggcgugauggugcaggccgacuccgggugcgucaucaacuggaagggccgggagcugaagugcgggagcggcaucuucgugacgaacgaggugcacaccuggaccgagcaguacaaguuccaggcggacagcccgaagcgccuguccgccgccaucggcaaggccugggaggagggggucugcggcauccggagcgccacccgccucgagaacgugauguggaagcagaucuccaacgagcugaaccacauccugcucgagaacgacaugaaguucaccguggucgugggggacguggcgggcauccuggcccaggggaagaagaugauccggccccagcccauggaguacaaguacagcuggaaguccuggggcaaggccaagaucaucggcgccgacguccagaacacgaccuucaucaucgacgggcccaacaccccggagugccccgacgaccagcgcgcguggaacaucugggagguggaggacuacggcuucgggaucuucaccacgaacaucuggcugaagcuccgggacagcuacacccaggugugcgaccaccgccugauguccgccgccaucaaggacagcaaggccguccacgccgacaugggcuacuggaucgaguccgagaagaacgagaccuggaagcuggcgcgggccagcuucaucgaggugaagaccugcaucuggcccaagucccacacgcucuggagcaacggcgugcuggaguccgagaugaucauccccaagaucuacgggggcccgaucagccagcacaacuaccgccccggguacuucacccagaccgccggccccuggcaccuggggaagcucgagcuggacuucgaccugugcgagggcaccacggucgugguggacgagcacugcggcaaccgggggccgucccuccgcaccaccaccgucacgggcaagaucauccacgaguggugcugccggagcugcacccugccgccccugcgcuuccgcggggaggacggcugcugguacgggauggagauccgccccgugaaggagaaggaggagaaccucgugaaguccauggucagcgccggcagcggcgagguggacuccuucagccuggggcugcucugcaucuccaucaugaucgaggaggugaugcggagccgcuggucccggaagaugcugaugaccggcacccuggccgucuuccuccugcugaucauggggcagcucacguggaacgaccugauccgccugugcaucauggugggcgcgaacgccagcgaccgcauggggaugggcaccaccuaccucgcccugauggccaccuucaagaugcggccgauguucgccguggggcuccuguuccgccggcugacgucccgcgagguccugcuccugaccaucgggcugagccucguggcguccgucgagcugcccaacagccuggaggagcucggcgacgggcuggccaugggcaucaugauccugaagcuccugaccgacuuccagucccaccagcugugggccacccuccugagccugacguucaucaagaccaccuucucccuccacuacgccuggaagaccauggcgauggugcugagcaucgugucccuguucccccucugccugagcacgaccucccagaagaccaccuggcugcccguccuccugggcagccuggggugcaagccgcucacgauguuccugaucgccgagaacaagaucuggggccggcgcuccuggccccugaacgaggggaucauggccgugggcaucgugagcauccuccugagcucccugcucaagaacgacgucccccuggccgggccccugaucgccggcggcaugcucaucgcgugcuacgugaucagcggguccagcgccgaccugucccuggagaaggccgccgaggugagcugggaggaggaggccgagcacuccggcgcgagccacaacauccucgucgaggugcaggacgacgggaccaugaagaucaaggacgaggagcgggacgacacccugaccauccugcucaaggccacccugcuggccguguccggcgucuacccgcucagcauccccgccacgcuguucgugugguacuucuggcagaagaagaagcagcgcuccggggugcugugggacacccccagcccgcccgaggucgagcgggccgugcuggacgacggcaucuaccgcaucaugcagcggggccuccuggggcgcucccaggugggcgucgggguguuccaggagaacguguuccacaccauguggcacgucacccggggcgcggugcugauguaccaggggaagcgccucgagcccagcugggccuccgugaagaaggaccugaucagcuacggcggcggguggcggcugcagggcuccuggaacacgggggaggagguccaggugaucgccguggagcccggcaagaaccccaagaacguccagaccgcccccgggaccuucaagacccccgagggcgaggugggcgccaucgcgcucgacuucaagcccgggacgagcggcucccccaucgugaaccgcgaggggaagaucgucggccuguacggcaacgggguggugaccaccagcggcaccuacgucagcgccaucgcccaggccaaggcgucccaggaggggccgcugcccgagaucgaggacgagguguuccggaagcgcaaccucacgaucauggaccugcaccccggcagcgggaagacccggcgcuaccugccggccaucgugcgggaggccaucaagcgcaagcuccgcacccugauccuggcccccacccgggucguggccuccgagauggcggaggcccucaagggcaugcccauccgcuaccagacgaccgccgucaagagcgagcacaccggcaaggagaucgucgaccugaugugccacgccaccuucacgaugcggcugcucucccccgugcgcgugccgaacuacaacaugaucaucauggacgaggcccacuucaccgaccccagcuccaucgcggcccggggguacaucagcacccgcgucggcaugggggaggccgccgccaucuucaugaccgcgacgccgcccggcuccguggaggccuucccgcagagcaacgccgugauccaggacgaggagcgggacauccccgagcgcuccuggaacagcggguacgaguggaucaccgacuuccccggcaagaccgucugguucgugcccuccaucaagagcggcaacgacaucgccaacugccugcggaagaacgggaagcgcgugauccagcugucccggaagaccuucgacacggaguaccagaagaccaagaacaacgacugggacuacgucgugaccaccgacaucagcgagaugggcgcgaacuuccgcgccgaccgggugaucgacccgcgccggugccucaagcccgucauccugaaggacgggcccgagcgcgugauccuggccggccccaugccggucacgguggccuccgccgcgcagcggcgcgggcggaucggccgcaaccacaacaaggagggcgaccaguacaucuacauggggcagccccucaacaacgacgaggaccacgcccacuggaccgaggccaagaugcugcuggacaacaucaacacccccgagggcaucauccccgcccucuucgagccggagcgcgagaaguccgccgcgaucgacggggaguaccggcugcgcggcgaggcccggaagaccuucguggagcugaugcgccgcggggaccuccccgucuggcuguccuacaagguggccagcgagggcuuccaguacagcgaccgccgguggugcuucgacggcgagcgcaacaaccaggugcuggaggagaacauggacgucgagaucuggacgaaggagggggagcggaagaagcuccgcccccgguggcuggacgcccgcaccuacuccgacccccuggcccuccgggaguucaaggaguucgcggccggccgccggagcguguccggggaccugauccuggagaucggcaagcucccgcagcaccugacccagcgcgcccagaacgcccuggacaaccucgugaugcugcacaacagcgagcagggcgggcgggcguaccgccacgccauggaggagcugcccgacaccaucgagacgcucaugcugcuggcccucaucgccguccugaccggcggggugacccuguucuuccucuccggccgggggcugggcaagaccagcaucggccugcucugcgugauggccuccagcguccugcuguggauggcguccguggagccccacuggaucgccgccagcaucauccucgaguucuuccugauggugcugcucauccccgagccggaccgccagcggacgccccaggacaaccagcuggccuacgucgugaucgggcuccucuucaugauccugacgguggccgcgaacgagaugggccugcucgagaccaccaagaaggaccuggggaucggccacgccgccgucgggaaccaccaccacgccgccaugcuggacguggaccuccaccccgcguccgccuggacccuguacgccguggccacgaccaucaucaccccgaugaugcgccacaccaucgagaacacgaccgccaacaucagccugaccgcgaucgccaaccaggccgccauccucaugggccuggacaagggcuggcccaucuccaagauggacaucggggucccccugcucgcgcugggcugcuacagccaggugaacccccugacccucacggccgccgugcugaugcuggucgcccacuacgccaucaucgggccgggccuccaggcgaaggccacccgcgaggcccagaagcggaccgccgccgggaucaugaagaaccccaccguggacggcaucguggcgaucgaccuggaccccgucguguacgacgccaaguucgagaagcagcugggccagaucaugcuccugauccugugcacgucccagauccuccugaugcgcaccaccugggcccugugcgagagcaucacccucgccacggggccccugaccacccugugggagggcuccccggggaaguucuggaacaccacgaucgccgugagcauggcgaacaucuuccggggcuccuaccucgccggcgccgggcuggccuucagccugaugaagucccucggcgggggccgccgggggaccggcgcgcagggcgagacccugggggagaaguggaagcgccagcugaaccagcucuccaagagcgaguucaacaccuacaagcgguccggcaucauggaggucgaccgcagcgaggccaaggaggggcugaagcggggcgagacgaccaagcacgccgugucccgcgggaccgccaagcugcggugguucguggagcgcaaccuggucaagcccgagggcaaggugaucgaccucggcugcgggcggggcggguggagcuacuacugcgccggccugaagaaggugaccgaggucaagggguacacgaagggcggccccgggcacgaggagcccaucccgauggcgaccuacggcuggaaccuggugaagcuccacuccgggaaggacguguucuucaucccgcccgagaagugcgacacccugcugugcgacaucggcgagagcucccccaacccgaccaucgaggaggggcgcacgcuccggguccugaagaugguggagcccuggcugcgcggcaaccaguucugcaucaagauccucaaccccuacaugcccagcguggucgagacccuggagcagaugcagcggaagcacggcgggaugcuggugcgcaacccgcucucccggaacagcacccacgagauguacuggguguccugcggcaccgggaacaucgucagcgccgugaacaugaccucccgcaugcugcugaaccgcuucacgauggcccaccggaagcccaccuacgagcgcgacguggaccucggcgccggcacccggcacgucgccguggagcccgagguggcgaaccuggacaucaucgggcagcgcaucgagaacaucaagcacgagcacaagagcaccuggcacuacgacgaggacaaccccuacaagacgugggccuaccacggcuccuacgaggucaagccgagcggguccgccagcagcauggugaacggcgucgugaagcugcucaccaagcccugggacgugauccccauggucacccagaucgccaugaccgacacgacccccuucgggcagcagcggguguucaaggagaagguggacacccgcaccccgaaggccaagcggggcacggcgcagaucauggaggucaccgccaaguggcuguggggcuuccugucccgcaacaagaagccccggaucugcacccgcgaggaguucacccggaaggugcgcagcaacgccgccaucggggcgguguucgucgacgagaaccaguggaacuccgccaaggaggccguggaggacgagcgguucugggaccucgugcaccgcgagcgggagcugcacaagcagggcaagugcgccacgugcgucuacaacaugauggggaagcgcgagaagaagcugggcgaguucgggaaggccaagggcagccgggcgaucugguacauguggcucggcgcccgcuuccuggaguucgaggcccugggguucaugaacgaggaccacugguucucccgggagaacagccucuccggcguggagggggagggccugcacaagcugggguacauccuccgcgacaucagcaagauccccggcggcaacauguacgccgacgacaccgccgggugggacacccggaucaccgaggacgaccugcagaacgaggcgcgcaucacggacaucauggagccggagcacgcccugcucgccaaguccaucuucaagcugaccuaccagaacaaggugguccgcgugcagcggcccgccaagaacggcaccgugauggacgucaucagccgccgggaccagcgcggguccggccaggugggcaccuacgggcugaacacguucaccaacauggaggcccagcucauccggcagauggagagcgagggcaucuucucccccagcgagcuggagacccccaaccuggcggagcgcgugcucgacuggcuggagaaguacggggucgagcggcugaagcgcauggccaucuccggcgacgacugcguggugaagccgaucgacgaccgguucgccaccgcccucacggcccugaacgacauggggaagguccgcaaggacaucccccagugggagcccagcaagggcuggaacgacuggcagcagguccccuucugcucccaccacuuccaccagcugaucaugaaggacggccgggagaucguggucccgugccgcaaccaggacgagcucguggggcgggcgcgcgugagccagggcgccggguggagccugcgggagaccgccugccugggcaaguccuacgcccagauguggcagcucauguacuuccaccgccgggaccugcgccuggcggccaacgccaucugcagcgccguccccguggacuggauccccaccucccggaccacguggagcauccacgcccaccaccaguggaugaccaccgaggacaugcucuccguguggaaccgcgucuggaucgaggagaaccccuggauggaggacaagacccacaucagcuccuggggcgacgugccguaccugggcaagcgcgaggaccaguggugcggcagccugaucgggcucacggcgcgggccaccugggccaccaacauccagguggccaucaaccagguccgccggcugaucggcaacgagaacuaccuggacuacaugaccuccaugaagcgcuucaagaacgagagcgaccccgagggggcccucugguga

SEQ ID NO: 8376 - RNA, 9879 nt, Artificial Sequence
  derived and/or modified CDS sequence (opt1) from DENV-1__FJ432746__SS-prME
agcgugaccaugcugcugaugcugaugcccaccgcccuggccuuccaccucacgacccgcggcggggagccccacaugaucgugagcaagcaggagcggggcaagagccugcuguucaagaccuccgcgggggugaacaugugcacccucaucgccauggaccugggcgaguucugcgaggacacgaugaccuacaagugcccccgcaucaccgaggccgagcccgacgacguggacugcuggugcaacgccaccgacacgugggucaccuacgggaccugcagccagaccggcgagcaccggcgcgacaagcgguccguggcccuggcgccccacgugggccucgggcuggagacgcgcaccgagaccuggaugagcuccgagggcgccuggaagcagauccagcgggucgagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugcccgacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaagaucguccaguacgagaaccugaaguacagcgugaucgugaccguccacaccggcgaccagcaccagguggggaacgaguccacggagcacggcaccaccgcgaccaucacgccccaggcccccagcacggagauccagcugaccgacuacggggcccucacccuggacugcagcccccgcaccggccuggacuucaacgagaugguccuccugacgaugaaggagaaguccuggcuggugcacaagcagugguuccucgaccugccgcugcccuggaccagcggggccuccaccagccaggagaccuggaaccggcaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcauguccuacgucaugugcaccgggagcuucaagcuggagaaggagguggcggagacccagcacggcacggugcucguccagaucaaguacgagggcaccgacgcccccugcaagauccccuucuccacccaggacgagaagggggugacccagaacggccggcugaucacggccaacccgaucgugaccgacaaggagaagcccgucaacaucgaggccgagccgcccuucggggagagcuacaucgugaucggcgcgggcgagaaggcccugaagcuguccugguucaagaaggggagcuccaucggcaagauguucgaggccaccgcccgcggggcccggcgcauggcgauccucggcgacaccgccugggacuucgggagcaucggcggcguguucacguccgucgggaagcuggugcaccagaucuucggcaccgccuacggggugcuguucagcggcgucuccuggaccaugaagaucgggaucggcgugcuccugaccuggcugggccucaacagccgcuccacgagccuguccaugaccugcaucgccguggggcuggucacccucuaccugggcgugauggugcaggccgacagcgggugcgucaucaacuggaagggccgggagcugaagugcgggagcggcaucuucgugaccaacgaggugcacacguggaccgagcaguacaaguuccaggcggacuccccgaagcgccucagcgccgccaucggcaaggccugggaggagggggucugcggcauccgguccgccacccgccuggagaacaucauguggaagcagaucagcaacgagcugaacuacauccuccuggagaacgacaugaagcugaccgugguggucggggacguggcgggcauccucgcccaggggaagaagaugauccggccccagcccauggaguacaaguacuccuggaaguccuggggcaaggccaagaucaucggcgccgacgugcagaacaccacguucaucaucgacgggcccaacaccccggagugccccgacgaccagcgcgcguggaacaucugggaggucgaggacuacggcuucgggaucuucaccaccaacaucuggcugaagcugcgggacuccuacacccaggugugcgaccaccgccucaugagcgccgccaucaaggacaccaaggccgugcacgccgacaugggcuacuggaucgaguccgagaagaacgagaccuggaagcuggcgcgggccagcuucaucgaggucaagaccugcaucuggcccaagucccacacgcuguggagcaacggcgugcucgaguccgagaugaucauccccaagaucuacgggggcccgaucagccagcacaacuaccgccccggguacuucacccagaccgccggccccuggcaccuggggaagcuggagcucgacuucgaccugugcgagggcaccacgguggucguggacgagcacugcggcaaccgggggccgucccugcgcaccaccaccgugacgggcaagaucauccacgaguggugcugccggagcugcacccugccgccccuccgcuucaagggggaggacggcugcugguacgggauggagauccggcccgucaaggagaaggaggagaaccuggugaaguccauggugagcgccggcagcggcgaggucgacuccuucagccucgggcugcugugcaucuccaucaugaucgaggaggugaugcgcagccgguggucccgcaagaugcucaugaccggcacccuggccguguucuuccugcucaucauggggcagcugacguggaacgaccugauccggcucugcaucauggucggcgcgaacgccagcgaccgcauggggaugggcaccaccuaccuggcccugauggccaccuucaagaugcgcccgauguucgccgugggccuccuguuccggcgccugacgucccgggaggugcuccugcugaccaucgggcucagccuggucgcguccguggagcugcccaacagccucgaggagcugggcgacgggcuggccaugggcaucaugauccucaagcugcugaccgacuuccagucccaccagcucugggccacccugcugagccucacguucguccgcaccaccuucucccugcacuacgccuggaagaccauggcgauggugcugagcaucgugucccucuucccccugugccugagcacgaccucccagaagaccaccuggcuccccguccugcugggcagccucgggugcaagccgcugacgauguuccugaucgccgagaacaagaucuggggccggaaguccuggccccucaacgaggggaucauggccgugggcaucgugagcauccugcugagcucccuccugaagaacgacgucccccuggccgggccccucaucgccggcggcaugcugaucgcgugcuacgugaucagcggguccagcgccgaccugucccucgagaaggccgccguggucagcugggaggaggaggccgagcacuccggcgcgagccacaacauccugguggaggugcaggacgacgggaccaugaagaucaaggacgaggagcgcgacgacacccugaccauccuccugaaggccacccugcucgccgucuccggcguguacccgcugagcauccccgccacgcuguucgugugguacuucuggcagaagaagaagcagcgguccgggguccucugggacacccccagcccgcccgagguggagcgcgccgugcuggacgacggcaucuaccggaucaugcagcgcggccugcuggggcggucccaggucggcguggggguguuccaggagaacgucuuccacaccauguggcacgugacccgcggcgcggugcucauguaccaggggaagcggcuggagcccagcugggccuccgucaagaaggaccugaucagcuacggcggcggguggcgccuccagggcuccuggaacacgggggaggagguccaggugaucgccgucgagcccggcaagaaccccaagaacgugcagaccgcccccgggaccuucaagaccagcgagggcgaggugggcgccaucgcgcuggacuucaagcccgggacguccggcagccccaucgucaaccgggaggggaagaucgugggccuguacggcaacgggguggucaccaccagcggcaccuacguguccgccaucgcccaggccaaggcgagccaggaggggccccucccggagaucgaggacgagguguuccgcaagcggaaccugacgaucauggaccugcaccccggcuccgggaagacccgccgguaccuccccgccaucguccgcgaggccaucaagcggaagcugcgcacccugauccucgccccgacccgcgugguggccagcgagauggcggaggcccugaagggcaugcccauccgguaccagacgaccgccgucaaguccgagcacaccggcaaggagaucguggaccugaugugccacgccaccuucacgaugcgccuccugagccccgugcggguccccaacuacaacaugaucaucauggacgaggcccacuucaccgacccguccagcaucgcggcccgcggguacaucuccacccgggugggcaugggggaggccgccgccaucuucaugaccgcgacgccgcccggcagcguggaggccuucccccaguccaacgccgucauccaggacgaggagcgcgacaucccggagcggagcuggaacuccggguacgaguggaucaccgacuuccccggcaagaccgugugguucgugcccagcaucaaguccggcaacgacaucgccaacugccugcgcaagaacgggaagcgggucauccagcucagccgcaagaccuucgacacggaguaccagaagaccaagaacaacgacugggacuacguggugaccaccgacaucuccgagaugggcgcgaacuuccgggccgaccgcgucaucgacccccggcgcugccugaagccggugauccugaaggacgggcccgagcgggucauccucgccggccccaugcccgugacgguggccagcgccgcgcagcgccgggggcgcaucggccggaaccacaacaaggagggcgaccaguacaucuacauggggcagccgcugaacaacgacgaggaccacgcccacuggaccgaggccaagaugcugcucgacaacaucaacacccccgagggcaucauccccgcccuguucgagcccgagcgcgagaaguccgccgcgaucgacggggaguaccgccugcggggcgaggcccgcaagaccuucgucgagcucaugcggcgcggggaccugccgguguggcugagcuacaagguggccagcgagggcuuccaguacuccgaccggcgcuggugcuucgacggcgagcggaacaaccagguccucgaggagaacauggacguggagaucuggacgaaggagggggagcgcaagaagcugcggccccgcuggcuggacgcccggaccuacagcgacccccucgcccugcgcgaguucaaggaguucgcggccggccggcgcuccgugagcggggaccugauccucgagaucggcaagcugccccagcaccugacccagcgggcccagaacgcccucgacaaccuggucaugcugcacaacuccgagcagggcgggcgcgcguaccggcacgccauggaggagcucccggacaccaucgagacgcugaugcugcucgcccugaucgccgugcugaccggcggggugacccucuucuuccugagcggccgcgggcugggcaagaccuccaucggccuccugugcgucauggccagcuccgugcugcucuggauggcgagcguggagccccacuggaucgccgccuccaucauccuggaguucuuccugaugguccuccugauccccgagcccgaccggcagcgcaccccgcaggacaaccagcuggccuacguggugaucgggcuccuguucaugauccugacggucgccgcgaacgagaugggccuccuggagaccaccaagaaggaccuggggaucggccacguggccguggagaaccaccaccacgccgccaugcucgacgucgaccugcaccccgccagcgcguggacccuguacgccguggccacgaccaucaucacccccaugaugcggcacaccaucgagaacacgaccgccaacaucucccucaccgccaucgcgaaccaggccgccauccugauggggcuggacaagggcuggccgaucagcaagauggacaucggcgugccccuccuggcccuggggugcuacucccaggucaacccccucacccugacggcggccgugcugaugcucguggcccacuacgccaucaucggccccgggcugcaggccaaggcgacccgcgaggcccagaagcgcaccgccgccggcaucaugaagaacccgaccgucgacgggaucguggccaucgaccuggaccccguggucuacgacgcgaaguucgagaagcagcucggccagaucaugcugcugauccucugcacgagccagauccugcugaugcggaccaccugggcccucugcgaguccaucacccuggccacgggcccccugaccacccucugggaggggagccccggcaaguucuggaacaccacgaucgccguguccauggccaacaucuuccgcgggagcuaccuggcgggcgccggccuggccuucagccucaugaagucccucgggggcgggcggcgcgggaccggggcccagggcgagacccugggcgagaaguggaagcggcagcucaaccagcugagcaaguccgaguucaacaccuacaagcgcagcgggaucauggagguggaccgguccgaggcgaaggagggccugaagcgcggggagacgaccaagcacgccgucagccggggcaccgccaagcuccgcugguucguggagcggaaccuggugaagccggaggggaaggucaucgaccugggcugcggccgcgggggcugguccuacuacugcgccgggcugaagaaggugaccgaggugaagggcuacacgaagggcgggcccggccacgaggagcccauccccauggccaccuacggguggaaccucgucaagcugcacagcggcaaggacguguucuucaucccgcccgagaagugcgacacccugcucugcgacaucggggaguccagccccaaccccaccaucgaggagggccggacgcugcgcgugcugaagauggucgagccguggcuccgggggaaccaguucugcaucaagauccugaaccccuacaugcccuccgugguggagacccuggagcagaugcagcgcaagcacggcggcaugcucguccggaacccccugagccgcaacuccacccacgagauguacugggugagcugcgggaccggcaacaucguguccgcggucaacaugaccagccggaugcugcucaaccgcuucacgauggcccaccgcaagccgaccuacgagcgggacguggaccugggggccggcacccgccacguggccgucgagcccgagguggccaaccuggacaucaucggccagcggaucgagaacaucaagcacgagcacaaguccaccuggcacuacgacgaggacaaccccuacaagacgugggcguaccacgggagcuacgaggucaagcccuccggcagcgccagcuccauggugaacgggguggucaagcuccugaccaagccgugggacgugauccccauggugacccagaucgccaugaccgacacgacccccuucggccagcagcgcgucuucaaggagaagguggacacccggacccccaaggccaagcgcgggacggcccagaucauggaggugaccgcgaaguggcuguggggcuuccucagccggaacaagaagccgcgcaucugcacccgggaggaguucacccgcaagguccgguccaacgccgccaucggcgccguguucguggacgagaaccaguggaacagcgcgaaggaggccgucgaggacgagcgcuucugggaccuggugcaccgggagcgcgagcugcacaagcaggggaagugcgccacgugcguguacaacaugaugggcaagcgggagaagaagcucggggaguucggcaaggccaaggggucccgcgccaucugguacauguggcugggcgcgcgguuccuggaguucgaggcccucggcuucaugaacgaggaccacugguucagccgcgagaacucccugagcggggucgagggcgaggggcugcacaagcucggcuacauccugcgggacaucuccaagauccccgggggcaacauguacgccgacgacaccgccggcugggacacccgcaucaccgaggacgaccugcagaacgaggccaagaucacggacaucauggagcccgagcacgcgcuccuggccaagagcaucuucaagcugaccuaccagaacaagguggugcggguccagcgcccggccaagaacgggaccgugauggacgugaucucccgccgggaccagcgcggcagcgggcaggucggcaccuacggccucaacacguucaccaacauggaggcccagcugauccggcagauggaguccgaggggaucuucagccccuccgagcuggagacccccaaccucgccggccgcgugcuggacuggcuggagaagcacgggguggagcggcucaagcgcauggcgaucagcggcgacgacugcgucgugaagcccaucgacgaccgguucgccaccgcccugacggcccugaacgacauggggaaggugcgcaaggacaucccgcagugggagcccuccaagggcuggaacgacuggcagcagguccccuucugcagccaccacuuccaccagcucaucaugaaggacggccgggagaucguggugcccugccgcaaccaggacgagcuggucgggcgggcccgcgugagccagggcgcgggguggucccugcgggagaccgccugccucggcaagagcuacgcccagauguggcagcugauguacuuccaccgccgggaccugcgccucgccgcgaacgccaucugcuccgccgugccggucgacugggugcccaccagccggaccacgugguccauccacgcccaccaccaguggaugaccaccgaggacaugcugagcguguggaaccgcgucuggaucgaggagaaccccuggauggaggacaagacccacaucuccagcuggggcgacgugcccuaccugggcaagcgggaggaccaguggugcggcucccucaucgggcugacggcccgcgcgaccugggccaccaacauccagguggccaucaaccagguccgccggcugcucggcaacgagaacuaccuggacuacaugaccagcaugaagcgcuucaagaacgaguccgacccggagggggcccugugguga

SEQ ID NO: 8377 - RNA, 9879 nt, Artificial Sequence
  derived and/or modified CDS sequence (opt1) from DENV-1__FJ432748__SS-prME
agcgugaccaugcugcugaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgagaccgagcccgacgacguggacugcuggugcaacgccacggacaccugggugaccuacgggaccugcagccagacgggcgagcaccggcgcgacaagcgguccguggcccucgcgccccacgugggccuggggcuggagacccggaccgagaccuggaugagcuccgagggcgcguggaagcagauccagcgggucgagacgugggcccuccgccaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagguggccgagacccagcacggcaccgugcugguccagaucaaguacgagggcaccgacgcgcccugcaaggugcccuucagcacgcaggacgagaagggggugacccagaacggccggcugaucaccgccaacccgaucgucaccgacaaggagaagcccgugaacaucgaggccgagccgcccuucggggaguccuacaucgugaucggcgccggcgagaaggcgcugaagcucagcugguucaagaagggguccagcaucggcaagauguucgaggccacggcccgcggggcccggcgcauggccauccugggcgacaccgcgugggacuucggguccaucggcggcgucuucaccagcguggggaagcuggugcaccagaucuucggcaccgccuacgggguccucuucuccggcgugagcuggacgaugaagaucgggaucggcgugcugcugaccuggcucggccugaacucccgcagcaccucccugagcaugaccugcaucgccgucgggcucgugacgcuguaccugggcgugaugguccaggccgacuccgggugcgugaucaacuggaagggccgggagcucaagugcgggagcggcaucuucgugaccaacgagguccacaccuggaccgagcaguacaaguuccaggccgacagcccgaagcgccuguccgcggccaucggcaaggccugggaggagggggugugcggcauccggagcgccacccgccuggagaacaucauguggaagcagaucuccaacgagcucaaccacauccugcuggagaacgacaugaaguucacgguggucgugggggacguggccggcauccucgcgcaggggaagaagaugauccggccccagcccauggaguacaaguacagcuggaaguccuggggcaaggccaagaucaucggcgccgacguccagaacaccaccuucaucaucgacgggcccaacaccccggagugccccgacgaccagcgcgccuggaacaucugggagguggaggacuacggcuucgggaucuucacgaccaacaucuggcugaagcugcgggacagcuacacccaggugugcgaccaccgccucauguccgcggccaucaaggacagcaaggccguccacgccgacaugggcuacuggaucgaguccgagaagaacgagaccuggaagcuggcccgggcgagcuucaucgaggugaagacgugcaucuggcccaagucccacacccuguggagcaacggcgugcucgaguccgagaugaucauccccaagaucuacgggggcccgaucagccagcacaacuaccgccccggguacuucacccaggccgccggccccuggcaccuggggaagcuggagcucgacuucgaccugugcgagggcaccacggucgugguggacgagcacugcggcaaccgggggccgucccugcgcaccaccaccgucacgggcaagaucauccacgaguggugcugccggagcugcacccugccgccccuccgcuucaagggggaggacggcugcugguacgggauggagauccggcccgugaaggagaaggaggagaaccuggugaaguccauggucagcgccggcagcggcgagguggacuccuucagccucgggcugcugugcaucuccaucaugaucgaggaggugaugcgcagccgguggucccgccggaugcucaugaccggcacccuggccgucuucuuccugcucaucauggggcagcugacguggaacgaccugauccgccucugcaucauggugggcgcgaacgccagcgaccgcauggggaugggcaccaccuaccuggcccugauggccaccuucaagaugcggccgauguucgccgugggccuccuguuccgccggcugacgucccgcgagguccuccugcugaccaucgggcucagccugguggcguccgucgagcugcccaacagccucgaggagcugggcgacgggcuggccaugggcaucaugauccucaagcugcugaccgacuuccagucccaccagcucugggccacccugcugagccucacguucaucaagaccaccuucucccugcacuacgccuggaagaccauggcgauggugcugagcaucgugucccucuucccccugugccugagcacgaccucccagaagaccaccuggcuccccguccugcugggcagccucgggugcaagccgcugacgauguuccugaucgccgagaacaagaucuggggccggcgcuccuggccccucaacgaggggaucauggccgugggcaucgugagcauccugcugagcucccuccugaagaacgacgucccccuggccgggccccucaucgccggcggcaugcugaucgcgugcuacgugaucagcggguccagcgccgaccugucccucgagaaggccgccgaggugagcugggaggaggaggccgagcacuccggcgcgagccacaacauccuggucgaggugcaggacgacgggaccaugaagaucaaggacgaggagcgggacgacacccugaccauccuccugaaggccacccugcucgccguguccggcgucuacccgcugagcauccccgccacgcuguucgugugguacuucuggcagaagaagaagcagcgcuccggggugcucugggacacccccagcccgcccgaggucgagcgggccgugcuggacgacggcaucuaccgcaucaugcagcggggccugcuggggcgcucccaggugggcgucgggguguuccaggagaacguguuccacaccauguggcacgucacccggggcgcggugcucauguaccaggggaagcgccuggagcccagcugggccuccgugaagaaggaccugaucagcuacggcggcggguggcggcuccagggcuccuggaacacgggggaggagguccaggugaucgccguggagcccggcaagaaccccaagaacguccagaccgcccccgggaccuucaagacccccgagggcgaggugggcgccaucgcgcuggacuucaagcccgggacgagcggcucccccaucgugaaccgcgaggggaagaucgucggccuguacggcaacgggguggugaccaccagcggcaccuacgucagcgccaucgcccaggccaaggcgucccaggaggggccgcuccccgagaucgaggacgagguguuccggaagcgcaaccugacgaucauggaccugcaccccggcagcgggaagacccggcgcuaccucccggccaucgugcgggaggccaucaagcgcaagcugcgcacccugauccucgcccccacccgggucguggccuccgagauggcggaggcccugaagggcaugcccauccgcuaccagacgaccgccgucaagagcgagcacaccggcaaggagaucgucgaccugaugugccacgccaccuucacgaugcggcuccugucccccgugcgcgugccgaacuacaacaugaucaucauggacgaggcccacuucaccgaccccagcuccaucgcggcccggggguacaucagcacccgcgucggcaugggggaggccgccgccaucuucaugaccgcgacgccgcccggcuccguggaggccuucccgcagagcaacgccgugauccaggacgaggagcgggacauccccgagcgcuccuggaacagcggguacgaguggaucaccgacuuccccggcaagaccgucugguucgugcccuccaucaagagcggcaacgacaucgccaacugccugcggaagaacgggaagcgcgugauccagcucucccggaagaccuucgacacggaguaccagaagaccaagaacaacgacugggacuacgucgugaccaccgacaucagcgagaugggcgcgaacuuccgcgccgaccgggugaucgacccgcgccggugccugaagcccgucauccugaaggacgggcccgagcgcgugauccucgccggccccaugccggucacgguggccuccgccgcgcagcggcgcgggcggaucggccgcaaccacaacaaggagggcgaccaguacaucuacauggggcagccccugaacaacgacgaggaccacgcccacuggaccgaggccaagaugcugcucgacaacaucaacacccccgagggcaucauccccgcccuguucgagccggagcgcgagaaguccgccgcgaucgacggggaguaccggcugcgcggcgaggcccggaagaccuucguggagcucaugcgccgcggggaccugcccgucuggcuguccuacaagguggccagcgagggcuuccaguacagcgaccgccgguggugcuucgacggcgagcgcaacaaccaggugcucgaggagaacauggacgucgagaucuggacgaaggagggggagcggaagaagcugcgcccccgguggcuggacgcccgcaccuacuccgacccccucgcccugcgggaguucaaggaguucgcggccggccgccggagcguguccggggaccugauccucgagaucggcaagcugccgcagcaccugacccagcgcgcccagaacgcccucgacaaccuggugaugcugcacaacagcgagcagggcgggcgggcguaccgccacgccauggaggagcuccccgacaccaucgagacgcugaugcugcucgcccugaucgccguccugaccggcggggugacccucuucuuccuguccggccgggggcugggcaagaccagcaucggccuccugugcgugauggccuccagcguccugcucuggauggcguccguggagccccacuggaucgccgccagcaucauccuggaguucuuccugauggugcuccugauccccgagccggaccgccagcggacgccccaggacaaccagcuggccuacgucgugaucgggcuccuguucaugauccugacgguggccgcgaacgagaugggccuccuggagaccaccaagaaggaccuggggaucggccacgucgccguggagaaccaccaccacgccgccaugcucgacguggaccugcaccccgccuccgcguggacccuguacgccgucgccacgaccaucaucaccccgaugaugcgccacaccaucgagaacacgaccgccaacaucagccucaccgccaucgcgaaccaggccgccauccugauggggcuggacaagggcuggcccaucuccaagauggacaucggcgugccccuccuggcccuggggugcuacagccaggugaacccccucacccugacggcggccguccugaugcucguggcccacuacgccaucaucggcccggggcugcaggccaaggcgacccgcgaggcccagaagcggaccgccgccggcaucaugaagaaccccaccguggacgggaucgucgccaucgaccuggaccccgugguguacgacgcgaaguucgagaagcagcucggccagaucaugcugcugauccucugcacgucccagauccugcugaugcgcaccaccugggcccucugcgagagcaucacccuggccacgggcccccugaccacccucugggagggguccccgggcaaguucuggaacaccacgaucgccgucagcauggccaacaucuuccggggguccuaccuggcgggcgccggccuggccuucagccucaugaagucccucgggggcgggcgccgggggaccggggcccagggcgagacccugggcgagaaguggaagcgccagcucaaccagcuguccaagagcgaguucaacaccuacaagcgguccgggaucauggagguggaccgcagcgaggcgaaggagggccugaagcgcggggagacgaccaagcacgccgugucccgcggcaccgccaagcuccggugguucgucgagcgcaaccuggugaagcccgaggggaaggugaucgaccugggcugcggccgcggcggguggagcuacuacugcgccgggcugaagaaggucaccgaggugaagggguacacgaagggcggccccggccacgaggagcccaucccgauggccaccuacggguggaaccucgugaagcugcacuccggcaaggacgucuucuucaucccgcccgagaagugcgacacccugcucugcgacaucggggagagcucccccaacccgaccaucgaggagggccgcacgcugcgggugcugaagaugguggagcccuggcuccgcgggaaccaguucugcaucaagauccugaaccccuacaugcccagcgucguggagacccuggagcagaugcagcggaagcacggcggcaugcucgugcgcaacccgcugucccggaacagcacccacgagauguacugggucuccugcgggaccggcaacaucgugagcgcggugaacaugaccucccgcaugcugcucaaccgcuucacgauggcccaccggaagcccaccuacgagcgcgacgucgaccugggggccggcacccggcacguggccguggagcccgaggucgccaaccuggacaucaucggccagcgcaucgagaacaucaagcacgagcacaagagcaccuggcacuacgacgaggacaaccccuacaagacgugggcguaccacggguccuacgaggugaagccgagcggcuccgccagcagcauggucaacgggguggugaagcuccugaccaagcccugggacgucauccccauggugacccagaucgccaugaccgacacgacccccuucggccagcagcggguguucaaggagaaggucgacacccgcaccccgaaggccaagcgggggacggcccagaucauggaggugaccgcgaaguggcuguggggcuuccucucccgcaacaagaagccccggaucugcacccgcgaggaguucacccggaaggugcgcagcaacgccgccaucggcgccgucuucguggacgagaaccaguggaacuccgcgaaggaggccguggaggacgagcgguucugggaccugguccaccgcgagcgggagcugcacaagcaggggaagugcgccacgugcguguacaacaugaugggcaagcgcgagaagaagcucggggaguucggcaaggccaaggggagccgggccaucugguacauguggcugggcgcgcgcuuccuggaguucgaggcccucggcuucaugaacgaggaccacugguucucccgggagaacagccuguccgggguggagggcgaggggcugcacaagcucggcuacauccugcgcgacaucagcaagauccccgggggcaacauguacgccgacgacaccgccggcugggacacccggaucaccgaggacgaccugcagaacgaggcccgcaucacggacaucauggagccggagcacgcgcuccuggccaaguccaucuucaagcugaccuaccagaacaaggucgugcgcgugcagcggcccgccaagaacgggaccgucauggacgugaucagccgccgggaccagcgcggcuccggccaggugggcaccuacggccucaacacguucaccaacauggaggcccagcugauccggcagauggagagcgaggggaucuucucccccagcgagcuggagacccccaaccucgccgagcgcguccuggacuggcuggagaaguacggcguggagcggcucaagcgcauggcgaucuccggggacgacugcguggucaagccgaucgacgaccgguucgccaccgcccugacggcccugaacgacaugggcaaggugcgcaaggacaucccccagugggagcccagcaagggguggaacgacuggcagcagguccccuucugcucccaccacuuccaccagcucaucaugaaggacggccgggagaucgucgugccgugccgcaaccaggacgagcuggugggccgggcccgcgucagccagggggcgggcuggagccugcgggagaccgccugccucgggaaguccuacgcccagauguggcagcugauguacuuccaccgccgggaccugcgccucgccgcgaacgccaucugcagcgccgugcccguggacuggauccccaccucccggaccacguggagcauccacgcccaccaccaguggaugaccaccgaggacaugcuguccgucuggaaccgcguguggaucgaggagaaccccuggauggaggacaagacccacaucagcuccuggggcgacgugccguaccuggggaagcgcgaggaccaguggugcggcagccucaucggccugacggcccgggcgaccugggccaccaacauccaggucgccaucaaccaggugcgccggcugaucgggaacgagaacuaccucgacuacaugaccuccaugaagcgcuucaagaacgagagcgaccccgagggcgcccugugguga

SEQ ID NO: 8378 - RNA, 9879 nt, Artificial Sequence
  derived and/or modified CDS sequence (opt1) from DENV-1__FJ432749__SS-prME
agcgugaccaugcugcucaugcugaugcccaccgcccuggccuuccaccucaccacccgcggcggggagccccacaugaucgugaccaagcaggagcggggcaagagccugcuguucaagaccagcgcgggggugaacaugugcacccucaucgccauggaccugggcgagcugugcgaggacaccaugaccuacaagugcccccggaucaccgaggccgagcccgacgacguggacugcuggugcaacgccaccgacaccugggucaccuacgggaccugcucccagacgggcgagcaccggcgcgacaagcggagcguggcccucgcgccccacgugggccuggggcuggagacccgcaccgagaccuggauguccagcgagggcgccuggaagcagauccagcgggucgagacgugggcccuccgccaccccggguucaccgugaucgcccuguuccuggcgcacgccaucggcaccuccaucacccagaaggggaucaucuucauccuccugaugcuggugacgcccagcauggccaugcggugcgucggcaucggcucccgcgacuucguggaggggcucagcggcgccaccuggguggacgucgugcuggagcacggguccugcgugaccaccauggccaaggacaagcccacgcuggacaucgagcuccugaagaccgaggucaccaaccccgcggugcugcggaagcucugcaucgaggccaagaucagcaacaccacgaccgacucccgcugccccacccagggcgaggccacccugauggaggagcaggacgccaacuucgugugccggcgcacguucgucgaccggggcugggggaacggcugcgggcuguucggcaaggggagccucaucacgugcgccaaguucaagugcgugaccaagcuggagggcaagaucgugcaguacgagaaccugaaguacuccgucaucgugaccgugcacacgggcgaccagcaccaggucgggaacgagagcaccgagcacggcaccaccgcgaccaucacgccccaggcccccaccuccgagauccagcucaccgacuacggggcccugacccuggacugcagcccccgcacgggccucgacuucaacgagauggugcugcugaccaugaaggagaaguccuggcucguccacaagcagugguuccuggaccugccgcuccccuggaccagcggggccagcaccucccaggagacguggaaccggcaggaccugcuggugaccuucaagaccgcccacgcgaagaagcaggagguggucgugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgugaugugcaccggguccuucaagcucgagaaggaggucgcggagacgcagcacggcaccgugcuggugcagaucaaguacgagggcaccgacgcccccugcaagauccccuuccugacccaggacgagaagggggucacgcagaacggccggcugaucaccgccaacccgaucgugaccgacaaggagaagcccgugaacaucgaggccgagccgcccuucggggagagcuacaucgucaucggcgcgggcgagaaggcccucaagcuguccugguucaagaaggggagcuccaucggcaagauguucgaggccaccgcccgcggggcccggcgcauggcgauccugggcgacacggccugggacuucgggagcaucggcggcguguucaccuccguggggaagcucguccaccagaucuucggcaccgccuacggggugcuguucagcggcguguccuggaccaugaagaucgggaucggcguccugcucacguggcugggccugaacagccgcuccaccagccucuccaugaccugcaucgccguggggcuggugacccuguaccucggcgucauggugcaggccgacagcgggugcgugaucaacuggaagggccgggagcugaagugcggguccggcaucuucgucacgaacgaggugcacaccuggaccgagcaguacaaguuccaggcggacagcccgaagcgccugagcgccgccaucggcaaggccugggaggagggggugugcggcauccgguccgccacccgccucgagaacaucauguggaagcagaucagcaacgagcugaaccacauccugcucgagaacgacaugaaguucaccgucguggugggggacgucgugggcauccuggcgcaggggaagaagaugauccggccccagcccauggagcacaaguacuccuggaaguccuggggcaaggccaagaucaucggcgccgacgugcagaacacgaccuucaucaucgacgggcccaacaccccggagugccccgacgaccagcgcgccuggaacaucugggaggucgaggacuacggcuucgggaucuucaccacgaacaucuggcugaagcuccgggacuccuacacccaggugugcgaccaccgccugaugagcgcggccaucaaggacuccaaggccgugcacgccgacaugggcuacuggaucgagagcgagaagaacgagaccuggaagcuggcccgggcguccuucaucgaggucaagaccugcaucuggcccaagagccacacgcucugguccaacggcgugcuggagagcgagaugaucauccccaagaucuacgggggcccgaucucccagcacaacuaccgccccggguacuucacccagaccgccggccccuggcaccuggggaagcucgagcuggacuucgaccugugcgagggcaccacgguggucguggacgagcacugcggcaaccgggggccgagccuccgcaccaccaccgugacgggcaagaucauccacgaguggugcugccgguccugcacccugccgccccugcgcuucaagggggaggacggcugcugguacgggauggagauccggcccgucaaggagaaggaggagaaccucgucaagagcaugguguccgccggcagcggcgaggucgacagcuucucccuggggcugcucugcaucagcaucaugaucgaggaggugaugcgcucccgguggagccgcaagaugcugaugaccggcacccuggccguguuccuccugcugaucauggggcagcucacguggaacgaccugauccggcugugcaucauggucggcgccaacgcguccgaccgcauggggaugggcaccaccuaccucgcccugauggccaccuucaagaugcgcccgauguucgccgugggccuccuguuccggcgccugacgagccgggaggugcugcuccugaccaucgggcugucccucgucgccagcguggagcugcccaacucccuggaggagcucggcgacgggcuggcgaugggcaucaugauccugaagcuccugaccgacuuccagagccaccagcugugggccacccuccugucccugacguucaucaagaccacccucagccugcacuacgccuggaagaccauggccaugguccuguccaucgugagccucuucccccugugccuguccacgaccagccagaagaccaccuggcuccccgugcugcugggcucccucgggugcaagccgcugacgauguuccugaucgcggagaacaagaucuggggccgcaagagcuggccccucaacgaggggaucauggccgucggcgugguguccauccugcugagcagccuccugaagaacgacgucccccuggccgggccccucaucgccggcggcaugcugaucgccugcuacgugaucuccgggagcuccgcggaccugagccucgagaaggccgccgagguguccugggaggaggaggccgagcacagcggcgccucccacaacauccuggucgaggugcaggacgacgggaccaugaagaucaaggacgaggagcgggacgacacccugaccauccuccugaaggcgacccugcucgccgugagcggcgucuacccgcuguccauccccgccacgcuguucgugugguacuucuggcagaagaagaagcagcgcagcggggugcugugggacacccccagcccgcccgaggucgagaaggccgugcucgacgacggcaucuaccggaucaugcagcgcggccugcuggggcggagccaggugggcgucgggguguuccaggagaacguguuccacaccauguggcacgucacccgcggcgccgugcucauguaccaggggaagcggcuggagcccuccugggcgagcgugaagaaggaccugaucuccuacggcggcggguggcgccuccagggcagcuggaacacgggggaggagguccaggugaucgccguggagcccggcaagaaccccaagaacguccagaccgcccccgggaccuucaagacccccgagggcgaggugggcgccaucgcccuggacuucaagcccgggacguccggcagccccaucgugaaccgggaggggaagaucgucggccuguacggcaacgggguggugaccaccuccggcaccuacgucagcgcgaucgcccaggccaaggccagccaggaggggccgcuccccgagaucgaggacgagguguuccgcaagcggaaccugacgaucauggaccugcaccccggcuccgggaagacccgccgguaccucccggcgaucgugcgcgaggccaucaagcggaagcugcgcacccugauccucgcccccacccgggucguggccagcgagauggccgaggcgcugaagggcaugcccauccgcuaccagacgaccgccgugaaguccgagcacaccggcaaggagaucgucgaccugaugugccacgccaccuucacgaugcgccuccugagccccgugcgggugccgaacuacaacaugaucaucauggacgaggcccacuucaccgaccccuccagcaucgccgcgcgcggguacaucuccacccgggucggcaugggggaggccgccgccaucuucaugaccgccacgccgcccggcagcguggaggcguucccgcaguccaacgccgugauccaggacgaggagcgcgacauccccgagcggagcuggaacuccggguacgaguggaucaccgacuuccccggcaagaccgucugguucgugcccagcaucaaguccggcaacgacaucgccaacugccugcgcaagaacgggaagcgggugauccagcucagccgcaagaccuucgacacggaguaccagaagaccaagaacaacgacugggacuacgucgugaccaccgacaucuccgagaugggcgccaacuuccgggcggaccgcgugaucgacccgcggcgcugccugaagcccgucauccugaaggacgggcccgagcgggugauccucgccggccccaugccggucacgguggccagcgccgcccagcgccgggggcgcaucggccggaaccacaacaaggagggcgaccaguacaucuacauggggcagccccugaacaacgacgaggaccacgcgcacuggaccgaggccaagaugcugcucgacaacaucaacacccccgagggcaucauccccgcccuguucgagccggagcgcgagaaguccgccgccaucgacggggaguaccggcugcgcggcgaggcgcgcaagaccuucguggagcucaugcggcgcggggaccugcccgucuggcugagcuacaagguggccuccgagggcuuccaguacagcgaccggcgcuggugcuucgacggcgagcggaacaaccaggugcucgaggagaacauggacgucgagaucuggacgaaggagggggagcgcaagaagcugcggccccgcuggcuggacgcccggaccuacagcgacccccucgcccugcgcgaguucaaggaguucgccgcgggccggcgcuccgugagcggggaccugauccucgagaucggcaagcugccgcagcaccugacccagcgggcccagaacgcccucgacaaccuggugaugcugcacaacuccgagcagggcgggcgcgccuaccggcacgcgauggaggagcuccccgacaccaucgagacgcugaugcugcucgcccugaucgccguccugaccggcggggugacccucuucuuccugagcggccgcgggcugggcaagaccuccaucggcgugcucugcgucauggccagcuccgugcugcuguggauggccagcguggagccccacuggaucgcggccuccaucauccucgaguucuuccugaugguccugcucauccccgagccggaccggcagcgcacgccccaggacaaccagcuggccuacguggugaucgggcuccuguucaugauccugacggucgccgccaacgagaugggccugcucgagaccaccaagaaggaccuggggaucggccacguggcgguggagaaccaccaccacgccaccaugcuggacgucgaccuccaccccgccagcgccuggacgcuguacgccguggcgaccaccaucaucaccccgaugaugcggcacacgaucgagaacaccaccgccaacaucucccugaccgccaucgccaaccaggccgcgauccucauggggcuggacaagggcuggcccaucagcaagauggacaucggcgugccccugcucgcccuggggugcuacucccaggucaacccccugacgcucaccgccgccgugcugaugcugguggcgcacuacgccaucaucggcccggggcuccaggccaaggccacccgcgaggcccagaagcggaccgcggccggcaucaugaagaaccccacggucgacgggaucguggccaucgaccuggaccccguggucuacgacgccaaguucgagaagcagcugggccagaucaugcuccugauccugugcaccagccagauccuccugaugcgcaccaccugggcccugugcgaguccaucacgcucgcgaccggcccccugaccacccugugggaggggagcccgggcaaguucuggaacacgaccaucgccguguccauggccaacaucuuccgcgggagcuaccucgccggcgccggccuggcguucucccugaugaagucccucgggggcgggcggcgcggcaccggggcccagggcgagacccugggcgagaaguggaagcggcagcugaaccagcucagcaaguccgaguucaacaucuacaagcgcagcgggaucauggagguggaccgguccgaggccaaggagggccugaagcgcggggagacgacccggcacgccgucagccgcggcaccgcgaagcugcggugguucguggagcgcaaccuggugaagcccgaggggaaggucaucgaccucggcugcggccgcggcgggugguccuacuacugcgccgggcugaagaaggugaccgaggugaagggguacacgaagggcgggcccggccacgaggagcccaucccgauggccaccuacggguggaaccuggucaagcuccacagcggcaaggacguguucuucacgccgcccgagaagugcgacacccugcugugcgacaucggggaguccagccccaacccgacgaucgaggagggccgcacccuccgggugcugaagauggucgagcccuggcugcgcgggaaccaguucugcaucaagauccucaaccccuacaugcccuccgugguggagacccuggagcagaugcagcggaagcacggcggcaugcugguccgcaacccgcucagccggaacuccacccacgagauguacugggugagcugcgggaccggcaacaucguguccgccgucaacaugacgagccgcaugcugcugaaccgguucaccauggcccaccgcaagcccaccuacgagcgcgacguggaccucggggcgggcacccggcacguggccgucgagcccgagguggccaaccuggacaucaucggccagcgcaucgagaacaucaagcacgagcacaaguccacguggcacuacgacgaggacaaccccuacaagaccugggccuaccacgggagcuacgaggucaagccguccggcagcgccuccagcauggugaacgggguggucaagcugcucaccaagcccugggacgugauccccauggugacccagaucgcgaugacggacaccacccccuucggccagcagcgggucuucaaggagaagguggacacccgcacgccgaaggccaagcgggggaccgcccagaucauggaggugaccgcccgcuggcuguggggcuuccugagccggaacaagaagccccgcaucugcacccgggaggaguucacgcgcaagguccgguccaacgccgcgaucggcgccguguucguggacgagaaccaguggaacagcgccaaggaggccgucgaggacgagcgcuucugggaccucgugcagaaggagcgggagcugcacaagcaggggaagugcgcgaccugcguguacaacaugaugggcaagcgcgagaagaagcugggggaguucggcaaggccaaggggucccgggccaucugguacauguggcucggcgcccgcuuccuggaguucgaggcccugggcuucaugaacgaggaccacugguucagccgggagaacucccucagcggggucgagggcgaggggcugcacaagcugggcuacauccuccgcgacaucuccaagauccccgggggcaacauguacgcggacgacaccgccggcugggacacccggaucacggaggacgaccugcagaacgaggccaagaucaccgacaucauggagccggagcacgcccugcucgccaccagcaucuucaagcugaccuaccagaacaagguggugcgcguccagcggcccgcgaagaacgggacggugauggacgugaucucccgccgcgaccagcggggcagcgggcaggucggcaccuacggccugaacaccuucaccaacauggaggcccagcucauccgccagauggaguccgaggggaucuuccugcccagcgagcuggagacgcccaaccucgccgagcgggugcuggacuggcuggagaaguacggcguggagcgccucaagcggauggccaucuccggggacgacugcgucgugaagccgaucgacgaccgcuucgccaccgcgcugaccgcccugaacgacaugggcaaggugcggaaggacaucccccagugggagcccagcaagggguggaacgacuggcagcagguccccuucugcucccaccacuuccaccagcucaucaugaaggacggccgcgagaucguggugccgugccggaaccaggacgagcuggucggccgcgcccgggugagccagggggccggcuggucccugcgcgagaccgccugccucggcaagagcuacgcgcagauguggcagcugauguacuuccaccggcgcgaccugcggcucgccgccaacgccaucugcagcgcggugcccgucgacugggugcccacgucccgcaccaccuggagcauccacgcccaccaccaguggaugaccacggaggacaugcuguccguguggaaccgggucuggaucgaggagaaccccuggauggaggacaagacccacgugagcuccuggggcgacgugccguaccuggggaagcgcgaggaccaguggugcggcagccucaucggccugaccgcccgggccaccugggccuccaacauccaggucgcgaucaaccaggugcgccgccugaucgggaacgagaacuaccucgacuacaugaccagcaugaagcgguucaagaacgagggcgaccccgagggggccuucugguga

SEQ ID NO: 8379 - RNA, 9879 nt, Artificial Sequence
  derived and/or modified CDS sequence (opt1) from DENV-1__FJ410212__SS-prME
agcgugaccaugcugcugaugcugaugcccaccgcccuggccuuccaccucaccacccggggcggggagccccacaugaucgucagcaagcaggagcggggcaagagccugcuguucaagaccagcgccggggugaacaugugcacccucaucgccauggaccugggcgagcugugcgaggacaccaugaccuacaagugcccccggaucaccgaggccgagcccgacgacguggacugcuggugcaacgccaccgacacgugggucaccuacgggaccugcagccagaccggcgagcaccggcgggagaagcgguccguggcccucgcgccccacgugggccuggggcuggagacgcggaccgagaccuggaugagcuccgagggcgccuggaagcagauccagcgggucgagaccugggcccuccgccaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcggugcugcggaagcucugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccuccugacgugcgccaaguucaagugcgugaccaagcuggagggcaagaucguccaguacgagaaccucaaguacagcgugaucgugaccguccacaccggcgaccagcaccagguggggaacgaguccacggagcacggcaccaccgcgaccaucacgccccaggcccccacgaccgagauccagcugaccgacuacggggcccugacccucgacugcagcccccgcacgggccuggacuucaacgagaugguccugcucaccaugaaggagaaguccuggcuggugcacaagcagugguuccuggaccucccccugcccuggaccagcggggccagcaccucccaggagacguggaaccggcaggaccugcucgugaccuucaagaccgcccacgcgaagaagcaggaggucguggugcugggcagccaggagggcgccaugcacaccgcccugacgggggccaccgagauccagaccuccggcaccacgaccaucuucgccgggcaccucaagugccgccugaagauggacaagcugacccucaagggcaugagcuacgucaugugcaccggguccuucaagcuggagaaggagguggcggagacgcagcacggcaccgugcugguccagaucaaguacgagggcaccgacgcccccugcaagauccccuucagcacccaggacgagaagggggugacgcagaacggccggcugaucaccgccaacccgaucgugaccgacaaggagaagcccgucaacaucgaggccgagccgcccuucggggaguccuacaucgugaucggcgcgggcgagaaggcccucaagcugagcugguucaagaagggguccagcaucggcaagauguucgaggccaccgcccgcggggcccggcgcauggcgauccugggcgacacggccugggacuucggguccaucggcggcguguucaccagcgucgggaagcucgugcaccagaucuucggcaccgccuacggggugcuguucuccggcgucagcuggaccaugaagaucgggaucggcgcccugcucacguggcugggccugaacucccgcagcaccucccucagcaugaccugcaucgccguggggcuggugacccuguaccucggcgucauggugcaggcggacuccgggugcgugaucaacuggaagggccgggagcugaagugcgggagcggcaucuucgucacgaacgaggugcacaccuggaccgagcaguacaaguuccaggccgacagcccgaagcgccuguccgccgccaucggcaaggccugggaggagggggugugcggcauccggagcgcgacccgccucgagaacaucauguggaagcagaucuccaacgagcugaaccacauccugcucgagaacgacaugaaguucaccgucguggugggggacgucgccggcauccuggugcaggggaagaagaugauccggccccagcccauggaguacaaguacagcuggaaguccuggggcaaggccaagaucaucggcgccgacgugcagaacagcacguucaucaucgacgggcccaacaccccggagugccccgacgaccagcgcgcguggaacaucugggaggucgaggacuacggcuucgggaucuucaccaccaacaucuggcugaagcuccgggacuccuacacccaggugugcgaccaccgccugaugagcgccgccaucaaggacuccaaggccgugcacgccgacaugggcuacuggaucgagagcgagaagaacgagaccuggaagcuggcgcgggccuccuucaucgaggucaagaccugcaucuggcccaagagccacacccucugguccaacggcgugcuggagagcgagaugaucauccccaagauccacgggggcccgaucucccagcacaacuaccgccccggguacuucacgcagaccgccggccccuggcaccuggggaagcucgagcuggacuucgaccugugcgagggcaccaccguggucguggacgagcacugcggcaaccgggggccgagccuccgcacgaccaccgugaccggcaagaucauccacgaguggugcugccgguccugcacgcugccgccccugcgcuuccgcggggaggacggcugcugguacgggauggagauccgccccgucaaggagaaggaggagaaccucgugaaguccauggugagcgccggcuccggcgaggucgacagcuucucccuggggcugcucugcaucagcaucaugaucgaggaggugaugcggucccgcuggagccggaagaugcugaugaccggcacccuggccguguucuuccuccugaucauggggcagcugaccuggaacgaccucauccgccugugcaucauggucggcgcgaacgccuccgaccgcauggggaugggcacgaccuaccuggcccucauggccaccuucaagaugcggccgauguucgccgugggccugcuguuccgccggcucaccagccgcgaggugcugcugcucacgaucgggcugucccuggucgcgagcguggagcuccccaacucccuggaggagcugggcgacgggcucgccaugggcaucaugauccugaagcugcucaccgacuuccagagcuaccagcugugggccacccugcucucccugaccuucaucaagacgaccuucagccugcacuacgccuggaagaccauggcgaugguccucuccaucgugagccuguucccccugugccucuccaccacgagccagaagaccaccuggcugcccgugcugcucggcucccuggggugcaagccgcugaccauguuccucaucgccgagaacaagaucuggggccgcaagagcuggccccugaacgaggggaucauggccgucggcaucgugagcauccugcucuccagccugcugaagaacgacgugccccucgccgggccccugaucgccggcggcaugcugaucgcgugcuacgucaucuccgggagcuccgccgaccucagccuggagaaggccgccgagguguccugggaggaggaggccgagcacagcggcgcgucccacaacauccugguggagguccaggacgacgggacgaugaagaucaaggacgaggagcgcgacgacacccucaccauccugcugaaggccacccuccuggccgugagcggcguguacccgcuguccauccccgccacccucuucgucuggcacuucuggcagaagaagaagcagcggagcggggugcugugggacacgcccagcccgcccgagguggagcgcgccguccuggacgacggcaucuaccggaucaugcagcgcggccugcucgggcggagccaggugggcgugggggucuuccaggagaacguguuccacaccauguggcacgugacccgcggcgcgguccugauguaccaggggaagcggcuggagcccuccugggccagcgugaagaaggaccucaucuccuacggcggcggguggcgcuuccagggcagcuggaacaccggggaggaggugcaggucaucgccguggagcccggcaagaaccccaagaacgugcagacggcccccgggaccuucaagacccccgagggcgaggucggcgccaucgcgcuggacuucaagcccgggaccuccggcagccccaucgugaaccgggaggggaagaucgugggccuguacggcaacggggucgugacgaccagcggcaccuacguguccgccaucgcccaggccaaggcgagccaggaggggccgcuccccgagaucgaggacgaggucuuccgcaagcggaaccugaccaucauggaccugcaccccggcuccgggaagacgcgccgguaccucccggccaucgugcgcgaggccaucaagcggaagcugcgcacccugauccucgcccccacccgcguggucgccagcgagauggcggaggcccugaagggcaugcccauccgguaccagaccacggccgugaaguccgagcacaccggcaaggagaucguggaccugaugugccacgccaccuucaccaugcgccuccugagccccguccgggugccgaacuacaacaugaucaucauggacgaggcccacuucacggaccccuccagcaucgcggcccgcggguacaucuccacccgggugggcaugggggaggccgccgccaucuucaugaccgcgacgccgcccggcagcauggaggccuucccgcaguccaacgccgucauccaggacgaggagcgcgacauccccgagcggagcuggaacuccggguacgaguggaucacggacuuccccggcaagaccgugugguucgugcccagcaucaaggccggcaacgacaucgcgaacugccugcgcaagaacgggaagcgggucauccagcucucccgcaagaccuucgacaccgaguaccagaagacgaagaacaacgacugggacuacguggugaccaccgacaucagcgagaugggcgccaacuuccgggccgaccgcgucaucgacccgcggcgcugccugaagcccgugauccugaaggacgggcccgagcgggugauccucgccggccccaugccggucaccguggccuccgcggcccagcgccgggggcgcaucggccggaaccacaacaaggagggcgaccaguacaucuacauggggcagccccugaacaacgacgaggaccacgcccacuggacggaggccaagaugcugcucgacaacaucaacacccccgagggcaucauccccgcccuguucgagccggagcgcgagaaguccgcggccaucgacggggaguaccgccugcggggcgaggcccgcaagaccuucgucgagcucaugcggcgcggggaccugcccguguggcuguccuacaagguggccagcgagggcuuccaguacagcgaccggcgcuggugcuucgacggcgagcggaacaaccagguccucgaggagaacauggacguggagaucuggaccaaggagggggagcgcaagaagcugcggccccgcuggcuggacgcccggacguacuccgacccccucgcgcugcgcgaguucaaggaguucgccgccggccggcgcagcguguccggggaccugauccucgagaucggcaagcugccgcagcaccugacccagcgggcccagaacgcgcucgacaaccuggucaugcugcacaacagcgagcagggcgggcgcgccuaccggcacgccauggaggagcuccccgacaccaucgagacccugaugcugcucgcccugaucgccgugcugacgggcggggugacccucuucuuccuguccggcaaggggcugggcaagaccagcaucggccuccugugcgucauggcguccagcgugcugcucuggauggccuccguggagccccacuggaucgccgccagcaucauccuggaguucuuccugaugguccuccugauccccgagccggaccgccagcggacgccccaggacaaccagcuggccuacguggugaucgggcuccuguucaugauccugaccgucgcggccaacgagaugggccuccuggagacgaccaagaaggaccuggggaucggccacguggccguggagaaccaccaccacgccgccaugcucgacgucgaccugcaccccgcguccgccuggacccuguacgccguggccaccacgaucgugaccccgaugaugcgccacaccaucgagaacaccacggccaacaucagccucaccgcgaucgccaaccaggccgccauccugauggggcuggacaagggcuggcccaucuccaagauggacaucggcgucccccuccuggcgcuggggugcuacagccaggugaacccccucacccugaccgccgccgugcugaugcucgucgcccacuacgccaucaucggcccggggcugcaggcgaaggccacgcgggaggcccagaagcgcaccgccgccggcaucaugaagaaccccaccaucgacgggaucguggcgaucgaccuggaccccguggucuacgacgccaaguucgagaagcagcucggccagaucaugcugcugauccucugcaccucccagauccugcugaugcgcacgaccugggcccucugcgagagcaucacccuggccaccggcccccugacgacccucugggagggguccccgggcaaguucuggaacaccaccaucgccgugagcauggcgaacaucuuccggggguccuaccuggccggcgccggccuggccuucagccucaugaagucccucgggggcgggcgccgggggacgggggcgcagggcgagacccugggcgagaaguggaagcgccagcucaaccagcuguccaagagcgaguucaacaccuacaagcgguccgggaucauggagguggaccgcagcgaggccaaggagggccugaagcgcggggagaccacgaagcacgccgucucccgcggcaccgccaagcuccggugguucguggagcgcaaccuggugaagcccgaggggaaggucaucgaccugggcugcggccgcgggggcuggagcuacuacugcgccgggcugaagaaggugaccgaggugaagggcuacaccaagggcggccccggccacgaggagcccaucccgauggcgacguacggguggaaccucgucaagcugcacuccggcaaggacguguucuucaucccgcccgagaagugcgacacccugcucugcgacaucggggagagcucccccaacccgaccaucgaggagggccgcacccugcgggugcugaagauggucgagcccuggcuccgcgggaaccaguucugcaucaagauccugaaccccuacaugcccagcgugguggagacgcuggagcagaugcagcggaagcacggcggcaugcucguccgcaacccgcugucccggaacagcacccacgagauguacuggguguccugcgggaccggcaacaucgugagcgccgucaacaugaccucccgcaugcugcucaaccgguucaccauggcccaccgcaagcccacguacgagcgcgacguggaccugggggccggcacccggcacguggccgucgagcccgagguggcgaaccuggacaucaucggccagcgcaucgagaacaucaagcacgagcacaagagcaccuggcacuacgacgaggacaaccccuacaagaccugggccuaccacggguccuacgaggugaagccgagcggcuccgccagcagcauggucaacgggguggucaagcuccugacgaagcccugggacgugauccccauggugacccagaucgccaugaccgacaccacgcccuucggccagcagcgggucuucaaggagaagguggacacccgcaccccgaaggccaagcgggggaccgcgcagaucauggaggugacggcccgcuggcuguggggcuuccucucccggaacaagaagccccgcaucugcacccgggaggaguucacccgcaagguccggagcaacgccgccaucggcgcgguguucguggacgagaaccaguggaacuccgccaaggaggccgucgaggacgaccgcuucugggaccuggugcaccgggagcgcgagcugcacaagcaggggaagugcgcgaccugcguguacaacaugaugggcaagcgggagaagaagcucggggaguucggcaaggccaaggggagccgcgcgaucugguacauguggcugggcgcccgguuccuggaguucgaggcccucggcuucaugaacgaggaccacugguucucccgcgagaacagccuguccggggucgagggcgaggggcugcacaagcucggcuacauccugcgggacaucagcaagauccccgggggcaacauguacgccgacgacacggccggcugggacacccgcaucaccgaggacgaccugcagaacgaggcgaagaucaccgacaucauggagccggagcacgcccuccuggccaaguccaucuucaagcugacguaccagaacaagguggugcggguccagcgccccgccaagaacgggaccgugauggacgugaucagccgccgggaccagcgcggcuccgggcaggucggcaccuacggccucaacaccuucacgaacauggaggcccagcugauccggcagauggagagcgaggggaucuuccugcccaacgagcucgagacccccaaccuggcgggccgcgugcuggacuggcucgagaaguacgggguggagcggcugaagcgcauggccaucuccggcgacgacugcgucgugaagccgaucgacgaccgguucgccaccgcccugaccgcccucaacgacauggggaaggugcgcaaggacaucccccagugggagcccagcaagggcuggaacgacuggcagcagguccccuucugcucccaccacuuccaccagcugaucaugaaggacggccgggagaucguggugccgugccgcaaccaggacgagcuggucgggcgggcgcgcgugagccagggcgccggguggucccuccgggagacggccugccugggcaagagcuacgcccagauguggcagcugauguacuuccaccgccgggaccuccgccuggcggccaacgccaucugcagcgccgugcccgucgacugggugcccaccucccggaccaccuggagcauccacgcccaccaccaguggaugacgaccgaggacaugcuguccguguggaaccgcgucuggaucgaggagaaccccuggauggaggacaagacccggaucagcuccugggaggacgugccguaccucgggaagcgcgaggaccaguggugcggcagccugaucggccugaccgcgcgcgccacgugggccaccaacauccagguggccaucaaccagguccggcgccucaucgggaacgagaacuacuccgacuacaugaccagcaugaagcgguucaagaacgaguccgagcccgagggcgcccugugguga

SEQ ID NO: 8380 - RNA, 9879 nt, Artificial Sequence
  derived and/or modified CDS sequence (opt1) from DENV-1__FJ461307__SS-prME
agcgugaccaugcugcugaugcugaugcccaccgcccuggccuuccaccucaccacccggggcggggagccccacaugaucgucagcaagcaggagcggggcaagagccugcuguucaagaccagcgccggggugaacaugugcacccucaucgccauggaccugggcgagcugugcgaggacaccaugaccuacaagugcccccggaucaccgaggccgagcccgacgacguggacugcuggugcaacgccaccgacacgugggucaccuacgggaccugcagccagaccggcgagcaccggcgggagaagcgguccguggcccucgcgccccacgugggccuggggcuggagacgcggaccgagaccuggaugagcuccgagggcgccuggaagcagauccagcgggucgagaccugggcccuccgccaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcggugcugcggaagcucugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccuccugacgugcgccaaguucaagugcgugaccaagcuggagggcaagaucguccaguacgagaaccucaaguacagcgugaucgugaccguccacaccggcgaccagcaccagguggggaacgaguccacggagcacggcaccaccgcgaccaucacgccccaggcccccacgaccgagauccagcugaccgacuacggggcccugacccucgacugcagcccccgcacgggccuggacuucaacgagaugguccugcucaccaugaaggagaaguccuggcuggugcacaagcagugguuccuggaccucccccugcccuggaccagcggggccagcaccucccaggagacguggaaccggcaggaccugcucgugaccuucaagaccgcccacgcgaagaagcaggaggucguggugcugggcagccaggagggcgccaugcacaccgcccugacgggggccaccgagauccagaccuccggcaccacgaccaucuucgccgggcaccucaagugccgccugaagauggacaagcugacccucaagggcaugagcuacgucaugugcaccggguccuucaagcuggagaaggagguggcggagacgcagcacggcaccgugcugguccagaucaaguacgagggcaccgacgcccccugcaagauccccuucagcacccaggacgagaagggggugacgcagaacggccggcugaucaccgccaacccgaucgugaccgacaaggagaagcccgucaacaucgaggccgagccgcccuucggggaguccuacaucgugaucggcgcgggcgagaaggcccucaagcugagcugguucaagaagggguccagcaucggcaagauguucgaggccaccgcccgcggggcccggcgcauggcgauccugggcgacacggccugggacuucggguccaucggcggcguguucaccagcgucgggaagcucgugcaccagaucuucggcaccgccuacggggugcuguucuccggcgucagcuggaccaugaagaucgggaucggcgugcugcucacguggcugggccugaacucccgcagcaccucccucagcaugaccugcaucgccguggggcuggucacccuguaccucggcgugauggugcaggccgacuccgggugcgucaucaacuggaagggccgggagcugaagugcgggagcggcaucuucgugacgaacgaggugcacaccuggaccgagcaguacaaguuccaggcggacagcccgaagcgccuguccgccgccaucggcaaggccugggaggagggggucugcggcauccggagcgccacccgccucgagaacaucauguggaagcagaucuccaacgagcugaaccacauccugcucgagaacgacaugaaguucaccgugguggucggggacguggcgggcauccuggugcaggggaagaagaugauccggccccagcccauggaguacaaguacagcuggaaguccuggggcaaggccaagaucaucggcgccgacguccagaacagcacguucaucaucgacgggcccaacaccccggagugccccgacgaccagcgcgccuggaacaucugggagguggaggacuacggcuucgggaucuucaccaccaacaucuggcugaagcuccgggacuccuacacccaggugugcgaccaccgccugaugagcgcggccaucaaggacuccaaggccguccacgccgacaugggcuacuggaucgagagcgagaagaacgagaccuggaagcuggcccgggcguccuucaucgaggugaagaccugcaucuggcccaagagccacacccucugguccaacggcgugcuggagagcgagaugaucauccccaagauccacgggggcccgaucucccagcacaacuaccgccccggguacuucacgcagaccgccggccccuggcaccuggggaagcucgagcuggacuucgaccugugcgagggcaccaccgucgugguggacgagcacugcggcaaccgggggccgagccuccgcacgaccaccgucaccggcaagaucauccacgaguggugcugccgguccugcacgcugccgccccugcgcuuccgcggggaggacggcugcugguacgggauggagauccgccccgugaaggagaaggaggagaaccucgugaaguccauggucagcgccggcuccggcgagguggacagcuucucccuggggcugcucugcaucagcaucaugaucgaggaggugaugcggucccgcuggagccggaagaugcugaugaccggcacccuggccgucuucuuccuccugaucauggggcagcugaccuggaacgaccucauccgccugugcaucauggugggcgccaacgcguccgaccgcauggggaugggcacgaccuaccuggcccucauggccaccuucaagaugcggccgauguucgccgugggccugcuguuccgccggcucaccagccgcgagguccugcugcucacgaucgggcugucccugguggccagcgucgagcuccccaacucccuggaggagcugggcgacgggcucgcgaugggcaucaugauccugaagcugcucaccgacuuccagagcuaccagcugugggccacccugcucucccugaccuucaucaagacgaccuucagccugcacuacgccuggaagaccauggccauggugcucuccaucgugagccuguucccccugugccucuccaccacgagccagaagaccaccuggcugcccguccugcucggcucccuggggugcaagccgcugaccauguuccucaucgcggagaacaagaucuggggccgcaagagcuggccccugaacgaggggaucauggccgugggcaucgugagcauccugcucuccagccugcugaagaacgacgucccccucgccgggccccugaucgccggcggcaugcugaucgccugcuacgugaucuccgggagcuccgcggaccucagccuggagaaggccgccgagguguccugggaggaggaggccgagcacagcggcgccucccacaacauccuggucgaggugcaggacgacgggacgaugaagaucaaggacgaggagcgcgacgacacccucaccauccugcugaaggcgacccuccuggccgugagcggcgucuacccgcuguccauccccgccacccucuucguguggcacuucuggcagaagaagaagcagcggagcggggugcugugggacacgcccagcccgcccgaggucgagcgcgccgugcuggacgacggcaucuaccggaucaugcagcgcggccugcucgggcggagccaggugggcgucgggguguuccaggagaacguguuccacaccauguggcacgucacccgcggcgccgugcugauguaccaggggaagcggcuggagcccuccugggcgagcgugaagaaggaccucaucuccuacggcggcggguggcgcuuccagggcagcuggaacaccggggaggagguccaggugaucgccguggagcccggcaagaaccccaagaacguccagacggcccccgggaccuucaagacccccgagggcgaggugggcgccaucgcccuggacuucaagcccgggaccuccggcagccccaucgugaaccgggaggggaagaucgucggccuguacggcaacgggguggugacgaccagcggcaccuacgucuccgcgaucgcccaggccaaggccagccaggaggggccgcuccccgagaucgaggacgagguguuccgcaagcggaaccugaccaucauggaccugcaccccggcuccgggaagacgcgccgguaccucccggcgaucgugcgcgaggccaucaagcggaagcugcgcacccugauccucgcccccacccgcgucguggccagcgagauggccgaggcgcugaagggcaugcccauccgguaccagaccacggccgugaaguccgagcacaccggcaaggagaucgucgaccugaugugccacgccaccuucaccaugcgccuccugagccccgugcgggugccgaacuacaacaugaucaucauggacgaggcccacuucacggaccccuccagcaucgccgcgcgcggguacaucuccacccgggucggcaugggggaggccgccgccaucuucaugaccgccacgccgcccggcagcauggaggcguucccgcaguccaacgccgugauccaggacgaggagcgcgacauccccgagcggagcuggaacuccggguacgaguggaucacggacuuccccggcaagaccgugugguucguccccagcaucaaggccggcaacgacaucgccaacugccugcgcaagaacgggaagcgggugauccagcucucccgcaagaccuucgacaccgaguaccagaagacgaagaacaacgacugggacuacguggucaccaccgacaucagcgagaugggcgcgaacuuccgggccgaccgcgugaucgacccgcggcgcugccugaagcccgugauccugaaggacgggcccgagcgggucauccucgccggccccaugccggugaccgucgccuccgccgcgcagcgccgggggcgcaucggccggaaccacaacaaggagggcgaccaguacaucuacauggggcagccccugaacaacgacgaggaccacgcccacuggacggaggccaagaugcugcucgacaacaucaacacccccgagggcaucauccccgcccuguucgagccggagcgcgagaaguccgccgcgaucgacggggaguaccgccugcggggcgaggcccgcaagaccuucguggagcucaugcggcgcggggaccugcccguguggcuguccuacaaggucgccagcgagggcuuccaguacagcgaccggcgcuggugcuucgacggcgagcggaacaaccaggugcucgaggagaacauggacguggagaucuggaccaaggagggggagcgcaagaagcugcggccccgcuggcuggacgcccggacguacuccgacccccucgcccugcgcgaguucaaggaguucgcggccggccggcgcagcgucuccggggaccugauccucgagaucggcaagcugccgcagcaccugacccagcgggcccagaacgcccucgacaaccuggugaugcugcacaacagcgagcagggcgggcgcgcguaccggcacgccauggaggagcuccccgacaccaucgagacccugaugcugcucgcccugaucgccgugcugacgggcggggucacccucuucuuccuguccggcaaggggcugggcaagaccagcaucggccuccugugcgugauggccuccagcgugcugcucuggauggcguccgucgagccccacuggaucgccgccagcaucauccuggaguucuuccugauggugcuccugauccccgagccggaccgccagcggacgccccaggacaaccagcuggccuacguggucaucgggcuccuguucaugauccugaccguggccgcgaacgagaugggccuccuggagacgaccaagaaggaccuggggaucggccacguggccgucgagaaccaccaccacgccgccaugcucgacguggaccugcaccccgccuccgcguggacccuguacgccguggccaccacgaucaucaccccgaugaugcgccacaccaucgagaacaccacggccaacaucagccucaccgccaucgcgaaccaggccgccauccugauggggcuggacaagggcuggcccaucuccaagauggacaucggcgucccccuccuggcccuggggugcuacagccaggugaacccccucacccugaccgcggccgugcugaugcucgucgcccacuacgccaucaucggcccggggcugcaggccaaggcgacgcgggaggcccagaagcgcaccgccgccggcaucaugaagaaccccaccaucgacgggaucguggccaucgaccuggaccccguggucuacgacgcgaaguucgagaagcagcucggccagaucaugcugcugauccucugcaccucccagauccugcugaugcgcacgaccugggcccucugcgagagcaucacccuggccaccggcccccugacgacccucugggagggguccccgggcaaguucuggaacaccaccaucgccgugagcauggccaacaucuuccggggguccuaccuggcgggcgccggccuggccuucagccucaugaagucccucgggggcgggcgccgggggacgggggcccagggcgagacccugggcgagaaguggaagcgccagcucaaccagcuguccaagagcgaguucaacaccuacaagcgguccgggaucauggagguggaccgcagcgaggcgaaggagggccugaagcgcggggagaccacgaagcacgccgucucccgcggcaccgccaagcuccggugguucguggagcgcaaccuggugaagcccgaggggaaggucaucgaccugggcugcggccgcgggggcuggagcuacuacugcgccgggcugaagaaggugaccgaggugaagggcuacaccaagggcggccccggccacgaggagcccaucccgauggccacguacggguggaaccucgucaagcugcacuccggcaaggacguguucuucaucccgcccgagaagugcgacacccugcucugcgacaucggggagagcucccccaacccgaccaucgaggagggccgcacccugcgggugcugaagauggucgagcccuggcuccgcgggaaccaguucugcaucaagauccugaaccccuacaugcccagcgugguggagacgcuggagcagaugcagcggaagcacggcggcaugcucguccgcaacccgcugucccggaacagcacccacgagauguacuggguguccugcgggaccggcaacaucgugagcgcggucaacaugaccucccgcaugcugcucaaccgguucaccauggcccaccgcaagcccacguacgagcgcgacguggaccugggggccggcacccggcacguggccgucgagcccgagguggccaaccuggacaucaucggccagcgcaucgagaacaucaagcacgagcacaagagcaccuggcacuacgacgaggacaaccccuacaagaccugggcguaccacggguccuacgaggugaagccgagcggcuccgccagcagcauggucaacgggguggucaagcuccugacgaagcccugggacgugauccccauggugacccagaucgccaugaccgacaccacgcccuucggccagcagcgggucuucaaggagaagguggacacccgcaccccgaaggccaagcgggggaccgcccagaucauggaggugacggcgcgcuggcuguggggcuuccucucccggaacaagaagccccgcaucugcacccgggaggaguucacccgcaagguccggagcaacgccgccaucggcgccguguucguggacgagaaccaguggaacuccgcgaaggaggccgucgaggacgaccgcuucugggaccuggugcaccgggagcgcgagcugcacaagcaggggaagugcgcgaccugcguguacaacaugaugggcaagcgggagaagaagcucggggaguucggcaaggccaaggggagccgcgccaucugguacauguggcugggcgcgcgguuccuggaguucgaggcccucggcuucaugaacgaggaccacugguucucccgcgagaacagccuguccggggucgagggcgaggggcugcacaagcucggcuacauccugcgggacaucagcaagauccccgggggcaacauguacgccgacgacacggccggcugggacacccgcaucaccgaggacgaccugcagaacgaggccaagaucaccgacaucauggagccggagcacgcgcuccuggccaaguccaucuucaagcugacguaccagaacaagguggugcggguccagcgccccgccaagaacgggaccgugauggacgugaucagccgccgggaccagcgcggcuccgggcaggucggcaccuacggccucaacaccuucacgaacauggaggcccagcugauccggcagauggagagcgaggggaucuuccugcccaacgagcucgagacccccaaccuggccggccgcgugcuggacuggcucgagaaguacgggguggagcggcugaagcgcauggcgaucuccggcgacgacugcgucgugaagccgaucgacgaccgguucgccaccgcccugaccgcccucaacgacauggggaaggugcgcaaggacaucccccagugggagcccagcaagggcuggaacgacuggcagcagguccccuucugcucccaccacuuccaccagcugaucaugaaggacggccgggagaucguggugccgugccgcaaccaggacgagcuggucgggcgggcccgcgugagccagggcgcgggguggucccuccgggagacggccugccugggcaagagcuacgcccagauguggcagcugauguacuuccaccgccgggaccuccgccuggccgcgaacgccaucugcagcgccgugcccgucgacugggugcccaccucccggaccaccuggagcauccacgcccaccaccaguggaugacgaccgaggacaugcuguccguguggaaccgcgucuggaucgaggagaaccccuggauggaggacaagacccggaucagcuccugggaggacgugccguaccucgggaagcgcgaggaccaguggugcggcagccugaucggccugaccgcccgcgcgacgugggccaccaacauccagguggccaucaaccagguccggcgccucaucgggaacgagaacuacuccgacuacaugaucagcaugaagcgguucaagaacgaguccgagcccgagggcgcccugugguga

SEQ ID NO: 8381 - RNA, 9879 nt, Artificial Sequence
  derived and/or modified CDS sequence (opt1) from DENV-1__FJ410213__SS-prME
agcgugaccaugcugcucaugcugaugcccaccgcccuggccuuccaccucaccacccggggcggggagccccacaugaucgugaccaagcaggagcggggcaagagccugcuguucaagaccagcgccggggugaacaugugcacccucaucgccauggaccugggcgagcugugcgaggacaccaugaccuacaagugcccccggaucaccgaggccgagcccgacgacguggacugcuggugcaacgccaccgacaccugggugaccuacgggaccugcagccagacgggcgagcaccggcgcgacaagcggagcguggcccucgcgccccacgugggccuggggcuggagacccgcaccgagaccuggauguccagcgagggcgccuggaagcagauccagcgggucgagacgugggcccuccgccaccccggguucaccgugaucgcccuguuccuggcgcacgccaucggcaccuccaucacccagaaggggaucaucuucauccuccugaugcuggugacgcccagcauggccaugcggugcgucggcaucggcucccgcgacuucguggaggggcucagcggcgccaccuggguggacgucgugcuggagcacggguccugcgugaccaccauggccaaggacaagcccacgcuggacaucgagcuccugaagaccgaggucaccaaccccgcggugcugcggaagcucugcaucgaggccaagaucagcaacaccacgaccgacucccgcugccccacccagggcgaggccacccugauggaggagcaggacgccaacuucgugugccggcgcacguucgucgaccggggcugggggaacggcugcgggcuguucggcaaggggagccucaucacgugcgccaaguucaagugcgugaccaagcuggagggcaagaucgugcaguacgagaaccugaaguacuccgucaucgugaccgugcacacgggcgaccagcaccaggucgggaacgagagcaccgagcacggcaccaccgcgaccaucacgccccaggcccccaccuccgagauccagcucaccgacuacggggcccugacccuggacugcagcccccgcacgggccucgacuucaacgagauggugcugcugaccaugaaggagaaguccuggcucguccacaagcagugguuccuggaccugccgcuccccuggaccagcggggccagcaccucccaggagacguggaaccggcaggaccugcuggugaccuucaagaccgcccacgcgaagaagcaggagguggucgugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgugaugugcaccggguccuucaagcucgagaaggaggucgcggagacgcagcacggcaccgugcuggugcagaucaaguacgagggcaccgacgcccccugcaagauccccuucagcacccaggacgagaagggggucacgcagaacggccggcugaucaccgccaacccgaucgugaccgacaaggagaagcccgugaacaucgaggccgagccgcccuucggggaguccuacaucgucaucggcgcgggcgagaaggcccugaagcucagcugguucaagaagggguccagcaucggcaagauguucgaggccaccgcccgcggggcccggcgcauggcgauccugggcgacacggccugggacuucggguccgugggcggcguguucaccagcgucgggaagcuggugcaccagaucuucggcaccgccuacgggguccuguucuccggcgucagcuggaccaugaagaucgggaucggcgugcugcugacguggcucggccugaacucccgcagcaccucccugagcaugaccugcaucgccguggggcucgucacccuguaccugggcgugauggugcaggccgacuccgggugcgucaucaacuggaagggccgggagcucaagugcgggagcggcaucuucgugacgaacgaggugcacaccuggaccgagcaguacaaguuccaggcggacagcccgaagcgccuguccgccgccaucggcaaggccugggaggagggggucugcggcauccggagcgccacccgccuggagaacaucauguggaagcagaucuccaacgagcucaaccacauccugcuggagaacgacaugaaguucaccgugguggucggggacguggugggcauccucgcgcaggggaagaagaugauccggccccagcccauggagcacaaguacagcuggaaguccuggggcaaggccaagaucaucggcgccgacguccagaacacgaccuucaucaucgacgggcccaacaccccggagugccccgacgaccagcgcgccuggaacaucugggagguggaggacuacggcuucgggaucuucaccacgaacaucuggcugaagcugcgggacagcuacacccaggugugcgaccaccgccucauguccgcggccaucaaggacagcaaggccguccacgccgacaugggcuacuggaucgaguccgagaagaacgagaccuggaagcuggcccgggcgagcuucaucgaggugaagaccugcaucuggcccaagucccacacgcuguggagcaacggcgugcucgaguccgagaugaucauccccaagaucuacgggggcccgaucagccagcacaacuaccgccccggguacuucacccagaccgccggccccuggcaccuggggaagcuggagcucgacuucgaccugugcgagggcaccacggucgugguggacgagcacugcggcaaccgggggccgucccugcgcaccaccaccgucacgggcaagaucauccacgaguggugcugccggagcugcacccugccgccccuccgcuucaagggggaggacggcugcugguacgggauggagauccggcccgugaaggagaaggaggagaaccuggugaaguccauggucagcgccggcagcggcgagguggacuccuucagccucgggcugcugugcaucuccaucaugaucgaggaggugaugcgcagccgguggucccgcaagaugcucaugaccggcacccuggccgucuuccugcuccugaucauggggcagcugacguggaacgaccucauccggcugugcaucauggugggcgccaacgcgagcgaccgcauggggaugggcaccaccuaccuggcccucauggccaccuucaagaugcgcccgauguucgccguggggcugcuguuccggcgccucacgucccgggagguccugcugcucaccaucgggcugagccugguggccuccgucgagcuccccaacagccuggaggagcugggcgacgggcucgcgaugggcaucaugauccugaagcugcucaccgacuuccagucccaccagcugugggccacccugcucagccugacguucaucaagaccacccugucccuccacuacgccuggaagaccauggccauggugcugagcaucgugucccuguucccccucugccugagcacgaccucccagaagaccaccuggcugcccguccuccugggcagccuggggugcaagccgcucacgauguuccugaucaccgagaacaagaucuggggccgcaaguccuggccccugaacgaggggaucauggcggugggcguggucagcauccuccugagcucccugcucaaggacgacgugccccuggccgggccccugaucgccggcggcaugcucaucgccugcuacgugaucagcggguccagcgccgaccugucccuggagaaggcggccgaggucagcugggaggaggaggccgagcacuccggcgccagccacaacauccucguggaggugcaggacgacgggaccaugaagaucaaggacgaggagcgggacgacacccugaccauccugcucaaggccacgcugcuggcggucuccggcguguacccgcucagcauccccgccacccuguucgugugguacuucuggcagaagaagaagcagcgcuccgggguccugugggacacccccagcccgcccgagguggagcgggccgugcuggacgacggcaucuaccgcaucaugcagcggggccuccuggggcgcucccaggucggcguggggguguuccaggagaacgucuuccacaccauguggcacgugacgcggggcgccgugcugauguaccaggggaagcgccucgagcccagcugggccuccgucaagaaggaccugaucagcuacggcggcggguggcggcugcagggcuccuggaacaccggggaggagguccaggugaucgcggucgagcccggcaagaaccccaagaacgugcagaccgcccccgggaccuucaagacgcccgagggcgaggugggcgccaucgcccucgacuucaagcccgggaccagcggcucccccaucgucaaccgcgaggggaagaucgugggccuguacggcaacgggguggucaccaccagcggcacguacgugagcgccaucgcgcaggccaaggccucccaggaggggccgcugcccgagaucgaggacgagguguuccggaagcgcaaccucaccaucauggaccugcaccccggcagcgggaagacccggcgcuaccugccggccaucguccgggaggcgaucaagcgcaagcuccggacccugauccuggcccccacgcgcgugguggccuccgagauggccgaggcccucaagggcaugcccauccgcuaccagaccaccgcggucaagagcgagcacaccggcaaggagaucguggaccugaugugccacgccacguucaccaugcggcugcucucccccgugcgcgucccgaacuacaacaugaucaucauggacgaggcccacuucaccgaccccagcuccaucgccgcccggggguacaucagcacccgcgugggcaugggggaggcggccgccaucuucaugacggccacgccgcccggcuccguggaggccuucccgcagagcaacgcggucauccaggacgaggagcgggacauccccgagcgcuccuggaacagcggguacgaguggaucaccgacuuccccggcaagaccgugugguucgugcccuccaucaagagcggcaacgacaucgccaacugccugcggaagaacgggaagcgcgucauccagcugucccggaagacguucgacaccgaguaccagaagaccaagaacaacgacugggacuacguggugaccacggacaucagcgagaugggcgccaacuuccgcgccgaccgggucaucgacccgcgccggugccucaagcccgugauccugaaggacgggcccgagcgcgucauccuggcgggccccaugccggugaccguggccuccgccgcccagcggcgcgggcggaucggccgcaaccacaacaaggagggcgaccaguacaucuacauggggcagccccucaacaacgacgaggaccacgcccacuggaccgaggcgaagaugcugcuggacaacaucaacacccccgagggcaucauccccgcccucuucgagccggagcgggagaaguccgccgccaucgacggggaguaccgccugcgcggcgaggcccggaagacguucgucgagcugaugcgccgcggggaccuccccguguggcuguccuacaagguggcgagcgagggcuuccaguacagcgaccgccgguggugcuucgacggcgagcgcaacaaccagguccuggaggagaacauggacguggagaucuggaccaaggagggggagcggaagaagcuccgcccccgguggcuggacgcccgcaccuacuccgacccccuggcccuccgggaguucaaggaguucgccgccggccgccggagcguguccggggaccugauccuggagaucggcaagcucccgcagcaccugacccagcgcgcgcagaacgcccuggacaaccucgucaugcugcacaacagcgagcagggcgggcgggccuaccgccacgccauggaggagcugcccgacacgaucgagacccucaugcugcuggcgcucaucgccgugcugaccggcggggugacccuguucuuccucuccggccgggggcugggcaagaccagcaucggccugcucugcgucauggccuccagcgugcugcuguggauggccuccguggagccccacuggaucgccgcgagcaucauccucgaguucuuccugaugguccugcucauccccgagccggaccgccagcggacgccccaggacaaccagcuggccuacguggugaucgggcuccucuucaugauccugaccgucgccgccaacgagaugggccugcucgagaccaccaagaaggaccuggggaucggccacguggccguggagaaccaccaccacgcgacgaugcuggacgucgaccuccaccccgccuccgccuggacccuguacgccguggccaccaccaucaucacgccgaugaugcgccacaccaucgagaacaccaccgcgaacaucagccugacggccaucgccaaccaggccgccauccucauggggcuggacaagggcuggcccaucuccaagauggacaucggcgugccccugcucgcgcuggggugcuacagccaggucaacccccugacccucaccgccgccgugcugaugcugguggcccacuacgcgaucaucggcccggggcuccaggccaaggccacccgggaggcccagaagcgcacggccgcgggcaucaugaagaaccccaccgucgacgggaucguggccaucgaccuggaccccguggucuacgacgccaaguucgagaagcagcugggccagaucaugcuccugauccugugcaccucccagauccuccugaugcgcaccacgugggcccugugcgagagcaucacccucgccaccggcccccugaccacgcugugggagggguccccgggcaaguucuggaacaccaccaucgcggugagcauggccaacaucuuccggggguccuaccucgccggcgccggccuggccuucagccugaugaagucccucgggggcgggcgccggggcaccggggcgcagggcgagacgcugggcgagaaguggaagcgccagcugaaccagcucuccaagagcgaguucaacaucuacaagcgguccgggaucauggagguggaccgcagcgaggccaaggagggccugaagcgcggggagaccacccgccacgccgucucccggggcaccgccaagcugcgcugguucguggagcggaaccuggugaagcccgaggggaaggucaucgaccucggcugcggccgcgggggcuggagcuacuacugcgcggggcugaagaaggugacggaggugaagggcuacaccaagggcgggcccggccacgaggagcccaucccgauggccaccuacggguggaaccuggucaagcuccacuccggcaaggacguguucuucacgccgcccgagaagugcgacacgcugcugugcgacaucggggagagcucccccaacccgaccaucgaggagggccggacccuccgcgugcugaagauggucgagcccuggcugcgggggaaccaguucugcaucaagauccucaaccccuacaugcccagcgugguggagacccuggagcagaugcagcgcaagcacggcggcaugcugguccggaacccgcucucccgcaacagcacccacgagauguacuggguguccugcgggacgggcaacaucgugagcgccgucaacaugaccucccggaugcugcugaaccgcuucaccauggcccaccgcaagcccaccuacgagcgggacguggaccucggggccggcacgcgccacguggcggucgagcccgagguggccaaccuggacaucaucggccagcggaucgagaacaucaagcacgagcacaagagcaccuggcacuacgacgaggacaaccccuacaagaccugggccuaccacggguccuacgaggucaagccgagcggcuccgccagcagcauggugaacgggguggucaagcugcucaccaagcccugggacgugauccccauggugacgcagaucgccaugaccgacaccacccccuucggccagcagcgcgucuucaaggagaagguggacacgcggaccccgaaggcgaagcgcgggaccgcccagaucauggaggugaccgcccgguggcuguggggcuuccugucccgcaacaagaagccccggaucugcacgcgcgaggaguucacccggaagguccgcagcaacgccgccaucggcgcgguguucguggacgagaaccaguggaacuccgccaaggaggccgucgaggacgagcgguucugggaccucgugcagaaggagcgcgagcugcacaagcaggggaagugcgcgaccugcguguacaacaugaugggcaagcgggagaagaagcugggggaguucggcaaggcgaaggggagccgcgccaucugguacauguggcucggcgcccgguuccuggaguucgaggcccugggcuucaugaacgaggaccacugguucucccgcgagaacagccucuccggggucgagggcgaggggcugcacaagcugggcuacauccuccgggacaucagcaagauccccgggggcaacauguacgccgacgacaccgcgggcugggacacgcgcaucaccgaggacgaccugcagaacgaggccaagaucaccgacaucauggagccggagcacgcccugcucgccaccuccaucuucaagcugacguaccagaacaagguggugcggguccagcgccccgccaagaacgggaccgugauggacgugaucagccgccgggaccagcgcggcuccgggcaggucggcaccuacggccugaacaccuucacgaacauggaggcgcagcucauccggcagauggagagcgaggggaucuuccugcccuccgagcuggagacccccaaccucgccgagcgcgugcuggacuggcuggagaaguacggcguggagcggcucaagcgcauggccaucagcggggacgacugcgucgugaagccgaucgacgaccgguucgccaccgcccugaccgcgcugaacgacaugggcaaggugcgcaaggacaucccccagugggagcccuccaagggguggaacgacuggcagcagguccccuucugcagccaccacuuccaccagcucaucaugaaggacggccgggagaucguggugccgugccgcaaccaggacgagcuggucggccgggcccgcgugucccagggggccggcuggagccugcgggagacggccugccucggcaagagcuacgcccagauguggcagcugauguacuuccaccgccgggaccugcgccucgcggccaacgccaucugcuccgccgugcccgucgacugggugcccaccagccggaccaccugguccauccacgcgcaccaccaguggaugacgaccgaggacaugcugagcguguggaaccgcgucuggaucgaggagaaccccuggauggaggacaagacccacguguccagcuggggcgacgugccguaccuggggaagcgggaggaccaguggugcggcucccucaucggccugaccgcccgcgccaccugggccagcaacauccaggucgccaucaaccaggugcgccggcugaucgggaacgagaacuaccucgacuacaugacguccaugaagcgcuucaagaacgagggcgaccccgagggggcgcugugguga

SEQ ID NO: 8382 - RNA, 9879 nt, Artificial Sequence
  derived and/or modified CDS sequence (opt1) from DENV-1__FJ461308__SS-prME
agcgugaccaugcugcucaugcugaugcccaccgcccuggccuuccaccucaccacccggggcggggagccccacaugaucgugagcaagcaggagcggggcaagagccugcuguucaagaccagcgcgggggugaacaugugcacccucaucgccauggaccugggcgaguucugcgaggacaccaugaccuacaagugcccccgcaucaccgaggccgagcccgacgacguggacugcuggugcaacgccaccgacacgugggugaccuacgggaccugcagccagaccggcgagcaccggcgggacaagcgguccguggcccuggcgccccacgugggccucgggcuggagacgcgcgccgagaccuggaugagcuccgagggcgccuggaagcagauccagcggguggagaccugggcccugcgccaccccggguucaccgugaucgcccuguuccuggcccacgccaucggcacgagcaucacccagaaggggaucaucuucauccugcucaugcuggugacccccuccauggccaugcggugcgucggcaucggcagccgcgacuucguggaggggcuguccggcgccaccuggguggacgucgugcucgagcacgggagcugcgugacgaccauggcgaaggacaagcccacccuggacaucgagcugcucaagaccgaggucacgaaccccgccgugcugcggaagcugugcaucgaggccaagaucuccaacaccaccaccgacagccgcugcccgacgcagggcgaggccacccucguggaggagcaggacgccaacuucgucugccggcgcaccuucguggaccggggcugggggaacggcugcgggcuguucggcaaggggucccugaucacgugcgcgaaguucaagugcgugacgaagcucgagggcaagaccguccaguacgagaaccugaaguacagcgugaucgugaccguccacaccggcgaccagcaccagguggggaacgaguccacggagcacggcaccaccgccaccaucacgccccaggcccccagcacggagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccagcggggccuccaccagccaggagaccuggaaccggaaggaccuccuggugacguucaagaccgcgcacgccaagaagcaggaggucguggugcugggcucccaggagggcgccaugcacaccgcccucaccggggccacggagauccagaccagcggcaccaccacgaucuucgcggggcaccugaagugccgccugaagauggacaagcucacccugaagggcauguccuacgucaugugcaccgggagcuucaagcuggagaaggagguggccgagacccagcacggcacggugcucguccagaucaaguacgagggcaccgacgcccccugcaagauccccuucuccacccaggacgagaagggggugacccagaacggccggcugaucacggccaacccgaucgugaccgacaaggagaagcccgucaacaucgaggcggagccgcccuucggggagagcugcaucgugaucggcgccggcgagaaggcccugaagcuguccugguucaagaaggggagcuccaucggcaagauguucgaggccaccgcccgcggggcgcggcgcauggccauccucggcgacaccgccugggacuucgggagcaucggcggcguguucacguccgucgggaagcuggugcaccagaucuucggcaccgccuacggggugcuguucagcggcgucuccuggaccaugaagaucgggaucggcgugcuccugaccuggcugggccucaacagccgcuccacgagccuguccaugaccugcaucgccguggggcuggucacccucuaccugggcgugauggugcaggcggacagcgggugcgucaucaacuggaagggccgggagcugaagugcgggagcggcaucuucgugaccaacgaggugcacacguggaccgagcaguacaaguuccaggccgacuccccgaagcgccucagcgccgccaucggcaaggccugggaggagggggucugcggcauccgguccgcgacccgccuggagaacaucauguggaagcagaucagcaacgagcugaaccacauccuccuggagaacgacaugaaguucaccgugguggucggggacguggccggcauccuggcccaggggaagaagaugauccggccccagcccauggagcacaaguacuccuggaaguccuggggcaaggccaagaucaucggcgcggacgugcagaacaccacguucaucaucgacgggcccaacaccccggagugccccgacgaccagcgcgccuggaacaucugggaggucgaggacuacggcuucgggaucuucaccaccaacaucuggcucaagcugcgggacuccuacacccaggugugcgaccaccgccugaugagcgccgccaucaaggacuccaaggccgugcacgcggacaugggcuacuggaucgagagcgagaagaacgagaccuggaagcucgcccgggccuccuucaucgaggucaagaccugcaucuggcccaagagccacacccugugguccaacggcgugcuggagagcgagaugaucauccccaagaucuacgggggcccgaucucccagcacaacuaccgccccggguacuucacgcagaccgccggccccuggcaccucgggaagcuggagcuggacuucgaccucugcgagggcaccaccguggucguggacgagcacugcggcaaccgggggccgagccugcgcacgaccaccgugaccggcaagaucauccacgaguggugcugccgguccugcacgcugccgccccugcgcuucaagggggaggacggcugcugguacgggauggagauccggcccgucaaggagaaggaggagaaccuggucaagagcauggugagcgccggcuccggcgaggucgacagcuucucccuggggcuccugugcaucagcaucaugaucgaggaggugaugcgcucccgguggagccgcaagaugcugaugaccggcacccucgcgguguucuuccugcugaucauggggcagcucaccuggaacgaccugauccggcugugcaucauggucggcgccaacgccuccgaccgcauggggaugggcacgaccuaccucgcccugauggccaccuucaagaugcgcccgauguucgcgguggggcuccucuuccggcgccugaccagccgggaggugcugcuccugacgaucgggcugucccucgucgccagcguggagcugcccaacucccuggaggagcucggcgacgggcuggccaugggcaucaugauccugaagcuccugaccgacuuccagagccaccagcugugggccacccuccugucccugaccuucaucaagacgaccuucagccuccacuacgcguggaagaccauggccaugguccuguccaucgugagccuguucccccucugccuguccaccacgagccagaagaccaccuggcugcccgugcuccugggcucccuggggugcaagccgcucaccauguuccugaucgccgagaacaagaucuggggccgcaagagcuggccccugaacgaggggaucauggccgucggcaucgugagcauccuccuguccagccugcucaagaacgacgugccccuggccgggccccugaucgcgggcggcaugcucaucgccugcuacgucaucuccgggagcuccgccgaccugagccuggagaaggccgccgagguguccugggaggaggaggcggagcacagcggcgccucccacaacauccucguggagguccaggacgacgggacgaugaagaucaaggacgaggagcgggacgacacccugaccauccugcucaaggccacccugcuggccgugagcggcguguacccgcucuccauccccgccacccuguucgucugguacuucuggcagaagaagaagcagcgcagcggggugcugugggacacgcccagcccgcccgagguggagcgggcgguccucgacgacggcaucuaccgcaucaugcagcggggccugcuggggcgcagccaggugggcgugggggucuuccaggagaacguguuccacaccauguggcacgugacccggggcgccguccugauguaccaggggaagcgccucgagcccuccugggccagcgugaagaaggaccugaucuccuacggcggcggguggcggcugcagggcagcuggaacaccggggaggaggugcaggucaucgccguggagcccggcaagaaccccaagaacgugcagacggcccccgggaccuucaagaccuccgagggcgaggucggcgcgaucgcccucgacuucaagcccgggaccagcggcagccccaucgugaaccgcgaggggaagaucgugggccuguacggcaacggggucgugacgaccuccggcaccuacgugagcgccaucgcccaggcgaaggccucccaggaggggccccugccggagaucgaggacgaggucuuccggaagcgcaaccucaccaucauggaccugcaccccggcagcgggaagacgcggcgcuaccugcccgccaucgugcgggaggccaucaagcgcaagcuccggacccugauccuggccccgacccgcguggucgcguccgagauggccgaggcccucaagggcaugcccauccgcuaccagaccacggccgucaagagcgagcacaccggcaaggagaucguggaccugaugugccacgccaccuucaccaugcggcugcucucccccguccgcgugcccaacuacaacaugaucaucauggacgaggcgcacuucacggacccgagcuccaucgccgcccggggguacaucagcacccgcgugggcaugggggaggccgccgcgaucuucaugaccgccacgccgcccggcuccgucgaggccuucccccagagcaacgccgugauccaggacgaggagcgggacaucccggagcgcuccuggaacagcggguacgaguggaucacggacuuccccggcaagaccgugugguucguccccuccaucaagagcggcaacgacaucgcgaacugccugcggaagaacgggaagcgcgugauccagcugucccggaagaccuucgacaccgaguaccagaagacgaagaacaacgacugggacuacguggucaccaccgacaucagcgagaugggcgccaacuuccgcgccgaccgggugaucgacccccgccggugccucaagccggugauccugaaggacgggcccgagcgcgucauccuggccggccccaugcccgugaccgucgccuccgcggcccagcggcgcgggcggaucggccgcaaccacaacaaggagggcgaccaguacaucuacauggggcagccgcucaacaacgacgaggaccacgcccacuggacggaggccaagaugcugcuggacaacaucaacacccccgagggcaucauccccgcccucuucgagcccgagcgggagaaguccgcggccaucgacggggaguaccgccugcgcggcgaggcccggaagaccuucguggagcugaugcgccgcggggaccucccgguguggcugagcuacaaggucgccuccgagggcuuccaguacagcgaccgccgguggugcuucgacggcgagcgcaacaaccaggugcuggaggagaacauggacguggagaucuggaccaaggagggggagcggaagaagcuccgcccccgguggcuggacgcccgcacguacuccgacccccuggcgcuccgggaguucaaggaguucgccgccggccgccggagcgucuccggggaccugauccuggagaucggcaagcucccccagcaccugacccagcgcgcccagaacgcgcuggacaaccucgugaugcugcacaacagcgagcagggcgggcgggccuaccgccacgccauggaggagcugccggacaccaucgagacccucaugcugcuggcccucaucgccgugcugacgggcggggucacccuguucuuccucuccggccgggggcugggcaagaccagcaucggccugcucugcgugauggcguccagcgugcugcuguggauggccuccgucgagccccacuggaucgccgccagcaucauccucgaguucuuccugauggugcugcucauccccgagcccgaccgccagcggaccccgcaggacaaccagcuggccuacguggucaucgggcuccucuucaugauccugaccguggcggccaacgagaugggccugcucgagacgaccaagaaggaccuggggaucggccacguggccgucgagaaccaccaccacgccgccaugcuggacguggaccuccaccccgcguccgccuggacccuguacgccguggccaccacgaucaucacccccaugaugcgccacaccaucgagaacaccacggccaacaucagccugaccgcgaucgccaaccaggccgccauccucauggggcuggacaagggcuggccgaucuccaagauggacaucggcgucccccugcucgcgcuggggugcuacagccaggugaacccccugacccucaccgccgccgugcugaugcuggucgcccacuacgccaucaucggccccgggcuccaggcgaaggccacgcgggaggcccagaagcgcaccgccgccggcaucaugaagaacccgaccguggacgggaucguggcgaucgaccuggaccccgucguguacgacgccaaguucgagaagcagcugggccagaucaugcuccugauccugugcaccucccagauccuccugaugcgcacgaccugggcccugugcgagagcaucacccucgccaccggcccccugacgacccugugggaggggucccccggcaaguucuggaacaccaccaucgccgugagcauggcgaacaucuuccgggggagcuaccucgccggcgccggccuggccuucucccugaugaagucccucgggggcgggcgccggggcacgggggcgcagggcgagacccugggcgagaaguggaagcgccagcugaaccagcucuccaagagcgaguucaacaccuacaagcgguccgggaucauggaggucgaccgcagcgaggccaaggagggccugaagcgcggggagaccacgaagcacgccgugucccgcggcaccgccaagcugcggugguucguggagcgcaaccucgucaagccggaggggaaggugaucgaccugggcugcggccgcggcggguggagcuacuacugcgccgggcugaagaaggugaccgaggucaagggguacaccaagggcgggcccggccacgaggagcccauccccauggcgacguacggguggaaccuggugaagcuccacuccggcaaggacguguucuucaucccgcccgagaagugcgacacccugcugugcgacaucggggagagcucccccaaccccaccaucgaggagggccgcacccuccggguccugaagaugguggagccguggcugcgcgggaaccaguucugcaucaagauccucaaccccuacaugcccagcguggucgagacgcuggagcagaugcagcggaagcacggcggcaugcuggugcgcaacccccucucccggaacagcacccacgagauguacuggguguccugcgggaccggcaacaucgucagcgccgugaacaugaccucccgcaugcugcugaaccgguucaccauggcccaccgcaagccgacguacgagcgcgacguggaccucggggccggcacccggcacgucgccguggagcccgagguggcgaaccuggacaucaucggccagcgcaucgagaacaucaagcacgagcacaagagcaccuggcacuacgacgaggacaaccccuacaagaccugggccuaccacggguccuacgaggucaagcccagcggcagcgccuccagcauggugaacggggucgugaagcugcucacgaagccgugggacgugauccccauggucacccagaucgccaugaccgacaccacgcccuucggccagcagcggguguucaaggagaagguggacacccgcacccccaaggccaagcgggggaccgcgcagaucauggaggucacggccaaguggcuguggggcuuccugucccgcaacaagaagccgcggaucugcacccgcgaggaguucacccggaaggugcgcagcaacgccgccaucggcgcgguguucgucgacgagaaccaguggaacuccgccaaggaggccguggaggacgagcgguucugggaccucgugcaccgcgagcgggagcugcacaagcaggggaagugcgcgaccugcgucuacaacaugaugggcaagcgcgagaagaagcugggggaguucggcaaggccaaggggagccgggcgaucugguacauguggcucggcgcccgcuuccuggaguucgaggcccugggcuucaugaacgaggaccacugguucucccgggagaacagccucuccgggguggagggcgaggggcugcacaagcugggcuacauccuccgcgacaucagcaagauccccgggggcaacauguacgccgacgacacggccggcugggacacccggaucaccgaggacgaccugcagaacgaggcgaagaucaccgacaucauggagcccgagcacgcccugcucgccaaguccaucuucaagcugacguaccagaacaaggugguccgcgugcagcggccggccaagaacgggaccgugauggacgucaucagccgccgcgaccagcggggcuccggccaggugggcaccuacggccugaacaccuucacgaacauggaggcccagcucauccgccagauggagagcgaggggaucuucucccccagcgagcuggagacccccaaccuggcgggccgggugcucgacuggcuggagaagcacggggucgagcgccugaagcggauggccaucuccggcgacgacugcguggugaagcccaucgacgaccgcuucgccaccgcccucaccgcccugaacgacauggggaagguccggaaggacaucccgcagugggagcccagcaagggcuggaacgacuggcagcagguccccuucugcagccaccacuuccaccagcugaucaugaaggacggccgcgagaucgugguccccugccggaaccaggacgagcucguggggcgcgcgcgggugucccagggcgccggguggagccugcgcgagacggccugccugggcaaguccuacgcccagauguggcagcucauguacuuccaccggcgcgaccugcggcuggcggccaacgccaucugcagcgccgucccgguggacugggugcccaccucccgcaccaccuggagcauccacgcccaccaccaguggaugacgaccgaggacaugcucuccgucuggaaccggguguggaucgaggagaaccccuggauggaggacaagacccacaucagcuccuggggcgacgugcccuaccugggcaagcgcgaggaccaguggugcggcagccugaucgggcucaccgcgcgggccacgugggccaccaacauccaggucgccaucaaccaggugcgccgccugaucggcaacgagaacuaccuggacuacaugaccuccaugaagcgguucaagaacgagagcgacccggagggggcccucugguga

SEQ ID NO: 8383 - RNA, 9879 nt, Artificial Sequence
  derived and/or modified CDS sequence (opt1) from DENV-1__FJ461310__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgaggccgagcccgacgacguggacugcuggugcaacgccaccgacaccugggucaccuacgggaccugcagccagaccggcgagcaccggcgggacaagcgguccguggcccucgcgccccacgugggccuggggcuggagacgcgcaccgagaccuggaugagcuccgagggcgccuggaagcagauccagcgggucgagaccugggcccuccggcaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcggugcugcggaagcucugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacaccggcgaccagcaccagguggggaacgaguccacggagcacggcaccaccgcgaccaucacgccccaggcccccacgaccgagauccagcucaccgacuacggggcccugacccuggacugcagcccccgcacgggccucgacuucaacgagaugguccugcugaccaugaaggagaaguccuggcucgugcacaagcagugguuccuggaccugccccuccccuggaccagcggggccagcaccucccaggagacguggaaccggcaggaccugcuggugaccuucaagaccgcccacgcgaagaagcaggaggucguggugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgucaugugcaccggguccuucaagcucgagaaggagguggcggagacgcagcacggcaccgugcugguccagaucaaguacgagggcaccgacgcccccugcaagauccccuucagcacccaggacgagaagggggugacgcagaacggccggcugaucaccgccaacccgaucgugaccgacaaggagaagcccgucaacaucgaggccgagccgcccuucggggaguccuacaucgugaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcgucgggaagcuggugcaccagaucuucggcaccgccuacggggugcuguucuccggcgucagcuggaccaugaagaucgggaucggcgugcugcugacguggcucggccugaacucccgcagcaccucccugagcaugaccugcaucgccguggggcucaucacccuguaccugggcgucauggugcaggccgacuccgggugcgugaucaacuggaagggccgggagcucaagugcgggagcggcaucuucgucacgaacgaggugcacaccuggaccgagcaguacaaguuccaggcggacagcccgaagcgccuguccgccgccaucggcaaggccugggaggagggggugugcggcauccggagcgccacccgccuggagaacaucauguggaagcagaucuccaacgagcucaaccacauccugcuggagaacgacaugaaguucaccgucguggugggggacgucgcgggcauccucgcccaggggaagaagaugauccggccccagcccauggaguacaaguacagcuggaaguccuggggcaaggccaagaucaucggcgccgacgugcagaacacgaccuucaucaucgacgggcccaacaccccggagugccccgacgaccagcgcgcguggaacaucugggagguggaggacuacggcuucgggaucuucaccacgaacaucuggcugaagcugcgggacagcuacacccaggucugcgaccaccgccucauguccgccgccaucaaggacagcaaggccgugcacgccgacaugggcuacuggaucgaguccgagaagaacgagaccuggaagcuggcgcgggccagcuucaucgaggugaagaccugcaucuggcccaagucccacacgcuguggagcaacggcguccucgaguccgagaugaucauccccaagaucuacgggggcccgaucagccagcacaacuaccgccccggguacuucacccaggccgccggccccuggcaccuggggaagcuggagcucgacuucgaccugugcgagggcaccaccgugguggucgacgagcacugcggcaaccgggggccgucccugcgcacgaccaccgugaccggcaagaucauccacgaguggugcugccggagcugcacgcugccgccccuccgcuuccgcggggaggacggcugcugguacgggauggagauccgccccgugaaggagaaggaggagaaccuggucaaguccauggugagcgccggcagcggcgagguggacuccuucagccucgggcugcugugcaucuccaucaugaucgaggaggucaugcggagccgcuggucccggcgcaugcucaugaccggcacccuggcgguguucuuccugcucaucauggggcagcugaccuggaacgaccugauccgccucugcaucauggugggcgccaacgccagcgaccggauggggaugggcacgaccuaccuggcccugauggccaccuucaagaugcgcccgauguucgcggucggccuccuguuccggcgccugaccucccgggaggugcuccugcugacgaucgggcucagccugguggccuccgucgagcugcccaacagccucgaggagcugggcgacgggcuggccaugggcaucaugauccucaagcugcugaccgacuuccagucccaccagcucugggccacccugcugagccucaccuucaucaagacgaccuucucccugcacuacgcguggaagaccauggccauggugcugagcaucgucucccucuucccccugugccugagcaccacgucccagaagaccaccuggcuccccgugcugcugggcagccucgggugcaagccgcugaccauguuccugaucgccgagaacaagaucuggggccgccgguccuggccccucaacgaggggaucauggccgugggcaucgucagcauccugcugagcucccuccugaagaacgacgugccccuggccgggccccucaucgcgggcggcaugcugaucgccugcuacgugaucagcggguccagcgccgaccugucccucgagaaggccgccgaggucagcugggaggaggaggcggagcacuccggcgccagccacaacauccugguggaggugcaggacgacgggacgaugaagaucaaggacgaggagcgcgacgacacccugaccauccuccugaaggccacccugcucgccgucuccggcguguacccgcugagcauccccgccacccuguucgugugguacuucuggcagcggaagaagcagcgcuccgggguccucugggacacgcccagcccgcccgagguggagcgggcggugcuggacgacggcaucuaccgcaucaugcagcggggccugcuggggcgcucccaggucggcguggggguguuccaggagaacgucuuccacaccauguggcacgugacccggggcgccgugcucauguaccaggggaagcgccuggagcccagcugggccuccgucaagaaggaccugaucagcuacggcggcggguggcggcuccagggcuccuggaacaccggggaggagguccaggugaucgccgucgagcccggcaagaaccccaagaacgugcagacggcccccgggaccuucaagacccccgagggcgaggugggcgcgaucgcccuggacuucaagcccgggaccagcggcucccccaucgucaaccgcgaggggaagaucgugggccuguacggcaacgggguggucacgaccagcggcaccuacgugagcgccaucgcccaggcgaaggccucccaggaggggccgcuccccgagaucgaggacgagguguuccggaagcgcaaccugaccaucauggaccugcaccccggcagcgggaagacgcggcgcuaccucccggccaucguccgcgaggccaucaagcggaagcugcgcacccugauccucgcccccacccgggugguggcguccgagauggccgaggcccugaagggcaugcccauccgcuaccagaccacggccgucaagagcgagcacaccggcaaggagaucguggaccugaugugccacgccaccuucaccaugcggcuccugucccccgugcgcgucccgaacuacaacaugaucaucauggacgaggcgcacuucacggaccccagcuccaucgccgcccggggguacaucagcacccgcgugggcaugggggaggccgccgcgaucuucaugaccgccacgccgcccggcuccguggaggccuucccgcagagcaacgccgucauccaggacgaggagcgggacauccccgagcgcuccuggaacagcggguacgaguggaucacggacuuccccggcaagaccgugugguucgugcccuccaucaagagcggcaacgacaucgcgaacugccugcggaagaacgggaagcgcgucauccagcucucccggaagaccuucgacaccgaguaccagaagacgaagaacaacgacugggacuacguggugaccaccgacaucagcgagaugggcgccaacuuccgcgccgaccgggucaucgacccgcgccggugccugaagcccgugauccugaaggacgggcccgagcgcgugauccucgccggccccaugccggucaccguggccuccgcggcccagcggcgcgggcgcaucggccggaaccacaacaaggagggcgaccaguacaucuacauggggcagccccugaacaacgacgaggaccacgcccacuggacggaggccaagaugcugcucgacaacaucaacacccccgagggcaucauccccgcccuguucgagccggagcgcgagaaguccgcggccaucgacggggaguaccggcugcgcggcgaggcccggaagaccuucgucgagcucaugcgccgcggggaccugcccguguggcuguccuacaagguggccagcgagggcuuccaguacagcgaccgccgguggugcuucgacggcgagcgcaacaaccagguccucgaggagaacauggacguggagaucuggaccaaggagggggagcggaagaagcugcgcccccgguggcuggacgcccgcacguacuccgacccccucgcgcugcgggaguucaaggaguucgccgccggccgccggagcguguccggggaccugauccucgagaucggcaagcugccgcagcaccugacccagcgcgcccagaacgcgcucgacaaccuggucaugcugcacaacagcgagcagggcgggcgggccuaccgccacgccaucgaggagcuccccgacaccaucgagacccugaugcugcucgcccugaucgccgugcugacgggcggggugacccucuucuuccuguccggccgggggcugggcaagaccagcaucggccuccugugcgucauggcguccagcgugcugcucuggauggccuccguggagccccacuggaucgccgccagcaucauccuggaguucuuccugaugguccuccugauccccgagccggaccgccagcgcacgccccaggacaaccagcuggccuacguggugaucgggcuccuguucaugauccugaccgucgcggccaacgagaugggccuccuggagacgaccaagaaggaccuggggaucggccacguggccguggagaaccaccaccacgccgccaugcucgacgucgaccugcaccccgcguccgccuggacccuguacgccguggccaccacgaucaucaccccgaugaugcggcacaccaucgagaacaccacggccaacaucagccucaccgcgaucgccaaccaggccgccauccugauggggcuggacaagggcuggcccaucuccaagauggacaucggcgugccccuccuggcgcuggggugcuacagccaggucaacccccucacccugaccgccgccgugcugaugcucguggcccacuacgccaucaucggcccggggcugcaggcgaaggccacgcgcgaggcccagaagcggaccgccgccggcaucaugaagaaccccaccgucgacgggaucguggcgaucgaccuggaccccguggucuacgacgccaaguucgagaagcagcucggccagaucaugcugcugauccucugcaccucccagauccugcugaugcgcacgaccugggcccucugcgagagcaucacccuggccaccggcccccugacgacccucugggagggguccccgggcaaguucuggaacaccaccaucgccgugagcauggcgaacaucuuccggggguccuaccuggccggcgccggccuggccuucagccucaugaagucccucgggggcgggcgccgggggacgggggcgcagggcgagacccugggcgagaaguggaagcgccagcucaaccagcuguccaagagcgaguucaacaccuacaagcgguccgggaucauggagguggaccgcagcgaggccaaggagggccugaagcgcggggagaccacgaagcacgccgucucccgcggcaccgccaagcuccggugguucguggagcgcaaccuggugaagcccgaggggaaggucaucgaccugggcugcggccgcgggggcuggagcuacuacugcgccgggcugaagaaggugaccgaggugaagggcuacaccaagggcggccccggccacgaggagcccaucccgauggcgacguacggguggaaccucgucaagcugcacuccggcaaggacguguucuucaucccgcccgagaagugcgacacccugcucugcgacaucggggagagcucccccaacccgaccaucgaggagggccgcacccugcgggugcugaagauggucgagcccuggcuccgcgggaaccaguucugcaucaagauccugaaccccuacaugcccagcgugguggagacgcuggagcagaugcagcggaagcacggcggcaugcucguccgcaacccgcugucccgcaacagcacccacgagauguacuggguguccugcgggaccggcaacaucgugagcgccgucaacaugaccucccggaugcugcucaaccgcuucaccauggcccaccggaagcccacguacgagcgcgacguggaccugggggccggcacccggcacguggccgucgagcccgagguggcgaaccuggacaucaucggccagcgcaucgagaacaucaagcacgagcacaagagcaccuggcacuacgacgaggacaaccccuacaagaccugggccuaccacggguccuacgaggugaagccgagcggcuccgccagcagcauggucaacgggguggucaagcuccugacgaagcccugggacgugauccccauggugacccagaucgccaugaccgacaccacgcccuucggccagcagcgggucuucaaggagaagguggacacccgcaccccgaaggccaagcgggggaccgcgcagaucauggaggugacggccaaguggcuguggggcuuccucucccgcaacaagaagccccggaucugcacccgcgaggaguucacccggaagguccgcagcaacgccgccaucggcgcgguguucguggacgagaaccaguggaacuccgccaaggaggccgucgaggacgagcgguucugggaccuggugcaccgcgagcgggagcugcacaagcaggggaagugcgcgaccugcguguacaacaugaugggcaagcgcgagaagaagcucggggaguucggcaaggccaaggggagccgggcgaucugguacauguggcugggcgcccgcuuccuggaguucgaggcccucggcuucaugaacgaggaccacugguucucccgggagaacagccuguccggggucgagggcgaggggcugcacaagcucggcuacauccugcgcgacaucagcaagauccccgggggcaacauguacgccgacgacacggccggcugggacacccgcaucaccgaggacgaccugcagaacgaggcgcggaucaccgacaucauggagccggagcacgcccuccuggccaaguccaucuucaagcugacguaccagaacaagguggugcgcguccagcggcccgccaagaacgggaccgugauggacgugaucagccgccgggaccagcgcggcuccgggcaggucggcaccuacggccucaacaccuucacgaacauggaggcccagcugauccggcagauggagagcgaggggaucuucucccccagcgagcuggagacccccaaccucgcggagcgcgugcuggacuggcuggagaaguacggcguggagcggcucaagcgcauggccaucuccggggacgacugcgucgugaagccgaucgacgaccgguucgccaccgcccugaccgcccugaacgacaugggcaaggugcgcaaggacaucccccagugggagcccagcaagggguggaacgacuggcagcagguccccuucugcucccaccacuuccaccagcucaucaugaaggacggccgggagaucguggugccgugccgcaaccaggacgagcuggucggccgggcgcgcgugagccagggggccggcuggagccugcgggagacggccugccucgggaaguccuacgcccagauguggcagcugauguacuuccaccgccgggaccugcgccucgcggccaacgccaucugcagcgccgugcccgucgacuggauccccaccucccgcaccaccuggagcauccacgcccaccaccaguggaugacgaccgaggacaugcuguccguguggaaccggguguggaucgaggagaaccccuggauggaggacaagacccacaucagcuccuggggcgacgucccguaccuggggaagcgcgaggaccaguggugcggcagccucaucggccugaccgcgcgggccacgugggccaccaacauccagguggccaucaaccaggugcgccggcugaucgggaacgagaacuaccucgacuacaugaccuccaugaagcgcuucaagaacgagagcgaccccgagggcgcccugugguga

SEQ ID NO: 8384 - RNA, 9879 nt, Artificial Sequence
  derived and/or modified CDS sequence (opt1) from DENV-1__FJ906728__SS-prME
agcgugaccaugcugcucaugcugaugcccaccgcccuggccuuccaccucacgacccgcggcggggagccgcacaugaucgucuccaagcaggagcggggcaagagccugcuguucaagaccuccgcgggggugaacaugugcacccucaucgccauggaccugggcgagcugugcgaggacacgaugaccuacaagugcccccgcaucaccgaggccgagcccgacgacguggacugcuggugcaacgccaccgacacgugggucaccuacgggaccugcagccagaccggcgagcaccggcgcgacaagcgguccguggcccucgcgccccacgugggccuggggcuggagacgcgcaccgagaccuggaugagcuccgagggcgccuggaagcagauccagcgggucgagaccugggcccuccgccacccgggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcggugcugcggaagcucugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacaccggcgaccagcaccagguggggaacgaguccacggagcacggcaccaccgcgaccaucaccccccaggcccccacgaccgagauccagcucaccgacuacggggcccugauccuggacugcagcccccgcaccggccucgacuucaacgagaugguccugcugacgaugaaggagaaguccuggcucgugcacaagcagugguuccuggaccugccgcuccccuggaccagcggggccagcaccucccaggagaccuggaaccggcaggaccugcuggugacguucaagaccgcccacgcgaagaagcaggaggucguggugcucggcagccaggagggcgccaugcacaccgcccugaccggggccacggagauccagaccuccggcaccaccacgaucuucgccgggcaccugaagugccgccucaagauggacaagcugacccugaagggcaugagcuacgucaugugcaccgggcccuucaagcucgagaaggagguggcggagacccagcacggcacggugcugguccagaucaaguacgagggcaccgacgcccccugcaagaucccguucuccacccaggacgagaagggggugacccagaacggccggcugaucacggccaaccccaucgugaccgacaaggagaagcccgucaacaucgaggccgagcccccguucggggagagcuacaucgugaucggcgcgggcgagaaggcccugaagcucuccugguucaagaaggggagcuccaucggcaagauguucgaggccaccgcccgcggggcccggcgcauggcgauccugggcgacaccgccugggacuucgggagcaucggcggcguguucacguccgucgggaagcuggugcaccagaucuucggcaccgccuacggggugcucuucagcggcgucuccuggaccaugaagaucgggaucggcgugcugcugaccuggcucggccugaacagccgcuccacgagccuguccaugaccugcaucgccguggggcucgucacccuguaccugggcgugauggugcaggccgacagcgggugcgucaucaacuggaagggccgggagcucaagugcggguccggcaucuucgugaccaacgaggugcacacguggaccgagcaguacaaguuccaggcggacagccccaagcgccugagcgccgccaucggcaaggccugggaggagggggucugcggcauccgguccgccacccgccuggagaacaucauguggaagcagaucagcaacgagcucaaccacauccugcuggagaacgacaugaagcucaccgugguggucggggacguggcgggcauccuggggcagggcaagaagaugauccggccccagcccauggaguacaaguacuccuggaagagcuggggcaaggccaagaucaucggggccgacgcccagaacaccacguucaucaucgacggcccgaacacccccgagugccccgacgaccagcgcgcguggaacaucugggagguggaggacuacggguucggcaucuucaccaccaacaucuggcugaagcuccgggacuccuacacgcaggucugcgaccaccgccugaugagcgccgccaucaaggacuccaaggccgugcacgccgacaugggcuacuggaucgagagcgagaagaacgagaccuggaagcuggcgcgggccuccuucaucgaggugaagaccugcaucuggcccaagagccacacccucugguccaacgggguccuggagagcgagaugaucaucccgaagaucuacggcgggcccaucucccagcacaacuaccgccccggcuacuucacgcagaccgccgggccguggcaccugggcaagcucgagcuggacuucgaccugugcgagggcaccaccgugguggucgacgagcacugcgggaaccggggccccagccuccgcacgaccaccgugaccgggaagaucauccacgaguggugcugccgguccugcacgcugcccccccugcgcuuccggggcgaggacgggugcugguacggcauggagauccgcccggugaaggagaaggaggagaaccucgucaagagcaugguguccgccggcagcggggagguggacagcuucucccugggccugcucugcaucagcaucaugaucgaggaggucaugcggucccgcuggagccggaagaugcugaugaccgggacccuggccguguucuuccuccugaucaugggccagcugaccuggaacgaccucauccgccugugcaucauggugggggcgaacgccuccgaccgcaugggcaugggcacgaccuaccuggcccucauggccaccuucaagaugcggcccauguucgccgucgggcugcugcuccgccggcugaccagccgcgaggugcugcuccugacgaucggccugucccucguggcgagcgucgagcugcccaacucccuggaggagcucggggacggccuggccaugggcaucaugauccugaagcuccugaccgacuuccagagccaccagcugugggccacccuccugucccugaccuucaucaagacgaccuucagccuccacuacgccuggaagaccauggcgauggugcuguccaucgucagccuguucccccucugccuguccaccacgagccagaagaccaccuggcugccggugcuccuggggucccugggcugcaagccccucaccauguuccugaucgccgagaacaagaucugggggcggaagagcuggccccugaacgagggcaucauggccguggggaucgucuccauccuccugagcagccugcucaagaacgacgugccccuggccggcccgcugaucgccggcgggaugcucaucgcgugcuacgugaucuccggcagcuccgccgaccugagccuggagaaggccgccgaggucuccugggaggaggaggccgagcacagcggggcgucccacaacauccucguggaggugcaggacgacggcacgaugaagaucaaggacgaggagcgcgacgacacccugaccauccugcucaaggccacccugcuggccgucagcgggguguacccccucuccauccccgccacccuguucgugugguacuucuggcagaagaagaagcagcggagcggcguccugugggacacgcccuccccgcccgagguggagcgcgccgugcuggacgacggcaucuaccggaucaugcagcgcgggcuccugggccggagccaggucggggugggcguguuccaggagaacgucuuccacaccauguggcacgugacccgcggggcggugcugauguaccagggcaagcggcucgagcccuccugggccagcgucaagaaggaccugaucuccuacggcgggggcuggcgccugcgggggagcuggaacaccggcgaggaggugcaggugaucgccgucgagcccgggaagaacccgaagaacgugcagacggcccccggcaccuucaagacccccgagggcgaggugggggccaucgcgcucgacuucaagcccggcaccuccgggagcccgaucgucaaccgcgagggcaagaucgugggccuguacgggaacggcguggucacgaccuccgggaccuacgugagcgccaucgcccaggccaaggcgagccaggagggcccccugcccgagaucgaggacgagguguuccggaagcgcaaccucaccaucauggaccugcacccgggguccggcaagacgcggcgcuaccugcccgccaucguccgggaggccaucaagcgcaagcuccgcacccugauccuggcccccacccgggugguggccagcgagauggcggaggcccucaagggcaugcccauccgcuaccagaccacggccgucaaguccgagcacaccgggaaggagaucguggaccugaugugccacgccaccuucaccaugcggcugcucagcccggugcgcguccccaacuacaacaugaucaucauggacgaggcccacuucacggaccccuccagcaucgcggcccggggcuacaucuccacccgcguggggaugggcgaggccgccgccaucuucaugaccgcgacccccccggggagcguggaggccuucccccaguccaacgccgucauccaggacgaggagcgggacauccccgagcgcagcuggaacacgggcuacgaguggaucaccgacuuccccggcaagaccgugugguucgugccguccaucaagagcgggaacgacaucgccaacugccugcggaagaacggcaagcgcgucauccagcugucccggaagaccuucgacacggaguaccagaagaccaagaacaacgacugggacuacguggugaccaccgacaucagcgagaugggggcgaacuuccgcgccgaccgggucaucgacccccgccggugccucaagcccgugauccugaaggacggccccgagcgcgugauccuggccgggccgaugcccgucacgguggccuccgccgcgcagcggcgcggccggaucggccgcaaccacaacaaggagggggaccaguacaucuacaugggccagccccucaacaacgacgaggaccacgcccacuggaccgaggccaagaugcugcuggacaacaucaacacccccgaggggaucaucccggcccucuucgagcccgagcgcgagaagagcgccgcggucgacggcgaguaccggcugcgcggggaggcccggaagaccuucguggagcugaugcgccggggcgaccuccccguguggcuguccuacaaggucgccagcgagggcuuccaguacuccgaccgccgguggugcuucgacggggagcgcaacaaccaggugcuggaggagaacauggacguggagaucuggacgaaggagggcgagcggaagaagcuccgcccccgguggcuggacgcccgcaccuacagcgacccgcuggcccuccgggaguucaaggaguucgcggccgggcgccggagcgucuccggcgaccugauccuggagaucggcaagcucccccagcaccugacccagcgcgcccagaacgcccuggacaaccucgugaugcugcacaacagcgagcaggggggccgggcguaccgccacgccauggaggagcugcccgacaccaucgagacgcucaugcugcuggcccucaucgccgugcugaccgggggcgucacccuguucuuccucuccgggcggggccugggcaagaccagcaucgggcugcucugcgugauggccuccagcgugcugcuguggauggcguccgucgagccccacuggaucgccgccagcaucauccucgaguucuuccugauggugcugcucaucccggagcccgaccgccagcggaccccccaggacaaccagcuggccuacguggucaucggccugcucuucaugauccuggccguggcggccaacgagauggggcugcucgagacgaccaagaaggaccugggcaucgggcacguggccgucgagaaccaccaccacgccgccaugcuggacguggaccuccacccggcguccgccuggacccuguacgccguggccaccacgaucaucacccccaugaugcgccacaccaucgagaacaccacggccaacaucagccugaccgcgaucgccaaccaggccgccauccucaugggccuggacaagggcuggcccaucuccaagauggacaucggggucccccugcucgcgcugggcugcuacagccaggugaacccgcugacccucaccgccgccgugcugaugcuggucgcccacuacgccaucaucgggcccggccuccaggcgaaggccacgcgcgaggcccagaagcggaccgccgccgggaucaugaagaaccccaccguggacggcaucguggcgaucgaccuggaccccgucguguacgacgccaaguucgagaagcagcugggccagaucaugcuccugauccugugcaccucccagauccuccugaugcgcacgaccugggcccugugcgagagcaucacccucgccaccgggccgcugacgacccugugggagggcucccccgggaaguucuggaacaccaccaucgccgugagcauggcgaacaucuuccggggcuccuaccucgccggcgccgggcuggccuucagccugaugaagucccucggcgggggccgccgggggacgggcgcgcagggcgagacccugggggagaaguggaagcgccagcugaaccagcucagcaagagcgaguucaacaccuacaagcgguccggcaucauggaggucgaccgcagcgaggccaaggaggggcugaagcggggcgagaccacgaagcacgccgugucccgcgggaccgccaagcugcggugguucguggagcgcaaccuggucaagcccgagggcaaggugaucgaccucggcugcgggcggggcggguggagcuacuacugcgccggccugaagaaggugaccgaggucaagggguacaccaagggcggccccgggcacgaggagccgauccccauggcgacguacggcuggaaccuggugaagcuccacuccgggaaggacguguucuucaucccccccgagaagugcgacacccugcugugcgacaucggcgagagcuccccgaaccccaccaucgaggaggggcgcacccuccggguccugaagaugguggagcccuggcugcgcggcaaccaguucugcaucaagauccucaaccccuacaugccgagcguggucgagacgcuggagcagaugcagcggaagcacggcgggaugcuggugcgcaacccccucucccggaacagcacccacgagauguacuggguguccugcggcaccgggaacaucgucagcgccgugaacaugaccucccgcaugcugcugaaccgcuucaccauggcccaccggaagcccacguacgagcgcgacguggaccucggcaccggcacccggcacgucgccguggagcccgagguggccaaccuggacaucaucgggcagcgcaucgagaacaucaagcacgagcacaagagcaccuggcacuacgacgaggacaacccguacaagacgugggcguaccacggcuccuacgaggucaagcccagcggguccgccagcuccauggugaacggcgucgugaagcugcucaccaagcccugggacgugauccccauggucacccagaucgccaugaccgacacgaccccguucgggcagcagcggguguucaaggagaagguggacacccgcacccccaaggccaagcggggcacggcccagaucauggaggucaccgcgcgcuggcuguggggcuuccugagccggaacaagaagccccgcaucugcacccgggaggaguucacccgcaaggugcggagcaacgccgccaucggggccguguucgucgacgagaaccaguggaacuccgcgaaggaggccguggaggacgagcgcuucugggaccucgugcaccgggagcgcgagcugcacaagcagggcaagugcgccacgugcgucuacaacaugauggggaagcgggagaagaagcugggcgaguucgggaaggccaagggcagccgcgccaucugguacauguggcucggcgcgcgguuccuggaguucgaggcccugggguucaugaacgaggaccacugguucucccgcgagaacagccucuccggcguggagggggagggccugcacaagcugggguacauccuccgggacaucagcaagaucccgggcggcaacauguacgccgacgacaccgccgggugggacacccgcaucaccgaggacgaccugcagaacgaggccaagaucacggacaucauggagcccgagcacgcgcugcucgccaaggccaucuucaagcugaccuaccagaacaaggugguccgcgugcagcggcccgccaagaacggcaccgugauggacgucaucucccgccgggaccagcgcgggagcggccaggugggcaccuacgggcugaacacguucaccaacauggaggcccagcucauccggcagauggaguccgagggcaucuucagccccuccgagcuggagaccccgaaccuggcggagcgcgcccucgacuggcuggagaaguacgggguggagcggcugaagcgcauggccaucagcggcgacgacugcgucgugaagcccaucgacgaccgguucgccaccgcccucacggcgcugaacgacauggggaaggugcgcaaggacaucccccagugggagcccuccaagggcuggaacgacuggcagcaggucccguucugcagccaccacuuccaccagcugaucaugaaggacggccgggagaucguggugcccugccgcaaccaggacgagcucgucgggcgggcccgcgugucccagggcgccggguggagccugcgggagaccgccugccugggcaaguccuacgcgcagauguggcagcucauguacuuccaccgccgggaccugcgccuggccgccaacgccaucugcagcgccgugcccgucgacugggugcccaccagccggaccacgugguccauccacgcgcaccaccaguggaugaccaccgaggacaugcucagcguguggaaccgcgucuggaucgaggagaacccguggauggaggacaagacccacaucuccagcugggaggacgugcccuaccuggggaagcgcgaggaccaguggugcggcucccugaucggccucacggcccgggccaccugggccaccaacauccagguggccaucaaccagguccgccggcugaucgggaacgagaacuaccuggacuacaugaccagcaugaagcgcuucaagaacgaguccgaccccgagggcgcgcucugguga

SEQ ID NO: 8385 - RNA, 9879 nt, Artificial Sequence
  derived and/or modified CDS sequence (opt1) from DENV-1__FJ461313__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacacgaugaccuacaagugcccccgcaucaccgaggccgagcccgacgacguggacugcuggugcaacgccaccgacacgugggugaccuacgggaccugcagccagaccggcgagcaccggcgggacaagcgguccguggcccucgcgccccacgugggccuggggcuggagacgcgcaccgagaccuggaugagcuccgagggcgccuggaagcagauccagcggguggagaccugggcccuccgccaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcggugcugcggaagcucugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacaccggcgaccagcaccagguggggaacgaguccacggagcacggcaccaccgcgaccaucacgccccaggcccccacgaccgagauccagcucaccgacuacggggcccugacccuggacugcagcccccgcacgggccucgacuucaacgagaugguccugcugaccaugaaggagaaguccuggcucgugcacaagcagugguuccuggaccugccccuccccuggaccagcggggccagcaccucccaggagacguggaaccggcaggaccugcuggugaccuucaagaccgcccacgcgaagaagcaggaggucguggugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgucaugugcaccggguccuucaagcucgagaaggagguggcggagacgcagcacggcaccgugcugguccagaucaaguacgagggcaccgacgcccccugcaagauccccuucagcacccaggacgagaagggggugacgcagaacggccggcugaucaccgccaacccgaucgugaccgacaaggagaagcccgucaacaucgaggccgagccgcccuucggggaguccuacaucgugaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcgucgggaagcuggugcaccagaucuucggcaccgccuacgggguccucuucuccggcgucagcuggaccaugaagaucgggaucggcgugcugcugacguggcucggccugaacucccgcagcaccucccugagcaugaccugcaucgccguggggcucgucacccuguaccugggcgccauggugcaggcggacuccgggugcgugaucaacuggaagggccgggagcucaagugcgggagcggcaucuucgucacgaacgaggugcacaccuggaccgagcaguacaaguuccaggccgacagcccgaagcgccuguccgccgccaucggcaaggccugggaggagggggugugcggcauccggagcgcgacccgccuggagaacaucauguggaagcagaucuccaacgagcucaaccacauccugcuggagaacgacaugaagcucaccgucguggugggggacgucgccggcauccuggggcagggcaagaagaugauccggccccagcccauggaguacaaguacagcuggaaguccuggggcaaggccaagaucaucggggccgacgcgcagaacacgaccuucaucaucgacggccccaacaccccggagugccccgacgaccagcgcgccuggaacaucugggagguggaggacuacggguucggcaucuucaccacgaacaucuggcugaagcuccgggacagcuacacccaggugugcgaccaccgccugauguccgccgccaucaaggacagcaaggccguccacgcggacaugggcuacuggaucgaguccgagaagaacgagaccuggaagcuggcccgggccagcuucaucgaggugaagaccugcaucuggcccaagucccacacgcucuggagcaacggggugcuggaguccgagaugaucauccccaagaucuacggcgggccgaucagccagcacaacuaccgccccggcuacuucacccagaccgccgggcccuggcaccugggcaagcucgagcuggacuucgaccugugcgagggcaccacggucgugguggacgagcacugcgggaaccggggcccgucccuccgcaccaccaccgucacggggaagaucauccacgaguggugcugccggagcugcacccugccgccccugcgcuuccggggcgaggacgggugcugguacggcauggagauccgccccgugaaggagaaggaggagaaccucgugaaguccauggucagcgccggcagcggggagguggacuccuucagccugggccugcucugcaucuccaucaugaucgaggaggugaugcggagccgcuggucccggaagaugcugaugaccgggacccuggcggucuucuuccuccugaucaugggccagcugacguggaacgaccucauccgccugugcaucauggugggggccaacgccagcgaccgcaugggcaugggcaccaccuaccuggcccucauggccaccuucaagaugcggccgauguucgcgguggggcugcuguuccgccggcucacgucccgcgagguccugcugcucaccaucggccugagccugguggccuccguggagcuccccaacagccuggaggagcugggggacggccucgccaugggcaucaugauccugaagcugcucaccgacuuccagucccaccagcugugggccacccugcucagccugacguucaucaagaccaccuucucccugcacuacgcguggaagaccauggccaugguccucagcaucgugucccuguucccccugugccucagcacgaccucccagaagaccaccuggcugcccguccugcucgggagccugggcugcaagccgcugacgauguuccucaucgccgagaacaagaucugggggcggaaguccuggccccugaacgagggcaucauggccguggggaucgugagcauccugcucagcucccugcugaagaacgacgucccccucgccggcccccugaucgcgggcgggaugcugaucgccugcuacgugaucagcggcuccagcgccgaccucucccuggagaaggccgccgaggugagcugggaggaggaggcggagcacuccggggccagccacaacauccuggucgaggugcaggacgacggcaccaugaagaucaaggacgaggagcgcgacgacacccucaccauccugcugaaggccacccuccuggccguguccggggucuacccgcugagcauccccgccacccucuucgugugguacuucuggcagaagaagaagcagcgguccggcgugcugugggacacccccagcccgcccgaggucgagcgcgcggugcuggacgacggcaucuaccggaucaugcagcgcgggcugcucggccggucccaggugggggucggcguguuccaggagaacguguuccacaccauguggcacgucacccgcggggccgugcugauguaccagggcaagcggcuggagcccagcugggccuccgugaagaaggaccucaucagcuacggcgggggcuggcgccugcggggguccuggaacacgggcgaggagguccaggugaucgccguggagcccgggaagaaccccaagaacguccagaccgcccccggcaccuucaagacccccgagggcgaggugggggcgaucgcccuggacuucaagcccggcacgagcgggucccccaucgugaaccgcgagggcaagaucgucggccucuacgggaacggcguggugaccaccagcgggaccuacgucagcgccaucgcccaggcgaaggccucccaggagggcccgcugcccgagaucgaggacgagguguuccggaagcgcaaccugacgaucauggaccuccaccccgggagcggcaagacccggcgcuaccugccggccaucgugcgggaggccaucaagcgcaagcugcgcacccucauccuggcccccacccgggucguggcguccgagauggccgaggcccugaagggcaugcccauccgcuaccagacgaccgccgucaagagcgagcacaccgggaaggagaucgucgaccucaugugccacgccaccuucacgaugcggcugcugucccccgugcgcgugccgaacuacaacaugaucaucauggacgaggcgcacuucaccgaccccagcuccaucgccgcccggggcuacaucagcacccgcgucgggaugggcgaggccgccgcgaucuucaugaccgccacgccgcccggguccguggaggccuucccgcagagcaacgccgugauccaggacgaggagcgggacauccccgagcgcuccuggaacagcggcuacgaguggaucaccgacuuccccggcaagaccgucugguucgugcccuccaucaagagcgggaacgacaucgcgaacugccuccggaagaacggcaagcgcgugauccagcugucccggaagaccuucgacacggaguaccagaagaccaagaacaacgacugggacuacgucgugaccaccgacaucagcgagaugggggccaacuuccgcgccgaccgggugaucgacccgcgccggugccugaagcccgucauccucaaggacggccccgagcgcgugauccuggccgggcccaugccggugacggucgccuccgcggcccagcggcgcggccggaucggccgcaaccacaacaaggagggggaccaguacaucuacaugggccagccccugaacaacgacgaggaccacgcccacuggaccgaggccaagaugcuccuggacaacaucaacacccccgaggggaucauccccgcccuguucgagccggagcgcgagaaguccgcggccguggacggcgaguaccggcuccgcggggaggcccggaagaccuucgucgagcugaugcgccggggcgaccugcccguguggcucuccuacaagguggccagcgagggcuuccaguacagcgaccgccgguggugcuucgacggggagcgcaacaaccagguccuggaggagaacauggacguggagaucuggacgaaggagggcgagcggaagaagcugcgcccccgguggcucgacgcccgcaccuacuccgacccccuggcgcugcgggaguucaaggaguucgccgccgggcgccggagcguguccggcgaccucauccuggagaucggcaagcugccgcagcaccucacccagcgcgcccagaacgcgcuggacaaccuggucaugcuccacaacagcgagcagggcgggcgggccuaccgccacgccauggaggagcugcccgacaccaucgagacgcugaugcuccuggcccugaucgccgugcucaccgggggcgugacccuguucuuccuguccgggcggggccucggcaagaccagcaucgggcugcugugcgucauggcguccagcgugcuccuguggauggccuccguggagccccacuggaucgccgccagcaucauccuggaguucuuccucaugguccugcugauccccgagccggaccgccagcggacgccccaggacaaccagcucgccuacguggugaucggccugcuguucaugauccucacggucgcggccaacgagauggggcugcuggagaccaccaagaaggaccucggcaucgggcacguggccguggagaaccaccaccacgccgccaugcuggacgucgaccugcaccccgcguccgccuggacccucuacgccguggccacgaccaucaucaccccgaugaugcgccacaccaucgagaacacgaccgccaacaucagccugaccgcgaucgccaaccaggccgccauccugaugggccucgacaagggcuggcccaucuccaagauggacaucggggugccccugcuggcgcucggcugcuacagccaggucaacccccugacccugacggccgccgugcucaugcugguggcccacuacgccaucaucgggccgggccugcaggcgaaggccacccgcgaggcccagaagcggaccgccgccgggaucaugaagaaccccaccgucgacggcaucguggcgaucgaccucgaccccguggucuacgacgccaaguucgagaagcagcugggccagaucaugcugcucauccugugcacgucccagauccugcucaugcgcaccaccugggcccugugcgagagcaucacccuggccacggggccccucaccacccugugggagggcuccccggggaaguucuggaacaccacgaucgccgugagcauggcgaacaucuuccggggcuccuaccuggccggcgccgggcucgccuucagccugaugaagucccugggcgggggccgccgguccaccggggcgcagggcgagacccucggcgagaaguggaagcgccagcugaaccagcugagcaaguccgaguucaacaccuacaagcggagcgggaucauggagguggaccgcuccgaggccaaggagggccucaagcgcggggagacgaccaagcacgccgucagccgcggcaccgccaagcugcggugguucguggagcgcaaccuggugaagcccgaggggaaggucaucgaccugggcugcggccgcggcgggugguccuacuacugcgccgggcucaagaaggugaccgaggugaagggguacacgaagggcggccccggccacgaggagcccaucccgauggcgaccuacggguggaaccuggucaagcugcacagcggcaaggacguguucuucaucccgcccgagaagugcgacacccuccugugcgacaucggggaguccagccccaacccgaccaucgaggagggccgcacgcugcgggugcucaagauggucgagcccuggcugcgcgggaaccaguucugcaucaagauccugaaccccuacaugcccuccgugguggagacccucgagcagaugcagcggaagcacggcggcaugcugguccgcaacccgcugagccggaacuccacccacgagauguacugggugagcugcgggaccggcaacaucguguccgccgucaacaugaccagccgcaugcuccugaaccgcuucacgauggcccaccggaagcccaccuacgagcgcgacguggaccuggggaccggcacccggcacguggccgucgagcccgagguggccaaccucgacaucaucggccagcgcaucgagaacaucaagcacgagcacaaguccacguggcacuacgacgaggacaaccccuacaagaccugggcguaccacgggagcuacgaggugaagccguccggcagcgccagcuccauggucaacgggguggucaagcugcugaccaagcccugggacgugauccccauggugacccagaucgccaugacggacaccacccccuucggccagcagcgggucuucaaggagaagguggacacccgcacgccgaaggccaagcgggggaccgcccagaucauggaggugaccgcgcgcuggcucuggggcuuccugagccggaacaagaagccccgcaucugcacccgggaggaguucacgcgcaagguccgguccaacgccgccaucggcgccguguucguggacgagaaccaguggaacagcgcgaaggaggccgucgaggacgagcgcuucugggaccuggugcaccgggagcgcgagcuccacaagcaggggaagugcgcgaccugcguguacaacaugaugggcaagcgggagaagaagcugggggaguucggcaaggccaaggggucccgcgccaucugguacauguggcugggcgcgcgguuccucgaguucgaggcccugggcuucaugaacgaggaccacugguucagccgcgagaacucccugagcggggucgagggcgaggggcuccacaagcugggcuacauccugcgggacaucuccaagauccccgggggcaacauguacgccgacgacaccgccggcugggacacccgcaucacggaggacgaccuccagaacgaggccaagaucaccgacaucauggagccggagcacgcgcugcuggccaaggccaucuucaagcucaccuaccagaacaagguggugcgcguccagcggcccgccaagaacgggaccgugauggacgugaucagccgccgggaccagcgcggcuccgggcaggucggcacguacggccugaacaccuucaccaacauggaggcccagcugauccggcagauggagagcgaggggaucuucucccccagcgagcucgagacccccaaccuggcggagcgcgcccugaacuggcucgagaaguacggcguggagcggcugaagcgcauggccaucuccggggacgacugcguggucaagccgaucgacgaccgguucgccacggcccugaccgcgcucaacgacaugggcaaggugcgcaaggacaucccccagugggagcccagcaagggguggaacgacuggcagcagguccccuucugcucccaccacuuccaccagcugaucaugaaggacggccgggagaucgucgugccgugccgcaaccaggacgagcuggugggccgggcccgcgucagccagggggccggcuggagccuccgggagaccgccugccuggggaaguccuacgcgcagauguggcagcugauguacuuccaccgccgggaccuccgccuggccgccaacgccaucugcagcgccgugcccguggacuggguccccaccucccggacgaccuggagcauccacgcgcaccaccaguggaugaccaccgaggacaugcuguccguguggaaccgcguguggaucgaggagaaccccuggauggaggacaagacgcacaucagcuccugggaggacgucccguaccucggcaagcgcgaggaccaguggugcgggagccugaucggccugaccgcccgggccaccugggccaccaacauccagguggccaucaaccaggugcgccggcucaucggcaacgagaacuaccuggacuacaugaccuccaugaagcgcuucaagaacgagagcgaccccgagggggcgcugugguga

SEQ ID NO: 8386 - RNA, 9879 nt, Artificial Sequence
  derived and/or modified CDS sequence (opt1) from DENV-1__FJ547063__SS-prME
agcgugaccaugcugcugaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgagaccgagcccgacgacguggacugcuggugcaacgccacggacaccugggugaccuacgggaccugcagccagacgggcgagcaccggcgggacaagcgguccguggcccucgcgccccacgugggccuggggcuggagacccgcaccgagaccuggaugagcuccgagggcgcguggaagcagauccagcgggucgagacgugggcccuccggcaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagcuggccgagacccagcacggcaccgugcuggugcagaucaaguacgagggcaccgacgcgcccugcaagauccccuucagcacgcaggacgagaagggggucacccagaacggccggcugaucaccgccaacccgaucgugaccgacaaggagaagcccgugaacaucgaggccgagccgcccuucggggaguccuacaucgucaucggcgccggcgagaaggcgcucaagcugagcugguucaagaagggguccagcaucggcaagauguucgaggccacggcccgcggggcccggcgcauggccauccugggcgacaccgcgugggacuucggguccaucggcggcguguucaccagcguggggaagcucguccaccagaucuucggcaccgccuacggggugcuguucuccggcgugagcuggacgaugaagaucgggaucggcguccugcucaccuggcugggccugaacucccgcagcaccucccucagcaugaccugcaucgccguggggcuggugacgcuguaccucggcgucauggugcaggccgacuccgggugcgugaucaacuggaagggccgggagcugaagugcgggagcggcaucuucgucaccaacgaggugcacaccuggaccgagcaguacaaguuccaggccgacagcccgaagcgccuguccgcggccaucggcaaggccugggaggagggggugugcggcauccggagcgccacccgccucgagaacaucauguggaagcagaucuccaacgagcugaaccacauccugcucgagaacgacaugaaguucacggucguggugggggacgucgccggcauccuggcgcaggggaagaagaugauccggccccagcccauggaguacaaguacagcuggaaguccuggggcaaggccaagaucaucggcgccgacgugcagaacaccaccuucaucaucgacgggcccaacaccccggagugccccgacgaccagcgcgccuggaacaucugggagguggaggacuacggcuucgggaucuucacgaccaacaucuggcugaagcuccgggacagcuacacccaggucugcgaccaccgccugauguccgcggccaucaaggacagcaaggccgugcacgccgacaugggcuacuggaucgaguccgagaagaacgagaccuggaagcuggcccgggcgagcuucaucgaggugaagacgugcaucuggcccaagucccacacccucuggagcaacggcguccuggaguccgagaugaucauccccaagaucuacgggggcccgaucagccagcacaacuaccgccccggguacuucacccagaccgccggccccuggcaccuggggaagcucgagcuggacuucgaccugugcgagggcacgaccgugguggucgacgagcacugcggcaaccgggggccgucccuccgcaccaccacggugaccggcaagaucauccacgaguggugcugccggagcugcacccugccgccccugcgcuuccgcggggaggacggcugcugguacgggauggagauccgccccgugaaggagaaggaggagaaccucgucaaguccauggugagcgccggcagcggcgagguggacuccuucagccuggggcugcucugcaucuccaucaugaucgaggaggucaugcggagccgcuggucccggaagaugcugaugaccggcacgcuggccguguucuuccuccugaucauggggcagcugaccuggaacgaccucauccgccugugcaucauggugggcgccaacgcgagcgaccgcauggggaugggcaccaccuaccuggcccucauggccacguucaagaugcggccgauguucgccgucggccugcuguuccgccggcucaccucccgcgaggugcugcugcucaccaucgggcugagccugguggccuccgucgagcuccccaacagccuggaggagcugggcgacgggcucgcgaugggcaucaugauccugaagcugcucaccgacuuccagucccaccagcugugggccacgcugcucagccugaccuucaucaagaccaccuucucccugcacuacgccuggaagacgauggccaugauccucagcaucgugucccuguucccccugugccucagcaccaccucccagaagaccacguggcugcccguccugcucggcagccuggggugcaagccgcugaccauguuccucaucgcggagaacaagaucuggggccggcgcuccuggccccugaacgaggggaucauggccgugggcaucgugagcauccugcucagcucccugcugaagaacgacgucccccucgccgggccccugaucgccggcggcaugcugaucgccugcuacgugaucagcggguccagcgcggaccucucccuggagaaggccgccgaggugagcugggaggaggaggccgagcacuccggcgccagccacaacauccuggucgaggugcaggacgacgggaccaugaagaucaaggacgaggagcgggacgacacccucaccauccugcugaaggcgacgcuccuggccguguccggcgucuacccgcugagcauccccgccacccucuucgugugguacuucuggcagaagaagaagcagcgcuccggggugcugugggacacccccagcccgcccgaggucgagcgggccgugcuggacgacggcaucuaccgcaucaugcagcggggccugcucgggcgcucccaggugggcgucgggguguuccaggagaacguguuccacaccauguggcacgucacgcggggcgccgugcugauguaccaggggaagcgccuggagcccagcugggcguccgugaagaaggaccucaucagcuacggcggcggguggcggcugcagggcuccuggaacaccggggaggagguccaggugaucgccguggagcccggcaagaaccccaagaacguccagaccgcccccgggaccuucaagacgcccgagggcgaggugggcgccaucgcccuggacuucaagcccgggaccagcggcucccccaucgugaaccgcgaggggaagaucgucggccucuacggcaacgggguggugaccaccagcggcacguacgucagcgcgaucgcccaggccaaggccucccaggaggggccgcugcccgagaucgaggacgagguguuccggaagcgcaaccugaccaucauggaccuccaccccggcagcgggaagacccggcgcuaccugccggcgaucgugcgggaggccaucaagcgcaagcugcgcacccucauccuggcccccacgcgggucguggccuccgagauggccgaggcgcugaagggcaugcccauccgcuaccagaccaccgccgucaagagcgagcacaccggcaaggagaucgucgaccucaugugccacgccacguucaccaugcggcugcugucccccgugcgcgugccgaacuacaacaugaucaucauggacgaggcccacuucaccgaccccagcuccaucgccgcgcggggguacaucagcacccgcgucggcaugggggaggccgccgccaucuucaugacggccacgccgcccggcuccguggaggcguucccgcagagcaacgccgugauccaggacgaggagcgggacauccccgagcgcuccuggaacagcggguacgaguggaucaccgacuuccccggcaagaccgucugguucgugcccuccaucaagagcggcaacgacaucgccaacugccuccggaagaacgggaagcgcgugauccagcugucccggaagacguucgacaccgaguaccagaagaccaagaacaacgacugggacuacgucgugaccacggacaucagcgagaugggcgccaacuuccgcgcggaccgggugaucgacccgcgccggugccugaagcccgucauccucaaggacgggcccgagcgcgugauccuggccggccccaugccggugaccgucgccuccgccgcccagcggcgcgggcggaucggccgcaaccacaacaaggagggcgaccaguacaucuacauggggcagccccugaacaacgacgaggaccacgcgcacuggaccgaggccaagaugcuccuggacaacaucaacacccccgagggcaucauccccgcccuguucgagccggagcgcgagaaguccgccgccaucgacggggaguaccggcuccgcggcgaggcgcggaagacguucguggagcugaugcgccgcggggaccugcccgucuggcucuccuacaagguggccagcgagggcuuccaguacagcgaccgccgguggugcuucgacggcgagcgcaacaaccaggugcuggaggagaacauggacgucgagaucuggaccaaggagggggagcggaagaagcugcgcccccgguggcucgacgcccgcaccuacuccgacccccuggcccugcgggaguucaaggaguucgccgcgggccgccggagcguguccggggaccucauccuggagaucggcaagcugccgcagcaccucacccagcgcgcccagaacgcccuggacaaccuggugaugcuccacaacagcgagcagggcgggcgggccuaccgccacgcgauggaggagcugcccgacacgaucgagacccugaugcuccuggcccugaucgccguccucaccggcggggugacccuguucuuccuguccggccgggggcucggcaagaccagcaucggccugcugugcgugauggccuccagcguccuccuguggauggccuccguggagccccacuggaucgcggccagcaucauccuggaguucuuccucauggugcugcugauccccgagccggaccgccagcggacgccccaggacaaccagcucgccuacgucgugaucgggcugcuguucaugauccucaccguggccgccaacgagaugggccugcuggagaccaccaagaaggaccucgggaucggccacgucgcgguggagaaccaccaccacgccgccaugcuggacguggaccugcaccccgccuccgccuggacgcucuacgcggucgccaccaccaucaucaccccgaugaugcgccacacgaucgagaacaccaccgccaacaucagccugaccgccaucgccaaccaggcggccauccugauggggcucgacaagggcuggcccaucuccaagauggacaucggcgugccccugcuggcccucgggugcuacagccaggugaacccccugacgcugaccgccgcgguccucaugcugguggcccacuacgccaucaucggcccggggcugcaggccaaggccacccgcgaggcgcagaagcggaccgccgccggcaucaugaagaaccccacgguggacgggaucgucgccaucgaccucgaccccgugguguacgacgccaaguucgagaagcagcugggccagaucaugcugcucauccugugcaccucccagauccugcucaugcgcaccaccugggcgcugugcgagagcaucacgcuggccaccggcccccucaccacccugugggagggguccccgggcaaguucuggaacacgaccaucgccgucagcauggccaacaucuuccggggguccuaccuggccggcgcgggccucgccuucagccugaugaagucccucgggggcgggcgccgggggaccggggcccagggcgagacccucggcgagaaguggaagcgccagcugaaccagcuguccaagagcgaguucaacacguacaagcgguccgggaucauggagguggaccgcagcgaggccaaggagggccucaagcgcggggagaccaccaagcacgcggugucccgcggcaccgccaagcugcggugguucgucgagcgcaaccuggugaagcccgaggggaaggugaucgaccugggcugcggccgcggcggguggagcuacuacugcgccgggcucaagaaggucacggaggugaagggguacaccaagggcggccccggccacgaggagcccaucccgauggccaccuacggguggaaccuggugaagcugcacuccggcaaggacgucuucuucaucccgcccgagaagugcgacacccuccugugcgacaucggggagagcucccccaacccgacgaucgaggagggccgcacccugcgggugcucaagaugguggagcccuggcugcgcgggaaccaguucugcaucaagauccugaaccccuacaugcccagcgucguggagacccucgagcagaugcagcggaagcacggcggcaugcuggugcgcaacccgcugcagcggaacuccacccacgagauguacugggucagcugcgggaccggcaacaucguguccgccgugaacaugacgagccgcaugcuccugaaccgcuucaccauggcgcaccggaagcccaccuacgagcgcgacgucgaccugggggccggcacccggcacguggccguggagcccgaggucgccaaccucgacaucaucggccagcgcaucgagaacaucaagcacgagcacaaguccacguggcacuacgacgaggacaaccccuacaagaccugggccuaccacgggagcuacgaggugaagccguccggcagcgcguccagcauggugaacggggucgugaagcugcugaccaagcccugggacgucauccccauggugacccagaucgccaugacggacaccacccccuucggccagcagcggguguucaaggagaaggucgacacccgcacgccgaaggccaagcgggggaccgcccagaucauggaggugaccgccaaguggcucuggggcuuccugagccgcaacaagaagccccggaucugcacccgcgaggaguucacgcggaaggugcgcuccaacgcggccaucggcgccgucuucguggacgagaaccaguggaacagcgccaaggaggcgguggaggacgagcgguucugggaccugguccaccgcgagcgggagcuccacaagcaggggaagugcgcgaccugcguguacaacaugaugggcaagcgcgagaagaagcugggggaguucggcaaggccaaggggucccgggccaucugguacauguggcugggcgcccgcuuccucgaguucgaggcgcugggcuucaugaacgaggaccacugguucagccgggagaacucccugagcgggguggagggcgaggggcuccacaagcugggcuacauccugcgcgacaucuccaagauccccgggggcaacauguacgccgacgacaccgccggcugggacacccggaucacggaggacgaccuccagaacgaggcccgcaucaccgacaucauggagccggagcacgcccugcuggccaagagcaucuucaagcucaccuaccagaacaaggucgugcgcgugcagcggcccgccaagaacgggaccgucauggacgugaucucccgccgggaccagcgcggcagcggccagguggggacguacggccugaacaccuucaccaacauggaggcccagcugauccggcagauggaguccgaggggaucuucagccccuccgagcucgagacccccaaccuggccgagcgcguccuggacuggcucgagaaguacggcguggagcggcugaagcgcauggccaucagcggggacgacugcguggucaagccgaucgacgaccgguucgcgacggcccugaccgcccucaacgacaugggcaaggugcgcaaggacaucccccagugggagcccuccaagggguggaacgacuggcagcagguccccuucugcagccaccacuuccaccagcugaucaugaaggacggccgggagaucgucgugccgugccgcaaccaggacgagcuggugggccgggcccgcgucucccagggggccggcuggagccuccgggagaccgcgugccugggcaagagcuacgcccagauguggcagcugauguacuuccaccgccgggaccuccgccuggccgccaacgcgaucugcuccgccgugcccguggacuggauccccaccagccggacgaccugguccauccacgcccaccaccaguggaugaccaccgaggacaugcugagcgucuggaaccgcguguggaucgaggagaaccccuggauggaggacaagacgcacaucuccagcuggggcgacgugccguaccucgggaagcgcgaggaccaguggugcggcucccugaucggccugaccgcccgggccaccugggcgaccaacauccaggucgccaucaaccaggugcgccggcucaucgggaacgagaacuaccuggacuacaugaccagcaugaagcgcuucaagaacgaguccgaccccgagggcgcccugugguga

SEQ ID NO: 8387 - RNA, 9879 nt, Artificial Sequence
  derived and/or modified CDS sequence (opt1) from DENV-1__FJ410218__SS-prME
agcgugaccaugcugcucaugcugaugcccaccgcccuggccuuccaccucaccacccggggcggggagccccacaugaucgugaccaagcaggagcggggcaagagccugcuguucaagaccagcgccggggugaacaugugcacccucaucgccauggaccugggcgagcugugcgaggacaccaugaccuacaagugcccccggaucaccgaggccgagcccgacgacguggacugcuggugcaacgccaccgacaccugggugaccuacgggaccugcagccagacgggcgagcaccggcgcgacaagcggagcguggcccucgcgccccacgugggccuggggcuggagacccgcaccgagaccuggauguccagcgagggcgccuggaagcagauccagcggguggagacgugggcccuccgccaccccggguucaccgugaucgcccuguuccuggcgcacgccaucggcaccuccaucacccagaaggggaucaucuucauccuccugaugcuggugacgcccagcauggccaugcggugcgucggcaucggcucccgcgacuucguggaggggcucagcggcgccaccuggguggacgucgugcuggagcacggguccugcgugaccaccauggccaaggacaagcccacgcuggacaucgagcuccugaagaccgaggucaccaaccccgcggugcugcggaagcucugcaucgaggccaagaucagcaacaccacgaccgacucccgcugccccacccagggcgaggccacccugauggaggagcaggacgccaacuucgugugccggcgcacguucgucgaccggggcugggggaacggcugcgggcuguucggcaaggggagccucaucacgugcgccaaguucaagugcgugaccaagcuggagggcaagaucgugcaguacgagaaccugaaguacuccgucaucgugaccgugcacacgggcgaccagcaccaggucgggaacgagagcaccgagcacggcaccaccgcgaccaucacgccccaggcccccaccuccgagauccagcucaccgacuacggggcccugacccuggacugcagcccccgcacgggccucgacuucaacgagauggugcugcugaccaugaaggagaaguccuggcucguccacaagcagugguuccuggaccugccgcuccccuggaccagcggggccagcaccucccaggagacguggaaccggcaggaccugcuggugaccuucaagaccgcccacgcgaagaagcaggagguggucgugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgugaugugcaccggguccuucaagcucgagaaggaggucgcggagacgcagcacggcaccgugcuggugcagaucaaguacgagggcaccgacgcccccugcaagauccccuucagcacccaggacgagaagggggucacgcagaacggccggcugaucaccgccaacccgaucgugaccgacaaggagaagcccgugaacaucgaggccgagccgcccuucggggaguccuacaucgucaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcguggggaagcugguccaccagaucuucggcaccgccuacgggguccuguucuccggcgugagcuggaccaugaagaucgggaucggcguccugcugacguggcucggccugaacucccgcagcaccucccugagcaugaccugcaucgccguggggcucgugacccuguaccugggcgucauggugcaggccgacuccgggugcgugaucaacuggaagggccgggagcucaagugcgggagcggcaucuucgucacgaacgaggugcacaccuggaccgagcaguacaaguuccaggcggacagcccgaagcgccuguccgccgccaucggcaaggccugggaggagggggugugcggcauccggagcgccacccgccuggagaacaucauguggaagcagaucuccaacgagcucaaccacauccugcuggagaacgacaugaaguucaccgucguggugggggacgucgugggcauccucgcgcaggggaagaagaugauccggccccagcccauggagcacaaguacagcuggaaguccuggggcaaggccaagaucaucggcgccgacgugcagaacacgaccuucaucaucgacgggcccaacaccccggagugccccgacgaccagcgcgccuggaacaucugggaggucgaggacuacggcuucgggaucuucaccacgaacaucuggcugaagcugcgggacagcuacacccaggugugcgaccaccgccucauguccgcggccaucaaggacagcaaggccgugcacgccgacaugggcuacuggaucgaguccgagaagaacgagaccuggaagcuggcccgggcgagcuucaucgaggucaagaccugcaucuggcccaagucccacacgcuguggagcaacggcgugcucgaguccgagaugaucauccccaagaucuacgggggcccgaucagccagcacaacuaccgccccggguacuucacccagaccgccggccccuggcaccuggggaagcuggagcucgacuucgaccugugcgagggcaccacgguggucguggacgagcacugcggcaaccgggggccgucccugcgcaccaccaccgugacgggcaagaucauccacgaguggugcugccggagcugcacccugccgccccuccgcuucaagggggaggacggcugcugguacgggauggagauccggcccgucaaggagaaggaggagaaccuggugaaguccauggugagcgccggcagcggcgaggucgacuccuucagccucgggcugcugugcaucuccaucaugaucgaggaggugaugcgcagccgguggucccgcaagaugcucaugaccggcacccuggccguguuccugcuccugaucauggggcagcugacguggaacgaccucauccggcugugcaucauggucggcgccaacgcgagcgaccgcauggggaugggcaccaccuaccuggcccucauggccaccuucaagaugcgcccgauguucgccgugggccugcuguuccggcgccucacgucccgggaggugcugcugcucaccaucgggcugagccuggucgccuccguggagcuccccaacagccuggaggagcugggcgacgggcucgcgaugggcaucaugauccugaagcugcucaccgacuuccagucccaccagcugugggccacccugcucagccugacguucaucaagaccacccugucccuccacuacgccuggaagaccauggccaugguccugagcaucgugucccuguucccccucugccugagcacgaccucccagaagaccaccuggcugcccgugcuccugggcagccuggggugcaagccgcucacgauguuccugaucgucgagaacaagaucuggggccgcaaguccuggccccugaacgaggggaucauggcggugggcguggucagcauccuccugagcucccugcucaagaacgacgugccccuggccgggccccugaucgccggcggcaugcucaucgccugcuacgugaucagcggguccagcgccgaccugucccuggagaaggcggccgaggucagcugggaggaggaggccgagcacuccggcgccagccacaacauccucguggaggugcaggacgacgggaccaugaagaucaaggacgaggagcgggacgacacccugaccauccugcucaaggccacccugcuggcggucuccggcguguacccgcucagcauccccgccacgcuguucgugugguacuucuggcagaagaagaagcagcgcuccgggguccugugggacacccccagcccgcccgagguggagcgggccgugcuggacgacggcaucuaccgcaucaugcagcggggccuccuggggcgcucccaggucggcguggggguguuccaggagaacgucuuccacaccauguggcacgugacccggggcgccgugcugauguaccaggggaagcgccucgagcccagcugggccuccgucaagaaggaccugaucagcuacggcggcggguggcggcugcagggcuccuggaacacgggggaggagguccaggugaucgcggucgagcccggcaagaaccccaagaacgugcagaccgcccccgggaccuucaagacccccgagggcgaggugggcgccaucgcccucgacuucaagcccgggacgagcggcucccccaucgucaaccgcgaggggaagaucgugggccuguacggcaacgggguggucaccaccagcggcaccuacgugagcgccaucgcgcaggccaaggccucccaggaggggccgcugcccgagaucgaggacgagguguuccggaagcgcaaccucacgaucauggaccugcaccccggcagcgggaagacccggcgcuaccugccggccaucguccgggaggcgaucaagcgcaagcuccggacccugauccuggcccccacccgcgugguggccuccgagauggccgaggcccucaagggcaugcccauccgcuaccagacgaccgcggucaagagcgagcacaccggcaaggagaucguggaccugaugugccacgccaccuucacgaugcggcugcucucccccgugcgcgucccgaacuacaacaugaucaucauggacgaggcccacuucaccgaccccagcuccaucgccgcccggggguacaucagcacccgcgugggcaugggggaggcggccgccaucuucaugaccgccacgccgcccggcuccguggaggccuucccgcagagcaacgcggucauccaggacgaggagcgggacauccccgagcgcuccuggaacagcggguacgaguggaucaccgacuuccccggcaagaccgugugguucgugcccuccaucaagagcggcaacgacaucgccaacugccugcggaagaacgggaagcgcgucauccagcugucccggaagaccuucgacacggaguaccagaagaccaagaacaacgacugggacuacguggugaccaccgacaucagcgagaugggcgccaacuuccgcgccgaccgggucaucgacccgcgccggugccucaagcccgugauccugaaggacgggcccgagcgcgucauccuggcgggccccaugccggugacgguggccuccgccgcccagcggcgcgggcggaucggccgcaaccacaacaaggagggcgaccaguacaucuacauggggcagccccucaacaacgacgaggaccacgcccacuggaccgaggcgaagaugcugcuggacaacaucaacacccccgagggcaucauccccgcccucuucgagccggagcgggagaaguccgccgccaucgacggggaguaccgccugcgcggcgaggcccggaagaccuucgucgagcugaugcgccgcggggaccuccccguguggcuguccuacaagguggcgagcgagggcuuccaguacagcgaccgccgguggugcuucgacggcgagcgcaacaaccagguccuggaggagaacauggacguggagaucuggacgaaggagggggagcggaagaagcuccgcccccgguggcuggacgcccgcaccuacuccgacccccuggcccuccgggaguucaaggaguucgccgccggccgccggagcguguccggggaccugauccuggagaucggcaagcucccgcagcaccugacccagcgcgcgcagaacgcccuggacaaccucgucaugcugcacaacagcgagcagggcgggcgggccuaccgccacgccauggaggagcugcccgacaccaucgagacgcucaugcugcuggcgcucaucgccgugcugaccggcggggugacccuguucuuccucuccggccgggggcugggcaagaccagcaucggccugcucugcgucauggccuccagcgugcugcuguggauggccuccguggagccccacuggaucgccgcgagcaucauccucgaguucuuccugaugguccugcucauccccgagccggaccgccagcggacgccccaggacaaccagcuggccuacguggugaucgggcuccucuucaugauccugacggucgccgccaacgagaugggccugcucgagaccaccaagaaggaccuggggaucggccacguggccguggagaaccaccaccacgcgaccaugcuggacgucgaccuccaccccgccuccgccuggacgcuguacgccguggccaccaccaucaucaccccgaugaugcgccacacgaucgagaacaccaccgcgaacaucagccugaccgccaucgccaaccaggccgccauccucauggggcuggacaagggcuggcccaucuccaagauggacaucggcgugccccugcucgcgcuggggugcuacagccaggucaacccccugacgcucaccgccgccgugcugaugcugguggcccacuacgcgaucaucggcccggggcuccaggccaaggccacccgggaggcccagaagcgcaccgccgcgggcaucaugaagaaccccacggucgacgggaucguggccaucgaccuggaccccguggucuacgacgccaaguucgagaagcagcugggccagaucaugcuccugauccugugcaccucccagauccuccugaugcgcaccaccugggcccugugcgagagcaucacgcucgccaccggcccccugaccacccugugggagggguccccgggcaaguucuggaacacgaccaucgcggugagcauggccaacaucuuccggggguccuaccucgccggcgccggccuggccuucagccugaugaagucccucgggggcgggcgccggggcaccggggcgcagggcgagacccugggcgagaaguggaagcgccagcugaaccagcucuccaagagcgaguucaacaucuacaagcgguccgggaucauggagguggaccgcagcgaggccaaggagggccugaagcgcggggagacgacccgccacgccgucucccggggcaccgccaagcugcgcugguucguggagcggaaccuggugaagcccgaggggaaggucaucgaccucggcugcggccgcgggggcuggagcuacuacugcgcggggcugaagaaggugaccgaggugaagggcuacacgaagggcgggcccggccacgaggagcccaucccgauggccaccuacggguggaaccuggucaagcuccacuccggcaaggacguguucuucacgccgcccgagaagugcgacacccugcugugcgacaucggggagagcucccccaacccgacgaucgaggagggccggacccuccgcgugcugaagauggucgagcccuggcugcgggggaaccaguucugcaucaagauccucaaccccuacaugcccagcgugguggagacccuggagcagaugcagcgcaagcacggcggcaugcugguccggaacccgcucucccgcaacagcacccacgagauguacuggguguccugcgggaccggcaacaucgugagcgccgucaacaugacgucccggaugcugcugaaccgcuucaccauggcccaccgcaagcccaccuacgagcgggacguggaccucggggccggcacccgccacguggcggucgagcccgagguggccaaccuggacaucaucggccagcggaucgagaacaucaagcacgagcacaagagcacguggcacuacgacgaggacaaccccuacaagaccugggccuaccacggguccuacgaggucaagccgagcggcuccgccagcagcauggugaacgggguggucaagcugcucaccaagcccugggacgugauccccauggugacccagaucgccaugacggacaccacccccuucggccagcagcgcgucuucaaggagaagguggacacccggacgccgaaggcgaagcgcgggaccgcccagaucauggaggugaccgcccgguggcuguggggcuuccugucccgcaacaagaagccccggaucugcacccgcgaggaguucacgcggaagguccgcagcaacgccgccaucggcgcgguguucguggacgagaaccaguggaacuccgccaaggaggccgucgaggacgagcgguucugggaccucgugcagaaggagcgcgagcugcacaagcaggggaagugcgcgaccugcguguacaacaugaugggcaagcgggagaagaagcugggggaguucggcaaggcgaaggggagccgcgccaucugguacauguggcucggcgcccgguuccuggaguucgaggcccugggcuucaugaacgaggaccacugguucucccgcgagaacagccucuccggggucgagggcgaggggcugcacaagcugggcuacauccuccgggacaucagcaagauccccgggggcaacauguacgccgacgacaccgcgggcugggacacccgcaucacggaggacgaccugcagaacgaggccaagaucaccgacaucauggagccggagcacgcccugcucgccaccuccaucuucaagcugaccuaccagaacaagguggugcggguccagcgccccgccaagaacgggacggugauggacgugaucagccgccgggaccagcgcggcuccgggcaggucggcaccuacggccugaacaccuucaccaacauggaggcgcagcucauccggcagauggagagcgaggggaucuucucccccagcgagcuggagauccccaaccuggccgagcgcgugcucgacuggcuggagaaguacggcguggagcggcugaagcgcauggccaucuccggggacgacugcgucgugaagccgaucgacgaccgguucgccacggcccucaccgcgcugaacgacaugggcaaggugcgcaaggacgucccccagugggagcccagcaagggguggaacgacuggcagcagguccccuucugcucccaccacuuccaccagcugaucaugaaggacggccgggagaucguggucccgugccgcaaccaggacgagcucgugggccgggcccgcgugagccagggggccggcuggagccugcgggagaccgccugccuggggaaguccuacgcccagauguggcagcucauguacuuccaccgccgggaccugcgccuggcggccaacgccaucugcagcgccguccccguggacugggugcccaccucccggacgaccuggagcauccacgcgcaccaccaguggaugaccaccgaggacaugcucuccgucuggaaccgcguguggaucgaggagaaccccuggauggaggacaagacgcacgugagcuccuggggcgacgucccguaccuggggaagcgggaggaccaguggugcggcagccugaucggccucaccgcccgcgccaccugggccuccaacauccagguggccaucaaccaggugcgccggcugaucgggaacgagaacuaccuggacuacaugaccagcaugaagcgcuucaagaacgagggcgaccccgagggggcgcucugguga

SEQ ID NO: 8388 - RNA, 9879 nt, Artificial Sequence
  derived and/or modified CDS sequence (opt1) from DENV-1__FJ461316__SS-prME
agcgugaccaugcugcucaugcugaugcccaccgcccuggccuuccaccucaccacccggggcggggagccccacaugguggugagcaagcaggagcggggcaagagccugcuguucaagaccagcgcgggggugaacaugugcacccucaucgccauggaccugggcgagcugugcgaggacaccaugaccuacaagugcccccggaucaccgaggccgagcccgacgacguggacugcuggugcaacgccaccgacacgugggugaccuacgggaccugcagccagaccggcgagcaccggcgcgacaagcgguccguggcccucgcgccccacgugggccuggggcuggagacgcgcaccgagaccuggaugagcuccgagggcgccuggaagcagauccagcggguggagaccugggcccuccgccaccccggguucacggugaucgcccuguuccuggcgcacgccaucggcaccagcaucacccagaaggggaucaucuucauccuccugaugcuggucacccccuccauggccaugcggugcgugggcaucggcagccgcgacuucguggaggggcucuccggcgccacgugggucgacguggugcuggagcacgggagcugcgucaccaccauggccaaggacaagcccacccuggacaucgagcuccugaagacggaggugaccaaccccgcgauccugcggaagcucugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacaccggcgaccagcaccagguggggaacgaguccacggagcacggcaccaccgcgaccaucacgccccaggcccccacgaccgagauccagcucaccgacuacggggcccugacccuggacugcagcccccgcacgggccucgacuucaacgagaugguccugcugaccaugaaggagaaguccuggcucgugcacaagcagugguuccuggaccugccccuccccuggaccagcggggccagcaccucccaggagacguggaaccggcaggaccugcuggugaccuucaagaccgcccacgcgaagaagcaggaggucguggugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgucaugugcaccggguccuucaagcucgagaaggagguggcggagacgcagcacggcaccgugcugguccagaucaaguacgagggcaccgacgcccccugcaagauccccuucagcacccaggacgagaagggggugacgcagaacggccggcugaucaccgccaacccgaucgugaccgacaaggagaagcccgucaacaucgaggccgagccgcccuucggggaguccuacaucgugaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcgucgggaagcuggugcaccagaucuucggcaccgccuacgggguccuguucuccggcgucagcuggaccaugaagaucgggcugggcgugcugcucacguggcugggccugaacucccgcagcaccucccucagcaugaccugcaucgccguggggcuggucacccuguaccucggcgugauggugcaggccgacuccgggugcgucaucaacuggaagggccgggagcugaagugcgggagcggcaucuucgugacgaacgaggugcacaccuggaccgagcaguacaaguuccaggcggacagcccgaagcgccuguccgccgccaucggcaaggccugggaggagggggucugcggcauccggagcgccacccgccucgagaacgugauguggaagcagaucuccaacgagcugaaccacauccugcucgagaacgacaugaaguucaccguggucgugggggacguggcgggcauccuggcccaggggaagaagaugauccggccccagcccauggaguacaaguacagcuggaaguccuggggcaaggccaagaucaugggcgccgacguccagaacacgaccuucaucaucgacgggcccaacaccccggagugccccgacgaccagcgcgcguggaacaucugggagguggaggacuacggcuucgggaucuucaccacgaacaucuggcugaagcuccgggacagcuacacccaggugugcgaccaccgccugauguccgccgccaucaaggacagcaaggccguccacgccgacaugggcuacuggaucgaguccgagaagaacgagaccuggaagcuggcgcgggccagcuucaucgaggugaagaccugcaucuggcccaagucccacacgcucuggagcaacggcgugcuggaguccgagaugaucauccccaagaucuacgggggcccgaucagccagcacaacuaccgccccggguacuucacccagaccgccggccccuggcaccuggggaagcucgagcuggacuucgaccugugcgagggcaccacggucgugguggacgagcacugcggcaaccgggggccgucccuccgcaccaccaccgucacgggcaagaucauccacgaguggugcugccggagcugcacccugccgccccugcgcuuccgcggggaggacggcugcugguacgggauggagauccgccccgugaaggagaaggaggagaaccucgugaaguccauggucagcgccggcagcggcgagguggacuccuucagccuggggcugcucugcaucuccaucaugaucgaggaggugaugcggagccgcuggucccggaagaugcugaugaccggcacccuggccgucuuccuccugcugaucauggggcagcucacguggaacgaccugauccgccugugcaucauggugggcgcgaacgccagcgaccgcauggggaugggcaccaccuaccucgcccugauggccaccuucaagaugcggccgauguucgccguggggcuccuguuccgccggcugacgucccgcgagguccugcuccugaccaucgggcugagccucguggcguccgucgagcugcccaacagccuggaggagcucggcgacgggcuggccaugggcaucaugauccugaagcuccugaccgacuuccagucccaccagcugugggccacccuccugagccugacguucaucaagaccaccuucucccuccacuacgccuggaagaccauggcgauggugcugagcaucgugucccuguucccccucugccugagcacgaccucccagaagaccaccuggcugcccguccuccugggcagccuggggugcaagccgcucacgauguuccugaucgccgagaacaagaucuggggccggcgcuccuggccccugaacgaggggaucauggccgugggcaucgugagcauccuccugagcucccugcucaagaacgacgucccccuggccgggccccugaucgccggcggcaugcucaucgcgugcuacgugaucagcggguccagcgccgaccugucccuggagaaggccgccgaggugagcugggaggaggaggccgagcacuccggcgcgagccacaacauccucgucgaggugcaggacgacgggaccaugaagaucaaggacgaggagcgggacgacacccugaccauccugcucaaggccacccugcuggccguguccggcgucuacccgcucagcauccccgccacgcuguucgugugguacuucuggcagaagaagaagcagcgcuccggggugcugugggacacccccagcccgcccgaggucgagcgggccgugcuggacgacggcaucuaccgcaucaugcagcggggccuccuggggcgcucccaggugggcgucgggguguuccaggagaacguguuccacaccauguggcacgucacccggggcgcggugcugauguaccaggggaagcgccucgagcccagcugggccuccgugaagaaggaccugaucagcuacggcggcggguggcggcugcagggcuccuggaacacgggggaggagguccaggugaucgccguggagcccggcaagaaccccaagaacguccagaccgcccccgggaccuucaagacccccgagggcgaggugggcgccaucgcgcucgacuucaagcccgggacgagcggcucccccaucgugaaccgcgaggggaagaucgucggccuguacggcaacgggguggugaccaccagcggcaccuacgucagcgccaucgcccaggccaaggcgucccaggaggggccgcugcccgagaucgaggacgagguguuccggaagcgcaaccucacgaucauggaccugcaccccggcagcgggaagacccggcgcuaccugccggccaucgugcgggaggccaucaagcgcaagcuccgcacccugauccuggcccccacccgggucguggccuccgagauggcggaggcccucaagggcaugcccauccgcuaccagacgaccgccgucaagagcgagcacaccggcaaggagaucgucgaccugaugugccacgccaccuucacgaugcggcugcucucccccgugcgcgugccgaacuacaacaugaucaucauggacgaggcccacuucaccgaccccagcuccaucgcggcccggggguacaucagcacccgcgucggcaugggggaggccgccgccaucuucaugaccgcgacgccgcccggcuccguggaggccuucccgcagagcaacgccgugauccaggacgaggagcgggacauccccgagcgcuccuggaacagcggguacgaguggaucaccgacuuccccggcaagaccgucugguucgugcccuccaucaagagcggcaacgacaucgccaacugccugcggaagaacgggaagcgcgugauccagcugucccggaagaccuucgacacggaguaccagaagaccaagaacaacgacugggacuacgucgugaccaccgacaucagcgagaugggcgcgaacuuccgcgccgaccgggugaucgacccgcgccggugccucaagcccgucauccugaaggacgggcccgagcgcgugauccuggccggccccaugccggucacgguggccuccgccgcgcagcggcgcgggcggaucggccgcaaccacaacaaggagggcgaccaguacaucuacauggggcagccccucaacaacgacgaggaccacgcccacuggaccgaggccaagaugcugcuggacaacaucaacacccccgagggcaucauccccgcccucuucgagccggagcgcgagaaguccgccgcgaucgacggggaguaccggcugcgcggcgaggcccggaagaccuucguggagcugaugcgccgcggggaccuccccgucuggcuguccuacaagguggccagcgagggcuuccaguacagcgaccgccgguggugcuucgacggcgagcgcaacaaccaggugcuggaggagaacauggacgucgagaucuggacgaaggagggggagcggaagaagcuccgcccccgguggcuggacgcccgcaccuacuccgacccccuggcccuccgggaguucaaggaguucgcggccggccgccggagcguguccggggaccugauccuggagaucggcaagcucccgcagcaccugacccagcgcgcccagaacgcccuggacaaccucgugaugcugcacaacagcgagcagggcgggcgggcguaccgccacgccauggaggagcugcccgacaccaucgagacgcucaugcugcuggcccucaucgccguccugaccggcggggugacccuguucuuccucuccggccgggggcugggcaagaccagcaucggccugcucugcgugauggccuccagcguccugcuguggauggcguccguggagccccacuggaucgccgccagcaucauccucgaguucuuccugauggugcugcucauccccgagccggaccgccagcggacgccccaggacaaccagcuggccuacgucgugaucgggcuccucuucaugauccugacgguggccgcgaacgagaugggccugcucgagaccaccaagaaggaccuggggaucggccacgccgccgucgggaaccaccaccacgccgccaugcuggacguggaccuccaccccgcguccgccuggacccuguacgccguggccacgaccaucaucaccccgaugaugcgccacaccaucgagaacacgaccgccaacaucagccugaccgcgaucgccaaccaggccgccauccucaugggccuggacaagggcuggcccaucuccaagauggacaucggggucccccugcucgcgcugggcugcuacagccaggugaacccccugacccucacggccgccgugcugaugcuggucgcccacuacgccaucaucgggccgggccuccaggcgaaggccacccgcgaggcccagaagcggaccgccgccgggaucaugaagaaccccaccguggacggcaucguggcgaucgaccuggaccccgucguguacgacgccaaguucgagaagcagcugggccagaucaugcuccugauccugugcacgucccagauccuccugaugcgcaccaccugggcccugugcgagagcaucacccucgccacggggccccugaccacccugugggagggcuccccggggaaguucuggaacaccacgaucgccgugagcauggcgaacaucuuccggggcuccuaccucgccggcgccgggcuggccuucagccugaugaagucccucggcgggggccgccgggggaccggcgcgcagggcgagacccugggggagaaguggaagcgccagcugaaccagcucuccaagagcgaguucaacaccuacaagcgguccggcaucauggaggucgaccgcagcgaggccaaggaggggcugaagcggggcgagacgaccaagcacgccgugucccgcgggaccgccaagcugcggugguucguggagcgcaaccuggucaagcccgagggcaaggugaucgaccucggcugcgggcggggcggguggagcuacuacugcgccggccugaagaaggugaccgaggucaagggguacacgaagggcggccccgggcacgaggagcccaucccgauggcgaccuacggcuggaaccuggugaagcuccacuccgggaaggacguguucuucaucccgcccgagaagugcgacacccugcugugcgacaucggcgagagcucccccaacccgaccaucgaggaggggcgcacgcuccggguccugaagaugguggagcccuggcugcgcggcaaccaguucugcaucaagauccucaaccccuacaugcccagcguggucgagacccuggagcagaugcagcggaagcacggcgggaugcuggugcgcaacccgcucucccggaacagcacccacgagauguacuggguguccugcggcaccgggaacaucgucagcgccgugaacaugaccucccgcaugcugcugaaccgcuucacgauggcccaccggaagcccaccuacgagcgcgacguggaccucggcgccggcacccggcacgucgccguggagcccgagguggcgaaccuggacaucaucgggcagcgcaucgagaacaucaagcacgagcacaagagcaccuggcacuacgacgaggacaaccccuacaagacgugggccuaccacggcuccuacgaggucaagccgagcggguccgccagcagcauggugaacggcgucgugaagcugcucaccaagcccugggacgugauccccauggucacccagaucgccaugaccgacacgacccccuucgggcagcagcggguguucaaggagaagguggacacccgcaccccgaaggccaagcggggcacggcgcagaucauggaggucaccgccaaguggcuguggggcuuccugucccgcaacaagaagccccggaucugcacccgcgaggaguucacccggaaggugcgcagcaacgccgccaucggggcgguguucgucgacgagaaccaguggaacuccgccaaggaggccguggaggacgagcgguucugggaccucgugcaccgcgagcgggagcugcacaagcagggcaagugcgccacgugcgucuacaacaugauggggaagcgcgagaagaagcugggcgaguucgggaaggccaagggcagccgggcgaucugguacauguggcucggcgcccgcuuccuggaguucgaggcccugggguucaugaacgaggaccacugguucucccgggagaacagccucuccggcguggagggggagggccugcacaagcugggguacauccuccgcgacaucagcaagauccccggcggcaacauguacgccgacgacaccgccgggugggacacccggaucaccgaggacgaccugcagaacgaggcgcgcaucacggacaucauggagccggagcacgcccugcucgccaaguccaucuucaagcugaccuaccagaacaaggugguccgcgugcagcggcccgccaagaacggcaccgugauggacgucaucagccgccgggaccagcgcggguccggccaggugggcaccuacgggcugaacacguucaccaacauggaggcccagcucauccggcagauggagagcgagggcaucuucucccccagcgagcuggagacccccaaccuggcggagcgcgugcucgacuggcuggagaaguacggggucgagcggcugaagcgcauggccaucuccggcgacgacugcguggugaagccgaucgacgaccgguucgccaccgcccucacggcccugaacgacauggggaagguccgcaaggacaucccccagugggagcccagcaagggcuggaacgacuggcagcagguccccuucugcucccaccacuuccaccagcugaucaugaaggacggccgggagaucguggucccgugccgcaaccaggacgagcucguggggcgggcgcgcgugagccagggcgccggguggagccugcgggagaccgccugccugggcaaguccuacgcccagauguggcagcucauguacuuccaccgccgggaccugcgccuggcggccaacgccaucugcagcgccguccccguggacuggauccccaccucccggaccacguggagcauccacgcccaccaccaguggaugaccaccgaggacaugcucuccguguggaaccgcgucuggaucgaggagaaccccuggauggaggacaagacccacaucagcuccuggggcgacgugccguaccugggcaagcgcgaggaccaguggugcggcagccugaucgggcucacggcgcgggccaccugggccaccaacauccagguggccaucaaccagguccgccggcugaucggcaacgagaacuaccuggacuacaugaccuccaugaagcgcuucaagaacgagagcgaccccgagggggcccucugguga

SEQ ID NO: 8389 - RNA, 9879 nt, Artificial Sequence
  derived and/or modified CDS sequence (opt1) from DENV-1__FJ410220__SS-prME
agcgugaccaugcugcugaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgaggccgagcccgacgacguggacugcuggugcaacgccaccgacaccugggugaccuacgggaccugcagccagaccggcgagcaccggcgcgagaagcgguccguggcccucgcgccccacgugggccuggggcuggagacgcggaccgagaccuggaugagcuccgagggcgccuggaagcagauccagcgggucgagaccugggcccuccgccaccccggguucacggugaucgcccuguuccuggcgcacgccaucggcaccagcaucacccagaaggggaucguguucauccuccugaugcuggucacccccuccauggccaugcggugcgugggcaucggcagccgcgacuucguggaggggcucuccggcgccacgugggucgacguggugcuggagcacgggagcugcgucaccaccauggccaaggacaagcccacccuggacaucgagcuccugaagacggaggugaccaaccccgcggugcugcggaagcucugcaucgaggccaagaucuccaacaccaccacggacagccgcugcccgacccagggcgaggccacccuggucgaggagcaggacgccaacuucgugugccggcgcaccuucguggaccggggcugggggaacggcugcgggcuguucggcaaggggucccuccugacgugcgccaaguucaagugcgucaccaagcuggagggcaagaucgugcaguacgagaaccucaaguacagcgugaucgucaccgugcacaccggcgaccagcaccaggucgggaacgaguccacggagcacggcaccaccgcgaccaucacgccccaggcccccacgaccgagauccagcugaccgacuacggggcccugacccucgacugcagcccccgcacgggccuggacuucaacgagauggugcugcucaccaugaaggagaaguccuggcuggugcacaagcagugguuccuggaccucccccugcccuggaccagcggggccagcaccucccaggagacguggaaccggcaggaccugcucgucaccuucaagaccgcccacgcgaagaagcaggagguggugguccugggcagccaggagggcgccaugcacaccgcccugacgggggccaccgagauccagaccuccggcaccacgaccaucuucgccgggcaccucaagugccgccugaagauggacaagcugacccucaagggcaugagcuacgugaugugcaccggguccuucaagcuggagaaggagguggcggagacgcagcacggcaccguccuggugcagaucaaguacgagggcaccgacgcccccugcaagauccccuucagcacccaggacgagaagggggugacgcagaacggccggcugaucaccgccaacccgaucgucaccgacaaggagaagcccgugaacaucgaggccgagccgcccuucggggaguccuacaucgugaucggcgcgggcgagaaggcccucaagcugagcugguucaagaagggguccagcaucggcaagauguucgaggccaccgcccgcggggcccggcgcauggcgauccugggcgacacggccugggacuucggguccaucggcggcgucuucaccagcguggggaagcucgugcaccagaucuucggcaccgccuacgggguccuguucuccggcgugagcuggaccaugaagaucgggaucggcgugcugcucacguggcugggccugaacucccgcagcaccucccucagcaugaccugcaucgccgucgggcuggugacccuguaccucggcgugaugguccaggccgacuccgggugcgugaucaacuggaagggccgggagcugaagugcgggagcggcaucuucgugacgaacgagguccacaccuggaccgagcaguacaaguuccaggcggacagcccgaagcgccuguccgccgccaucggcaaggccugggaggagggggugugcggcauccggagcgccacccgccucgagaacaucauguggaagcagaucuccaacgagcugaaccacauccugcucgagaacgacaugaaguucaccguggucgugggggacguggcgggcauccugguccaggggaagaagaugauccggccccagcccauggaguacaaguacagcuggaaguccuggggcaaggccaagaucaucggcgccgacgugcagaacagcacguucaucaucgacgggcccaacaccccggagugccccgacgaccagcgcgccuggaacaucugggagguggaggacuacggcuucgggaucuucaccaccaacaucuggcugaagcuccgggacuccuacacgcaggucugcgaccaccgccugaugagcgcggccaucaaggacuccaaggccgugcacgccgacaugggcuacuggaucgagagcgagaagaacgagaccuggaagcuggcccgggcguccuucaucgaggugaagaccugcaucuggcccaagagccacacccucugguccaacggcguccuggagagcgagaugaucauccccaagauccacgggggcccgaucucccagcacaacuaccgccccggguacuucacgcagaccgccggccccuggcaccuggggaagcucgagcuggacuucgaccugugcgagggcaccaccgugguggucgacgagcacugcggcaaccgggggccgagccuccgcacgaccaccgugaccggcaagaucauccacgaguggugcugccgguccugcacgcugccgccccugcgcuuccgcggggaggacggcugcugguacgggauggagauccgccccgugaaggagaaggaggagaaccucgucaagagcauggugagcgccggcuccggcgagguggacagcuucucccuggggcugcucugcaucagcaucaugaucgaggaggucaugcggucccgcuggagccggaagaugcugaugaccggcacccuggccguguucuuccuccugaucauggggcagcugaccuggaacgaccucauccgccugugcaucauggugggcgccaacgcguccgaccgcauggggaugggcacgaccuaccuggcccucauggccaccuucaagaugcggccgauguucgccgucggccugcuguuccgccggcucaccagccgcgaggugcugcugcucacgaucgggcugucccuggucgccagcguggagcuccccaacucccuggaggagcugggcgacgggcucgcgaugggcaucaugauccugaagcugcucaccgacuuccagagcuaccagcugugggccacccugcucucccugaccuucaucaagacgaccuucagccugcacuacgccuggaagaccauggccauggugcucuccaucgucagccuguucccccugugccucuccaccacgagccagaagaccaccuggcugcccgugcugcucggcucccuggggugcaagccgcugaccauguuccucaucgcggagaacaagaucuggggccggaaguccuggccccugaacgaggggaucauggccgugggcaucgucagcauccugcucuccagccugcugaagaacgacgugccccucgccgggccccugaucgccggcggcaugcugaucgccugcuacgugaucuccgggagcuccgcggaccucagccuggagaaggccgccgaggucuccugggaggaggaggccgagcacagcggcgccucccacaacauccugguggaggugcaggacgacgggacgaugaagaucaaggacgaggagcgcgacgacacccucaccauccugcugaaggcgacccuccuggccgucagcggcguguacccgcuguccauccccgccacccucuucguguggcacuucuggcagaagaagaagcagcggagcgggguccugugggacacgcccagcccgcccgagguggagcgcgccgugcuggacgacggcaucuaccggaucaugcagcgcggccugcucgggcggagccaggucggcguggggguguuccaggagaacgucuuccacaccauguggcacgugacccgcggcgccgugcugauguaccaggggaagcggcuggagcccuccugggcgagcgucaagaaggaccucaucuccuacggcggcggguggcgcuuccagggcagcuggaacaccggggaggagguccaggugaucgccgucgagcccggcaagaaccccaagaacgugcagacggcccccgggaccuucaagacccccgagggcgaggugggcgccaucgcccuggacuucaagcccgggaccuccggcagccccaucgucaaccgggaggggaagaucgugggccuguacggcaacgggguggucacgaccagcggcaccuacguguccgcgaucgcccaggccaaggccagccaggaggggccgcuccccgagaucgaggacgagguguuccgcaagcggaaccugaccaucauggaccugcaccccggcuccgggaagacgcgccgguaccucccggcgaucguccgcgaggccaucaagcggaagcugcgcacccugauccucgcccccacccgcgugguggccagcgagauggccgaggcgcugaagggcaugcccauccgguaccagaccacggccgucaaguccgagcacaccggcaaggagaucguggaccugaugugccacgccaccuucaccaugcgccuccugagccccgugcgggucccgaacuacaacaugaucaucauggacgaggcccacuucacggaccccuccagcaucgccgcgcgcggguacaucuccacccgggugggcaugggggaggccgccgccaucuucaugaccgccacgccgcccggcagcauggaggcguucccgcaguccaacgccgugauccaggacgaggagcgcgacauccccgagcggagcuggaacuccggguacgaguggaucacggacuuccccggcaagaccgucugguucgugcccagcaucaaggccggcaacgacaucgccaacugccugcgcaagaacgggaagcgggugauccagcucucccgcaagaccuucgacaccgaguaccagaagacgaagaacaacgacugggacuacgucgugaccaccgacaucagcgagaugggcgcgaacuuccgggccgaccgcgugaucgacccgcggcgcugccugaagcccgucauccugaaggacgggcccgagcgggugauccucgccggccccaugccggucaccguggccuccgccgcgcagcgccgggggcgcaucggccggaaccacaacaaggagggcgaccaguacaucuacauggggcagccccugaacaacgacgaggaccacgcccacuggacggaggccaagaugcugcucgacaacaucaacacccccgagggcaucauccccgcccuguucgagccggagcgcgagaaguccgccgcgaucgacggggaguaccgccugcggggcgaggcccgcaagaccuucguggagcucaugcggcgcggggaccugcccgucuggcuguccuacaagguggccagcgagggcuuccaguacagcgaccggcgcuggugcuucgacggcgagcggaacaaccaggugcucgaggagaacauggacgucgagaucuggaccaaggagggggagcgcaagaagcugcggccccgcuggcuggacgcccggacguacuccgacccccucgcccugcgcgaguucaaggaguucgcggccggccggcgcagcguguccggggaccugauccucgagaucggcaagcugccgcagcaccugacccagcgggcccagaacgcccucgacaaccuggugaugcugcacaacagcgagcagggcgggcgcgcguaccggcacgccauggaggagcuccccgacaccaucgagacccugaugcugcucgcccugaucgccguccugacgggcggggugacccucuucuuccuguccggcaaggggcugggcaagaccagcaucggccuccugugcgugauggccuccagcguccugcucuggauggcguccguggagccccacuggaucgccgccagcaucauccuggaguucuuccugauggugcuccugauccccgagccggaccgccagcggacgccccaggacaaccagcuggccuacgucgugaucgggcuccuguucaugauccugaccguggccgcgaacgagaugggccuccuggagacgaccaagaaggaccuggggaucggccacgucgccguggagaaccaccaccacgccgccaugcucgacguggaccugcaccccgccuccgcguggacccuguacgccgucgccaccacgaucaucaccccgaugaugcgccacaccaucgagaacaccacggccaacaucagccucaccgccaucgcgaaccaggccgccauccugauggggcuggacaagggcuggcccaucuccaagauggacaucggcgugccccuccuggcccuggggugcuacagccaggugaacccccucacccugaccgcggccguccugaugcucguggcccacuacgccaucaucggcccggggcugcaggccaaggcgacgcgggaggcccagaagcgcaccgccgccggcaucaugaagaaccccaccaucgacgggaucguggccaucgaccuggaccccgucguguacgacgcgaaguucgagaagcagcucggccagaucaugcugcugauccucugcaccucccagauccugcugaugcgcacgaccugggcccucugcgagagcaucacccuggccaccggcccccugacgacccucugggagggguccccgggcaaguucuggaacaccaccaucgccgugagcauggccaacaucuuccggggguccuaccuggcgggcgccggccuggccuucagccucaugaagucccucgggggcgggcgccgggggacgggggcccagggcgagacccugggcgagaaguggaagcgccagcucaaccagcuguccaagagcgaguucaacaccuacaagcgguccgggaucauggaggucgaccgcagcgaggcgaaggagggccugaagcgcggggagaccacgaagcacgccgugucccgcggcaccgccaagcuccggugguucguggagcgcaaccuggucaagcccgaggggaaggugaucgaccugggcugcggccgcgggggcuggagcuacuacugcgccgggcugaagaaggugaccgaggucaagggcuacaccaagggcggccccggccacgaggagcccaucccgauggccacguacggguggaaccucgugaagcugcacuccggcaaggacguguucuucaucccgcccgagaagugcgacacccugcucugcgacaucggggagagcucccccaacccgaccaucgaggagggccgcacccugcggguccugaagaugguggagcccuggcuccgcgggaaccaguucugcaucaagauccugaaccccuacaugcccagcguggucgagacgcuggagcagaugcagcggaagcacggcggcaugcucgugcgcaacccgcugucccggaacagcacccacgagauguacuggguguccugcgggaccggcaacaucgucagcgcggugaacaugaccucccgcaugcugcucaaccgguucaccauggcccaccgcaagcccacguacgagcgcgacguggaccugggggccggcacccggcacgucgccguggagcccgagguggccaaccuggacaucaucggccagcgcaucgagaacaucaagcacgagcacaagagcaccuggcacuacgacgaggacaaccccuacaagaccugggcguaccacggguccuacgaggucaagccgagcggcuccgccagcagcauggugaacggggucgugaagcuccugacgaagcccugggacgugauccccauggucacccagaucgccaugaccgacaccacgcccuucggccagcagcggguguucaaggagaagguggacacccgcaccccgaaggccaagcgggggaccgcccagaucauggaggucacggcgcgcuggcuguggggcuuccucucccggaacaagaagccccgcaucugcacccgggaggaguucacccgcaaggugcggagcaacgccgccaucggcgccguguucgucgacgagaaccaguggaacuccgcgaaggaggccguggaggacgaccgcuucugggaccuggugcaccgggagcgcgagcugcacaagcaggggaagugcgcgaccugcgucuacaacaugaugggcaagcgggagaagaagcucggggaguucggcaaggccaaggggagccgcgccaucugguacauguggcugggcgcgcgguuccuggaguucgaggcccucggcuucaugaacgaggaccacugguucucccgcgagaacagccuguccgggguggagggcgaggggcugcacaagcucggcuacauccugcgggacaucagcaagauccccgggggcaacauguacgccgacgacacggccggcugggacacccgcaucaccgaggacgaccugcagaacgaggccaagaucaccgacaucauggagccggagcacgcgcuccuggccaaguccaucuucaagcugacguaccagaacaaggugguccgggugcagcgccccgccaagaacgggaccgugauggacgucaucagccgccgggaccagcgcggcuccggccagguggggaccuacggccucaacaccuucacgaacauggaggcccagcugauccggcagauggagagcgaggggaucuuccugcccaacgagcucgagacccccaaccuggccggccgcgugcuggacuggcucgagaaguacggggucgagcggcugaagcgcauggcgaucuccggcgacgacugcguggugaagccgaucgacgaccgguucgccaccgcccugaccgcccucaacgacauggggaagguccgcaaggacaucccccagugggagcccagcaagggcuggaacgacuggcagcagguccccuucugcucccaccacuuccaccagcugaucaugaaggacggccgggagaucguggucccgugccgcaaccaggacgagcugguggggcgggcccgcgugagccagggcgcgggguggucccuccgggagacggccugccugggcaagagcuacgcccagauguggcagcugauguacuuccaccgccgggaccuccgccuggccgcgaacgccaucugcagcgccguccccguggacugggugcccaccucccggaccaccuggagcauccacgcccaccaccaguggaugacgaccgaggacaugcuguccgucuggaaccgcguguggaucgaggagaaccccuggauggaggacaagacccggaucagcuccugggaggacgugccguaccucgggaagcgcgaggaccaguggugcggcagccugaucggccugaccgcccgcgcgacgugggccaccaacauccaggucgccaucaaccaggugcggcgccucaucgggaacgagaacuacuccgacuacaugaccagcaugaagcgguucaagaacgaguccgagcccgagggcgcccugugguga

SEQ ID NO: 8390 - RNA, 9879 nt, Artificial Sequence
  derived and/or modified CDS sequence (opt1) from DENV-1__JF937649__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccgcaucaccgagguggagcccgacgacguggacugcuggugcaacaccaccgacaccugggugaccuacgggaccugcagccagacgggcgagcaccggcgcgacaagcggagcguggcccucgcgccccacgucggccuggggcuggagacccgcgccgagaccuggaugagcuccgagggcgcguggaagcagauccagaagguggagaccugggcccuccggcaccccggguucacggugaucgcccuguuccuggcccacgcgaucggcaccagcaucacccagaaggggaucaucuucauccuccugaugcuggucacccccuccauggccaugcgcugcgugggcaucggcagccgggacuucguggaggggcucuccggcgccacgugggucgacguggugcuggagcacgggagcugcgucaccaccauggccaaggacaagcccacccuggacaucgagcuccugaagacggaggugaccaaccccgccgugcugcgcaagcucugcaucgaggcgaagaucuccaacaccaccacggacagccggugcccgacccagggcgaggccacccuggucgaggagcaggacgccaacuucgugugccgccggaccuucguggaccgcggcugggggaacggcugcgggcuguucggcaaggggucccucaucacgugcgccaaguucaagugcgucaccaagcuggagggcaagaucgugcaguacgagaaccugaaguacagcgugaucgucaccgugcacaccggcgaccagcaccaggucgggaacgaguccacggagcacggcaccaccgccaccaucacgccccaggcgcccacgagcgagauccagcucaccgacuacggggcccugacccuggacugcagcccccggaccggccucgacuucaacgagauggugcugcugacgaugaaggagaaguccuggcucgugcacaagcagugguuccuggaccugccccuccccuggaccagcggggccuccaccagccaggagaccuggaaccgccaggaccugcuggucacguucaagaccgcccacgccaagaagcaggagguggugguccucggcucccaggagggcgcgaugcacaccgcccugaccggggccacggagauccagaccagcggcaccaccacgaucuucgccgggcaccugaagugccggcucaagauggacaagcugacccugaagggcauguccuacgugaugugcaccgggagcuucaagcucgagaaggagguggccgagacccagcacggcacgguccuggugcagaucaaguacgagggcaccgacgcgcccugcaagauccccuucuccacccaggacgagaagggggugacccagaacggccgccugaucacggccaacccgaucgucaccgacaaggagaagcccgugaacaucgaggccgagccgcccuucggggagagcuacaucgugaucggcgccggcgagaaggcgcugaagcucuccugguucaagaaggggagcuccaucggcaagauguucgaggccaccgcccgcggggcccgccggauggccauccugggcgacaccgcgugggacuucgggagcaucggcggcgucuucacguccguggggaagcuggugcaccagaucuucggcaccgccuacgggguccucuucagcggcguguccuggaccaugaagaucgggaucggcgugcugcugaccuggcucggccugaacagccgcuccacgagccuguccaugaccugcaucgccgucgggcucgugacccuguaccugggcgugaugguccaggccgacagcgggugcgugaucaacuggaagggccgcgagcucaagugcgggagcggcaucuucgugaccaacgagguccacacguggaccgagcaguacaaguuccaggccgacuccccgaagcggcugagcgcggccaucggcaaggccugggaggagggggugugcggcauccgcuccgccacccggcuggagaacaucauguggcgccagaucagcaacgagcucaaccacauccugcuggagaacgacaugaaguucaccguggucgugggggacguggucggcauccucgcccaggggaagaagaugauccggccccagcccauggagcacaaguacuccuggaaguccuggggcaaggcgaagaucaucggcgccgacgugcagaacaccacguucaucaucgacgggcccaacaccccggagugccccgacgaccagcgcgccuggaacaucugggagguggaggacuacggcuucgggaucuucaccaccaacaucuggcugaagcugcgggacuccuacacgcaggucugcgaccaccgccucaugagcgccgcgaucaaggacuccaaggccgugcacgccgacaugggcuacuggaucgagagcgagaagaacgagaccuggaagcuggcccgggccuccuucaucgaggugaagaccugcaucuggcccaagagccacacccugugguccaacggcguccucgagagcgagaugaucauccccaagaucuacgggggcccgaucucccagcacaacuaccgccccggguacuucacgcagaccgcgggccccuggcaccuggggaagcuggagcucgacuucgaccugugcgagggcaccaccgugguggucgacgagcacugcggcaaccgggggccgagccugcgcacgaccaccgugaccggcaagaucauccacgaguggugcugccgguccugcacgcugccgccccuccgcuucaagggggaggacggcugcugguacgggauggagauccggcccgugaaggagaaggaggagaaccuggucaagagcauggugagcgccggcuccggcgagguggacagcuucucccucgggcugcugugcaucagcaucaugaucgaggaggucaugcgcucccgguggagccgcaagaugcucaugaccggcacccuggccguguucuuccugcucaucauggggcagcugaccuggaacgaccugauccgguccugcaucauggugggcgccaacgccagcgaccgcauggggaugggcacgaccuaccucgcgcugauggccaccuucaagaugcgcccgauguucgccgucgggcugcuguuccggcgccugaccucccgggaggugcugcuccugacgaucgggcugagccucgucgccuccguggagcugcccaacagccuggaggagcucggcgacgggcuggccaugggcaucaugauccugaagcuccugaccgacuuccaguccuaccagcugugggcgacccuccugagccugaccuucaucaagacgaccuucucccuccacuacgccuggaagaccauggccauggugcugagcaucgucucccugcucccccugugccugagcaccacgucccagaagaccaccuggcuccccgugcugcugggcagccucgggugcaagccgcugaccauguuccugaucgccgagaacaagaucuggggccgcaagagcuggccccucaacgaggggaucauggcggugggcaucgucuccauccugcugagcucccuccugaagaacgacgugccccuggccgggccccucaucgccggcggcaugcugaucgccugcuacgugaucagcggguccagcgccgaccugucccucgagaaggcggccgaggucagcugggaggaggaggccgagcacuccggcgccagccacaacauccugguggaggugcaggacgacgggacgaugaagaucaaggacgaggagcgggacgacacccugaccauccuccugaaggccacccugcucgcggucuccggcguguacccgcugagcauccccgccacccuguucgugugguacuucuggcagaagaagaagcagcgcuccgggguccucugggacacgcccagcccgcccgagguggagcgggccgugcuggacgacggcaucuaccgcaucaugcagcggggccugcuggggcgcucccaggucggcguggggguguuccaggagaacgucuuccacaccauguggcacgugacccggggcgccgugcucauguaccaggggaagcgccuggagcccagcugggccuccgucaagaaggaccugaucagcuacggcggcggguggcggcuccagggcuccuggaacaccggggaggagguccaggugaucgcggucgagcccggcaagaaccccaagaacgugcagacggcccccgggaccuucaagacccccgagggcgaggugggcgccaucgcccuggacuucaagcccgggaccagcggcagccccaucgucaaccgcgaggggaagaucgugggccuguacggcaacgggguggucacgaccuccggcaccuacgugagcgccaucgcgcaggccaaggccucccaggaggggccgcuccccgagaucgaggacgagguguuccggaagcgcaaccugaccaucauggaccugcaccccggcagcgggaagacgcggcgcuaccucccggccaucguccgggaggcgaucaagcgcaagcugcggacccugauccucgcccccacccgcgugguggccuccgagauggccgaggcccugaagggcaugcccauccgcuaccagaccacggcggucaagagcgagcacaccggccgggagaucguggaccugaugugccacgccaccuucaccaugcgccuccugucccccgugcgggucccgaacuacaacaugaucaucauggacgaggcccacuucacggaccccagcuccaucgccgcccgcggguacaucagcacccgggugggcaugggggaggcggccgccaucuucaugaccgccacgccgcccggcuccguggaggccuucccgcagagcaacgcggucauccaggacgaggagcgcgacauccccgagcgguccuggaacagcggguacgaguggaucacggacuuccccggcaagaccgugugguucgugcccuccaucaagagcggcaacgacaucgccaacugccugcgcaagaacgggaagcgggucauccagcucucccgcaagaccuucgacaccgaguaccagaagacgaagaacaacgacugggacuacguggugaccaccgacaucagcgagaugggcgccaacuuccgggccgaccgcgucaucgacccgcggcgcugccugaagcccgugauccugaaggacgggcccgagcgggucauccucgcgggccccaugccggugaccguggccuccgccgcccagcgccgggggcgcaucggccggaaccacaacaaggagggcgaccaguacaucuacauggggcagccccugaacaacgacgaggaccacgcccacuggacggaggcgaagaugcugcucgacaacaucaacacccccgagggcaucauccccgcccuguucgagccggagcgcgagaaguccgccgccaucgacggggaguaccgccugcggggcgaggcccgcaagaccuucgucgagcucaugcggcgcggggaccugcccguguggcugagcuacaagguggcguccgagggcuuccaguacagcgaccggcgcuggugcuucgacggcgagcggaacaaccagguccucgaggagaacauggacguggagaucuggaccaaggagggggagcgcaagaagcugcggccccgcuggcuggacgcccggacguacuccgacccccucgcccugcgcgaguucaaggaguucgccgccggccggcgcagcguguccggggaccugauccucgagaucggcaagcugccgcagcaccugacccagcgggcgcagaacgcccucgacaaccuggucaugcugcacaacagcgagcagggcgggcgcgccuaccggcacgccauggaggagcuccccgacaccaucgagacccugaugcugcucgcgcugaucgccgugcugacgggcggggugacccucuucuuccuguccggcaaggggcugggcaagaccagcaucggccuccugugcgucauggccuccagcgcccugcucuggauggccuccguggagccccacuggaucgcggccagcaucauccuggaguucuuccugauggugcuccugauccccgagccggaccgccagcggacgccccaggacaaccagcuggccuacgucgugaucgggcuccuguucaugauccugaccguggccgccaacgagaugggccuccuggagacgaccaagaaggaccuggggaucggccacgucgcgguggagaaccaccaccacgccaccaugcucgacguggaccugcaccccgccuccgccuggacccuguacgccgucgcgacgaccaucaucaccccgaugaugcgccacaccaucgagaacacgaccgccaacaucagccucaccgccaucgccaaccaggccgcgauccugauggggcuggacaagggcuggcccaucuccaagauggacaucggcgugccccuccuggcccuggggugcuacagccaggugaacccccucacccugacggccgccguccugaugcucguggcgcacuacgccaucaucggcccggggcugcaggccaaggccacccgggaggcccagaagcgcaccgcggccggcaucaugaagaaccccaccguggacgggaucgucgccaucgaccuggaccccgugguguacgacgccaaguucgagaagcagcucggccagaucaugcugcugauccucugcacgucccagauccugcugaugcgcaccaccugggcccucugcgagagcaucacccuggcgacgggcccccugaccacccucugggagggguccccgggcaaguucuggaacaccacgaucgccgucagcauggccaacaucuuccgggggagcuaccuggccggcgccggccuggcguucucccucaugaagucccucgggggcgggcgccgggggaccggggcccagggcgagacccugggcgagaaguggaagcgccagcucaaccagcuguccaagagcgaguucaacaccuacaagcgguccgggaucauggagguggaccgcagcgaggccaaggagggccugcggcgcggggagacgaccaagcacgccgugucccggggcaccgcgaagcuccgcugguucgucgagcggaaccuggugaagcccgaggggaaggugaucgaccugggcugcggccgcgggggcuggagcuacuacugcgccgggcugaagaaggucaccgaggugaagggcuacacgaagggcgggcccggccacgaggagcccaucccgauggccaccuacggguggaaccucgugaagcugcacuccggcaaggacgucuucuucaucccgcccgagaagugcgacacccugcucugcgacaucggggagagcucccccaacccgaccaucgaggagggccggacgcugcgcgugcugaagaugguggagcccuggcuccgggggaaccaguucugcaucaagauccugaaccccuacaugcccagcgucguggagacccuggagcagaugcagcgcaagcacggcggcaugcucgugcggaacccgcugucccgcaacagcacccacgagauguacugggucuccugcgggaccggcaacaucgugagcgccgugaacaugaccucccggaugcugcucaaccgcuucacgauggcccaccgcaagcccaccuacgagcgggacgucgaccugggggcgggcacccgccacguggccguggagcccgaggucgccaaccuggacaucaucggccagcggaucgagaacaucaagcacgagcacaagagcaccuggcacuacgacgaggacaaccccuacaagacgugggccuaccacggguccuacgaggugaagccgagcggcagcgccuccagcauggucaacgggguggugaagcuccugaccaagcccugggacgucauccccauggugacccagaucgcgaugaccgacacgacccccuucggccagcagcgcguguucaaggagaaggucgacacccggaccccgaaggccaagcgcgggacggcccagaucauggaggugaccgcccgguggcuguggggcuuccucucccgcaacaagaagccccggaucugcacccgcgaggaguucacccggaaggugcgcagcaacgccgcgaucggcgccgucuucguggacgagaaccaguggaacuccgccaaggaggccguggaggacgagcgguucugggaccugguccaccgcgagcgggagcugcacaagcaggggaagugcgcgacgugcguguacaacaugaugggcaagcgcgagaagaagcucggggaguucggcaaggccaaggggagccgggccaucugguacauguggcugggcgcccgcuuccuggaguucgaggcccucggcuucaugaacgaggaccacugguucucccgggagaacagccuguccgggguggagggcgaggggcugcacaagcucggcuacauccugcgcgacaucagcaagauccccgggggcaacauguacgcggacgacaccgccggcugggacacccggaucaccgaggacgaccugcagaacgaggccaagaucacggacaucauggagccggagcacgcccuccuggccaccuccaucuucaagcugaccuaccagaacaaggucgugcgcgugcagcgccccgcgcggaacgggaccgucauggacgugaucagccgccgggaccagcgcggcuccggccaggugggcacguacggccucaacaccuucaccaacauggaggcccagcugauccggcagauggagagcgaggggaucuucucccccagcgagcuggagacccccaaccucgccgagcgcguccuggacuggcuggagaagcacggcguggagcggcucaagcgcauggccaucuccggggacgacugcguggucaagccgaucgacgaccgguucgccacggcgcugagcgcccugaacgacaugggcaaggugcgcaaggacaucccccagugggagcccagcaagggguggaacgacuggcagcagguccccuucugcucccaccacuuccaccagcucaucaugaaggacggccgggagaucgucgugccgugccgcaaccaggacgagcuggugggccgggcccgcgucagccagggggccggcuggucccugcgggagaccgccugccucggcaagagcuacgcgcagauguggcagcugauguacuuccaccgccgggaccugcgccucgccgccaacgccaucugcuccgcggugcccguggacuggguccccaccagccggaccacgugguccauccacgcccaccaccaguggaugaccaccgaggacaugcugagcguguggaaccgcguguggaucgaggagaaccccuggauggaggacaagacccacaucuccagcuggggcgacgucccguaccuggggaagcgcgaggaccaguggugcggcucccucaucggccugacggcccgggccaccugggccaccaacauccagguggcgaucaaccaggugcgccggcugaucgggaacgagaacuaccucgacuacaugaccagcaugaagcgcuucaagaacgaguccgaccccgagggcgcccugugguga

SEQ ID NO: 8391 - RNA, 9879 nt, Artificial Sequence
  derived and/or modified CDS sequence (opt1) from DENV-1__FJ410222__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgagaccgagcccgacgacguggacugcuggugcaacgccacggacaccugggucaccuacgggaccugcagccagacgggcgagcaccggcgggacaagcgguccguggcccucgcgccccacgugggccuggggcuggagacccgcaccgagaccuggaugagcuccgagggcgccuggaagcagauccagcgggucgagacgugggcccuccggcaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagcuggccgagacccagcacggcaccgugcuggugcagaucaaguacgagggcaccgacgcgcccugcaagauccccuucagcacgcaggacgagaagggggucacccagaacggccggcugaucaccgccaacccgaucgugaccgacaaggagaagcccgugaacaucgaggccgagccgcccuucggggaguccuacaucgucaucggcgccggcgagaaggcgcucaagcugagcugguucaagaagggguccagcaucggcaagauguucgaggccacggcccgcggggcccggcgcauggccauccugggcgacaccgcgugggacuucggguccaucggcggcguguucaccagcguggggaagcucguccaccagaucuucggcaccgccuacggggugcuguucuccggcgugagcuggacgaugaagaucgggaucggcguccugcucaccuggcugggccugaacucccgcagcaccucccucagcaugaccugcaucgccguggggcuggugacgcuguaccucggcgucauggugcaggccgacuccgggugcgugaucaacuggaagggccgggagcugaagugcgggagcggcaucuucgucaccaacgaggugcacaccuggaccgagcaguacaaguuccaggccgacagcccgaagcgccuguccgcggccaucggcaaggccugggaggagggggugugcggcauccggagcgccacccgccucgagaacaucauguggaagcagaucuccaacgagcugaaccacauccugcucgagaacgacaugaaguucacggucguggugggggacgucgccggcauccuggcgcaggggaagaagaugauccggccccagcccauggaguacaaguacagcuggaaguccuggggcaaggccaagaucaucggcgccgacgugcagaacaccaccuucaucaucgacgggcccaacaccccggagugccccgacgaccagcgcgccuggaacaucugggagguggaggacuacggcuucgggaucuucacgaccaacaucuggcugaagcuccgggacagcuacacccaggucugcgaccaccgccugauguccgcggccaucaaggacagcaaggccgugcacgccgacaugggcuacuggaucgaguccgagaagaacgagaccuggaagcuggcccgggcgagcuucaucgaggugaagacgugcaucuggcccaagucccacacccucuggagcaacggcguccuggaguccgagaugaucauccccaagaucuacgggggcccgaucagccagcacaacuaccgccccggguacuucacccagaccgccggccccuggcaccuggggaagcucgagcuggacuucgaccugugcgagggcacgaccgugguggucgacgagcacugcggcaaccgggggccgucccuccgcaccaccacggugaccggcaagaucauccacgaguggugcugccggagcugcacccugccgccccugcgcuuccgcggggaggacggcugcugguacgggauggagauccgccccgugaaggagaaggaggagaaccucgucaaguccauggugagcgccggcagcggcgagguggacuccuucagccuggggcugcucugcaucuccaucaugaucgaggaggucaugcggagccgcuggucccggaagaugcugaugaccggcacgcuggccguguucuuccuccugaucauggggcagcugaccuggaacgaccucauccgccugugcaucauggugggcgccaacgcgagcgaccgcauggggaugggcaccaccuaccuggcccucauggccacguucaagaugcggccgauguucgccgucggccugcuguuccgccggcucaccucccgcgaggugcugcugcucaccaucgggcugagccugguggccuccgucgagcuccccaacagccuggaggagcugggcgacgggcucgcgaugggcaucaugauccugaagcugcucaccgacuuccagucccaccagcugugggccacgcugcucagccugaccuucaucaagaccaccuucucccugcacuacgccuggaagacgauggccauggugcucagcaucgucucccugcugccccucugccugagcaccaccucccagaagaccacguggcugcccgugcuccugggcagccuggggugcaagccgcucaccauguuccugaucgcggagaacaagaucuggggccggcgcuccuggccccugaacgaggggaucauggccgugggcaucgucagcauccuccugagcucccugcucaagaacgacgugccccuggccgggccccugaucgccggcggcaugcucaucgccugcuacgugaucagcggguccagcgcggaccugucccuggagaaggccgccgaggucagcugggaggaggaggccgagcacuccggcgccagccacaacauccucguggaggugcaggacgacgggaccaugaagaucaaggacgaggagcgggacgacacccugaccauccugcucaaggcgacgcugcuggccgucuccggcguguacccgcucagcauccccgccacccuguucgugugguacuucuggcagaagaagaagcagcgcuccgggguccugugggacacccccagcccgcccgagguggagcgggccgugcuggacgacggcaucuaccgcaucaugcagcggggccuccuggggcgcucccaggucggcguggggguguuccaggagaacgucuuccacaccauguggcacgugacgcggggcgccgugcugauguaccaggggaagcgccucgagcccagcugggcguccgucaagaaggaccugaucagcuacggcggcggguggcggcugcagggcuccuggaacaccggggaggagguccaggugaucgccgucgagcccggcaagaaccccaagaacgugcagaccgcccccgggaccuucaagacgcccgagggcgaggugggcgccaucgcccucgacuucaagcccgggaccagcggcucccccaucgucaaccgcgaggggaagaucgugggccuguacggcaacgggguggucaccaccagcggcacguacgugagcgcgaucgcccaggccaaggccucccaggaggggccgcugcccgagaucgaggacgagguguuccggaagcgcaaccucaccaucauggaccugcaccccggcagcgggaagacccggcgcuaccugccggcgaucguccgggaggccaucaagcgcaagcuccgcacccugauccuggcccccacgcgggugguggccuccgagauggccgaggcgcucaagggcaugcccauccgcuaccagaccaccgccgucaagagcgagcacaccggcaaggagaucguggaccugaugugccacgccacguucaccaugcggcugcucucccccgugcgcgucccgaacuacaacaugaucaucauggacgaggcccacuucaccgaccccagcuccaucgccgcgcggggguacaucagcacccgcgugggcaugggggaggccgccgccaucuucaugacggccacgccgcccggcuccguggaggcguucccgcagagcaacgccgucauccaggacgaggagcgggacauccccgagcgcuccuggaacagcggguacgaguggaucaccgacuuccccggcaagaccgugugguucgugcccuccaucaagagcggcaacgacaucgccaacugccugcggaagaacgggaagcgcgucauccagcugucccggaagacguucgacaccgaguaccagaagaccaagaacaacgacugggacuacguggugaccacggacaucagcgagaugggcgccaacuuccgcgcggaccgggucaucgacccgcgccggugccucaagcccgugauccugaaggacgggcccgagcgcgugauccuggccggccccaugccggucaccguggccuccgccgcccagcggcgcgggcggaucggccgcaaccacaacaaggagggcgaccaguacaucuacauggggcagccccucaacaacgacgaggaccacgcgcacuggaccgaggccaagaugcugcuggacaacaucaacacccccgagggcaucauccccgcccucuucgagccggagcgcgagaaguccgccgccaucgacggggaguaccggcugcgcggcgaggcgcggaagacguucgucgagcugaugcgccgcggggaccuccccguguggcuguccuacaagguggccagcgagggcuuccaguacagcgaccgccgguggugcuucgacggcgagcgcaacaaccagguccuggaggagaacauggacguggagaucuggaccaaggagggggagcggaagaagcuccgcccccgguggcuggacgcccgcaccuacuccgacccccuggcccuccgggaguucaaggaguucgccgcgggccgccggagcguguccggggaccugauccuggagaucggcaagcucccgcagcaccugacccagcgcgcccagaacgcccuggacaaccucgucaugcugcacaacagcgagcagggcgggcgggccuaccgccacgcgauggaggagcugcccgacacgaucgagacccucaugcugcuggcccucaucgccgugcugaccggcggggugacccuguucuuccucuccggccgggggcugggcaagaccagcaucggccugcucugcgucauggccuccagcgugcugcuguggauggccuccguggagccccacuggaucgcggccagcaucauccucgaguucuuccugaugguccugcucauccccgagccggaccgccagcggacgccccaggacaaccagcuggccuacguggugaucgggcuccuguucaugauccugaccgucgccgccaacgagaugggccugcucgagaccaccaagaaggaccuggggaucggccacguggcgguggagaaccaccaccacgccgccaugcuggacgucgaccuccaccccgccuccgccuggacgcuguacgcgguggccaccaccaucaucaccccgaugaugcgccacacgaucgagaacaccaccgccaacaucagccugaccgccaucgccaaccaggcggccauccucauggggcuggacaagggcuggcccaucuccaagauggacaucggcgugccccugcucgcccuggggugcuacagccaggucaacccccugacgcucaccgccgcggugcugaugcugguggcccacuacgccaucaucggcccggggcuccaggccaaggccacccgcgaggcgcagaagcggaccgccgccggcaucaugaagaaccccacggucgacgggaucguggccaucgaccuggaccccguggucuacgacgccaaguucgagaagcagcugggccagaucaugcuccugauccugugcaccucccagauccuccugaugcgcaccaccugggcgcugugcgagagcaucacgcucgccaccggcccccugaccacccugugggagggguccccgggcaaguucuggaacacgaccaucgccgugagcauggccaacaucuuccggggguccuaccucgccggcgcgggccuggccuucagccugaugaagucccucgggggcgggcgccggggcaccggggcccagggcgagacccugggcgagaaguggaagcgccagcugaaccagcucuccaagagcgaguucaacacguacaagcgguccgggaucauggagguggaccgcagcgaggccaaggagggccugaagcgcggggagaccaccaagcacgcggucucccgcggcaccgccaagcugcggugguucguggagcgcaaccuggugaagcccgaggggaaggucaucgaccucggcugcggccgcggcggguggagcuacuacugcgccgggcugaagaaggugacggaggugaagggguacaccaagggcggccccggccacgaggagcccaucccgauggccaccuacggguggaaccuggucaagcuccacuccggcaaggacguguucuucaucccgcccgagaagugcgacacccugcugugcgacaucggggagagcucccccaacccgacgaucgaggagggccgcacccuccgggugcugaagauggucgagcccuggcugcgcgggaaccaguucugcaucaagauccucaaccccuacaugcccagcgugguggagacccuggagcagaugcagcggaagcacggcggcaugcugguccgcaacccgcucucccggaacagcacccacgagauguacuggguguccugcgggaccggcaacaucgugagcgccgucaacaugacgucccgcaugcugcugaaccgcuucaccauggcgcaccggaagcccaccuacgagcgcgacguggaccucggggccggcacccggcacguggccgucgagcccgagguggccaaccuggacaucaucggccagcgcaucgagaacaucaagcacgagcacaagagcacguggcacuacgacgaggacaaccccuacaagaccugggccuaccacggguccuacgaggugaagccgagcggcuccgcgagcagcauggucaacgggguggucaagcugcucaccaagcccugggacgugauccccauggugacccagaucgccaugacggacaccacccccuucggccagcagcgggucuucaaggagaagguggacacccgcacgccgaaggccaagcgggggaccgcccagaucauggaggugaccgccaaguggcuguggggcuuccugucccgcaacaagaagccccggaucugcacccgcgaggaguucacgcggaagguccgcagcaacgcggccaucggcgccguguucguggacgagaaccaguggaacuccgccaaggaggcggucgaggacgagcgguucugggaccucgugcaccgcgagcgggagcugcacaagcaggggaagugcgcgaccugcguguacaacaugaugggcaagcgcgagaagaagcugggggaguucggcaaggccaaggggagccgggccaucugguacauguggcucggcgcccgcuuccuggaguucgaggcgcugggcuucaugaacgaggaccacugguucucccgggagaacagccucuccggggucgagggcgaggggcugcacaagcugggcuacauccuccgcgacaucagcaagauccccgggggcaacauguacgccgacgacaccgccggcugggacacccggaucacggaggacgaccugcagaacgaggcccgcaucaccgacaucauggagccggagcacgcccugcucgcgaaguccaucuucaagcugaccuaccagaacaagguggugcgcguccagcggcccgccaagaacgggaccgugauggacgugaucagccgccgggaccagcgcggcuccgggcaggucggcacguacggccugaacaccuucaccaacauggaggcccagcucauccggcagauggagagcgaggggaucuucucccccagcgagcuggagacccccaaccuggccaagcgcgugcucgacuggcuggagaaguacggcguggagcggcugaagcgcauggccaucuccggggacgacugcgucgugaagccgaucgacgaccgguucgcgacggcccucaccgcccugaacgacaugggcaaggugcgcaaggacaucccccagugggagcccagcaagggguggaacgacuggcagcagguccccuucugcucccaccacuuccaccagcugaucaugaaggacggccgggagaucguggugccgugccgcaaccaggacgagcucgucggccgggcccgcgugagccagggggccggcuggagccugcgggagaccgcgugccuggggaaguccuacgcccagauguggcagcucauguacuuccaccgccgggaccugcgccuggccgccaacgcgaucugcagcgccgugcccgucgacuggauccccaccucccggacgaccuggagcauccacgcccaccaccaguggaugaccaccgaggacaugcucuccguguggaaccgcguguggaucgaggagaaccccuggauggaggacaagacgcacaucagcuccuggggcgacgucccguaccuggggaagcgcgaggaccaguggugcggcagccugaucggccucaccgcccgggccaccugggcgaccaacauccagguggccaucaaccaggugcgccggcugaucgggaacgagaacuaccuggacuacaugaccuccaugaagcgcuucaagaacgagagcgaccccgagggcgcccucugguga

SEQ ID NO: 8392 - RNA, 9879 nt, Artificial Sequence
  derived and/or modified CDS sequence (opt1) from DENV-1__FJ461319__SS-prME
agcgugaccaugcugcucaugcugaugcccaccgcccuggccuuccaccucaccacccggggcggggagccccacaugguggugagcaagcaggagcggggcaagagccugcuguucaagaccagcgccggggugaacaugugcacccucaucgccauggaccugggcgagcugugcgaggacaccaugaccuacaagugcccccggaucaccgaggccgagcccgacgacguggacugcuggugcaacgccaccgacacgugggugaccuacgggaccugcagccagaccggcgagcaccggcgcgacaagcgguccguggcccucgcgccccacgugggccuggggcuggagacgcgcaccgagaccuggaugagcuccgagggcgccuggaagcagauccagcggguggagaccugggcccuccgccaccccggguucacggugaucgcccuguuccuggcgcacgccaucggcaccagcaucacccagaaggggaucaucuucauccuccugaugcuggucacccccuccauggccaugcggugcgugggcaucggcagccgcgacuucguggaggggcucuccggcgccacgugggucgacguggugcuggagcacgggagcugcgucaccaccauggccaaggacaagcccacccuggacaucgagcuccugaagacggaggugaccaaccccgcgauccugcggaagcucugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacaccggcgaccagcaccagguggggaacgaguccacggagcacggcaccaccgcgaccaucacgccccaggcccccacgaccgagauccagcucaccgacuacggggcccugacccuggacugcagcccccgcacgggccucgacuucaacgagaugguccugcugaccaugaaggagaaguccuggcucgugcacaagcagugguuccuggaccugccccuccccuggaccagcggggccagcaccucccaggagacguggaaccggcaggaccugcuggugaccuucaagaccgcccacgcgaagaagcaggaggucguggugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgucaugugcaccggguccuucaagcucgagaaggagguggcggagacgcagcacggcaccgugcugguccagaucaaguacgagggcaccgacgcccccugcaagauccccuucagcacccaggacgagaagggggugacgcagaacggccggcugaucaccgccaacccgaucgugaccgacaaggagaagcccgucaacaucgaggccgagccgcccuucggggaguccuacaucgugaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcgucgggaagcuggugcaccagaucuucggcaccgccuacgggguccuguucuccggcgucagcuggaccaugaagaucgggcugggcgugcugcucacguggcugggccugaacucccgcagcaccucccucagcaugaccugcaucgccguggggcuggucacccuguaccucggcgugauggugcaggccgacuccgggugcgucaucaacuggaagggccgggagcugaagugcgggagcggcaucuucgugacgaacgaggugcacaccuggaccgagcaguacaaguuccaggcggacagcccgaagcgccuguccgccgccaucggcaaggccugggaggagggggucugcggcauccggagcgccacccgccucgagaacgugauguggaagcagaucuccaacgagcugaaccacauccugcucgagaacgacaugaaguucaccguggucgugggggacguggcgggcauccuggcccaggggaagaagaugauccggccccagcccauggagcacaaguacagcuggaaguccuggggcaaggccaagaucaucggcgccgacguccagaacacgaccuucaucaucgacgggcccaacaccccggagugccccgacgaccagcgcgcguggaacaucugggagguggaggacuacggcuucgggaucuucaccacgaacaucuggcugaagcuccgggacagcuacacccaggugugcgaccaccgccugauguccgccgccaucaaggacagcaaggccguccacgccgacaugggcuacuggaucgaguccgagaagaacgagaccuggaagcuggcgcgggccagcuucaucgaggugaagaccugcaucuggcccaagucccacacgcucuggagcaacggcgugcuggaguccgagaugaucauccccaagaucuacgggggcccgaucagccagcacaacuaccgccccggguacuucacccagaccgccggccccuggcaccuggggaagcucgagcuggacuucgaccugugcgagggcaccacggucgugguggacgagcacugcggcaaccgggggccgucccuccgcaccaccaccgucacgggcaagaucauccacgaguggugcugccggagcugcacccugccgccccugcgcuuccgcggggaggacggcugcugguacgggauggagauccgccccgugaaggagaaggaggagaaccucgugaaguccauggucagcgccggcagcggcgagguggacuccuucagccuggggcugcucugcaucuccaucaugaucgaggaggugaugcggagccgcuggucccggaagaugcugaugaccggcacccuggccgucuuccuccugcugaucauggggcagcucacguggaacgaccugauccgccugugcaucauggugggcgcgaacgccagcgaccgcauggggaugggcaccaccuaccucgcccugauggccaccuucaagaugcggccgauguucgccguggggcuccuguuccgccggcugacgucccgcgagguccugcuccugaccaucgggcugagccucguggcguccgucgagcugcccaacagccuggaggagcucggcgacgggcuggccaugggcaucaugauccugaagcuccugaccgacuuccagucccaccagcugugggccacccuccugagccugacguucaucaagaccaccuucucccuccacuacgccuggaagaccauggcgauggugcugagcaucgugucccuguucccccucugccugagcacgaccucccagaagaccaccuggcugcccguccuccugggcagccuggggugcaagccgcucacgauguuccugaucgccgagaacaagaucuggggccggcgcuccuggccccugaacgaggggaucauggccgugggcaucgugagcauccuccugagcucccugcucaagaacgacgucccccuggccgggccccugaucgccggcggcaugcucaucgcgugcuacgugaucagcggguccagcgccgaccugucccuggagaaggccgccgaggugagcugggaggaggaggccgagcacuccggcgcgagccacaacauccucgucgaggugcaggacgacgggaccaugaagaucaaggacgaggagcgggacgacacccugaccauccugcucaaggccacccugcuggccguguccggcgucuacccgcucagcauccccgccacgcuguucgugugguacuucuggcagaagaagaagcagcgcuccggggugcugugggacacccccagcccgcccgaggucgagcgggccgugcuggacgacggcaucuaccgcaucaugcagcggggccuccuggggcgcucccaggugggcgucgggguguuccaggagaacguguuccacaccauguggcacgucacccggggcgcggugcugauguaccaggggaagcgccucgagcccagcugggccuccgugaagaaggaccugaucagcuacggcggcggguggcggcugcagggcuccuggaacacgggggaggagguccaggugaucgccguggagcccggcaagaaccccaagaacguccagaccgcccccgggaccuucaagacccccgagggcgaggugggcgccaucgcgcucgacuucaagcccgggacgagcggcucccccaucgugaaccgcgaggggaagaucgucggccuguacggcaacgggguggugaccaccagcggcaccuacgucagcgccaucgcccaggccaaggcgucccaggaggggccgcugcccgagaucgaggacgagguguuccggaagcgcaaccucacgaucauggaccugcaccccggcagcgggaagacccggcgcuaccugccggccaucgugcgggaggccaucaagcgcaagcuccgcacccugauccuggcccccacccgggucguggccuccgagauggcggaggcccucaagggcaugcccauccgcuaccagacgaccgccgucaagagcgagcacaccggcaaggagaucgucgaccugaugugccacgccaccuucacgaugcggcugcucucccccgugcgcgugccgaacuacaacaugaucaucauggacgaggcccacuucaccgaccccagcuccaucgcggcccggggguacaucagcacccgcgucggcaugggggaggccgccgccaucuucaugaccgcgacgccgcccggcuccguggaggccuucccgcagagcaacgccgugauccaggacgaggagcgggacauccccgagcgcuccuggaacagcggguacgaguggaucaccgacuuccccggcaagaccgucugguucgugcccuccaucaagagcggcaacgacaucgccaacugccugcggaagaacgggaagcgcgugauccagcugucccggaagaccuucgacacggaguaccagaagaccaagaacaacgacugggacuacgucgugaccaccgacaucagcgagaugggcgcgaacuuccgcgccgaccgggugaucgacccgcgccggugccucaagcccgucauccugaaggacgggcccgagcgcgugauccuggccggccccaugccggucacgguggccuccgccgcgcagcggcgcgggcggaucggccgcaaccacaacaaggagggcgaccaguacaucuacauggggcagccccucaacaacgacgaggaccacgcccacuggaccgaggccaagaugcugcuggacaacaucaacacccccgagggcaucauccccgcccucuucgagccggagcgcgagaaguccgccgcgaucgacggggaguaccggcugcgcggcgaggcccggaagaccuucguggagcugaugcgccgcggggaccuccccgucuggcuguccuacaagguggccagcgagggcuuccaguacagcgaccgccgguggugcuucgacggcgagcgcaacaaccaggugcuggaggagaacauggacgucgagaucuggacgaaggagggggagcggaagaagcuccgcccccgguggcuggacgcccgcaccuacuccgacccccuggcccuccgggaguucaaggaguucgcggccggccgccggagcguguccggggaccugauccuggagaucggcaagcucccgcagcaccugacccagcgcgcccagaacgcccuggacaaccucgugaugcugcacaacagcgagcagggcgggcgggcguaccgccacgccauggaggagcugcccgacaccaucgagacgcucaugcugcuggcccucaucgccguccugaccggcggggugacccuguucuuccucuccggccgggggcugggcaagaccagcaucggccugcucugcgugauggccuccagcguccugcuguggauggcguccguggagccccacuggaucgccgccagcaucauccucgaguucuuccugauggugcugcucauccccgagccggaccgccagcggacgccccaggacaaccagcuggccuacgucgugaucgggcuccucuucaugauccugacgguggccgcgaacgagaugggccugcucgagaccaccaagaaggaccuggggaucggccacgccgccgucgggaaccaccaccacgccgccaugcuggacguggaccuccaccccgcguccgccuggacccuguacgccguggccacgaccaucaucaccccgaugaugcgccacaccaucgagaacacgaccgccaacaucagccugaccgcgaucgccaaccaggccgccauccucaugggccuggacaagggcuggcccaucuccaagauggacaucggggucccccugcucgcgcugggcugcuacagccaggugaacccccugacccucacggccgccgugcugaugcuggucgcccacuacgccaucaucgggccgggccuccaggcgaaggccacccgcgaggcccagaagcggaccgccgccgggaucaugaagaaccccaccguggacggcaucguggcgaucgaccuggaccccgucguguacgacgccaaguucgagaagcagcugggccagaucaugcuccugauccugugcacgucccagauccuccugaugcgcaccaccugggcccugugcgagagcaucacccucgccgccgggccccugacgacccugugggagggcuccccggggaaguucuggaacaccaccaucgcggugagcauggccaacaucuuccggggcuccuaccucgccggcgccgggcuggcguucagccugaugaagucccucggcgggggccgccgggggacgggcgcccagggcgagacccugggggagaaguggaagcgccagcugaaccagcucuccaagagcgaguucaacaccuacaagcgguccggcaucauggaggucgaccgcagcgaggccaaggaggggcugaagcggggcgagaccacgaagcacgccgugucccgcgggaccgccaagcugcggugguucguggagcgcaaccuggucaagcccgagggcaaggugaucgaccucggcugcgggcggggcggguggagcuacuacugcgcgggccugaagaaggugaccgaggucaagggguacaccaagggcggccccgggcacgaggagcccaucccgauggccacguacggcuggaaccuggugaagcuccacuccgggaaggacguguucuucaucccgcccgagaagugcgacacccugcugugcgacaucggcgagagcucccccaacccgaccaucgaggaggggcgcacccuccggguccugaagaugguggagcccuggcugcgcggcaaccaguucugcaucaagauccucaaccccuacaugcccagcguggucgagacgcuggagcagaugcagcggaagcacggcgggaugcuggugcgcaacccgcucucccggaacagcacccacgagauguacuggguguccugcggcaccgggaacaucgucagcgccgugaacaugaccucccgcaugcugcugaaccgcuucaccauggcccaccggaagcccacguacgagcgcgacguggaccucggcgccggcacccggcacgucgcgguggagcccgagguggccaaccuggacaucaucgggcagcgcaucgagaacaucaagcacgagcacaagagcaccuggcacuacgacgaggacaaccccuacaagaccugggccuaccacggcuccuacgaggucaagccgagcggguccgccagcagcauggugaacggcgucgugaagcugcucacgaagcccugggacgugauccccauggucacccagaucgccaugaccgacaccacgcccuucgggcagcagcggguguucaaggagaagguggacacccgcaccccgaaggcgaagcggggcaccgcccagaucauggaggucacggccaaguggcuguggggcuuccugucccgcaacaagaagccccggaucugcacccgcgaggaguucacccggaaggugcgcagcaacgccgcgaucggggccguguucgucgacgagaaccaguggaacuccgccaaggaggccguggaggacgagcgguucugggaccucgugcaccgcgagcgggagcugcacaagcagggcaagugcgcgaccugcgucuacaacaugauggggaagcgcgagaagaagcugggcgaguucgggaaggcgaagggcagccgggccaucugguacauguggcucggcgcccgcuuccuggaguucgaggcccugggguucaugaacgaggaccacugguucucccgggagaacagccucuccggcguggagggggagggccugcacaagcugggguacauccuccgcgacaucagcaagauccccggcggcaacauguacgccgacgacacggcggggugggacacccggaucaccgaggacgaccugcagaacgaggcccgcaucaccgacaucauggagccggagcacgcccugcucgccaaguccaucuucaagcugacguaccagaacaaggugguccgcgugcagcggcccgccaagaacggcaccgugauggacgucaucagccgccgggaccagcgcggguccggccaggugggcaccuacgggcugaacaccuucacgaacauggaggcgcagcucauccggcagauggagagcgagggcaucuucucccccagcgagcuggagacccccaaccuggccgagcgcgugcucgacuggcuggagaaguacggggucgagcggcugaagcgcauggccaucuccggcgacgacugcguggugaagccgaucgacgaccgguucgccaccgcccucaccgcgcugaacgacauggggaagguccgcaaggacaucccccagugggagcccagcaagggcuggaacgacuggcagcagguccccuucugcucccaccacuuccaccagcugaucaugaaggacggccgggagaucguggucccgugccgcaaccaggacgagcucguggggcgggcccgcgugagccagggcgccggguggagccugcgggagacggccugccugggcaaguccuacgcgcagauguggcagcucauguacuuccaccgccgggaccugcgccuggccgccaacgccaucugcagcgccguccccguggacuggauccccaccucccggaccaccuggagcauccacgcgcaccaccaguggaugacgaccgaggacaugcucuccguguggaaccgcgucuggaucgaggagaaccccuggauggaggacaagacccacaucagcuccuggggcgacgugccguaccugggcaagcgcgaggaccaguggugcggcagccugaucgggcucaccgcccgggccacgugggccaccaacgugcaggucgccaucaaccaggugcgccggcugaucggcaacgagaacuaccuggacuacaugaccuccaugaagcgcuucaagaacgagagcgaccccgagggggcgcucugguga

SEQ ID NO: 8393 - RNA, 9879 nt, Artificial Sequence
  derived and/or modified CDS sequence (opt1) from DENV-1__FJ461320__SS-prME
agcgugaccaugcugcucaugcugaugcccaccgcccuggccuuccaccucaccacccggggcggggagccccacaugaucgugaccaagcaggagcggggcaagagccugcuguucaagaccagcgccggggugaacaugugcacccucaucgccauggaccugggggagcugugcgaggacaccaugaccuacaagugcccccggaucaccgaggccgagcccgacgacguggacugcuggugcaacgccaccgacaccugggugaccuacgggaccugcagccagacgggggagcaccggcgcgacaagcggagcguggcccucgcgccccacgugggccuggggcuggagacccgcaccgagaccuggauguccagcgagggcgccuggaagcagauccagcggguggagacgugggcccuccgccaccccggguucaccgugaucgcccuguuccuggcgcacgccaucggcaccuccaucacccagaaggggaucaucuucauccuccugaugcuggugacgcccagcauggccaugcggugcgucggcaucggcucccgcgacuucguggaggggcucagcggcgccaccuggguggacgucgugcuggagcacggguccugcgugaccaccauggccaaggacaagcccacgcuggacaucgagcuccugaagaccgaggucaccaaccccgcggugcugcggaagcucugcaucgaggccaagaucagcaacaccacgaccgacucccgcugccccacccagggcgaggccacccugauggaggagcaggacgccaacuucgugugccggcgcacguucgucgaccggggcugggggaacggcugcgggcuguucggcaaggggagccucaucacgugcgccaaguucaagugcgugaccaagcuggagggcaagaucgugcaguacgagaaccugaaguacuccgucaucgugaccgugcacacgggcgaccagcaccaggucgggaacgagagcaccgagcacggcaccaccgcgaccaucacgccccaggcccccaccuccgagauccagcucaccgacuacggggcccugacccuggacugcagcccccgcacgggccucgacuucaacgagauggugcugcugaccaugaaggagaaguccuggcucguccacaagcagugguuccuggaccugccgcuccccuggaccagcggggccagcaccucccaggagacguggaaccggcaggaccugcuggugaccuucaagaccgcccacgcgaagaagcaggagguggucgugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgugaugugcaccggguccuucaagcucgagaaggaggucgcggagacgcagcacggcaccgugcuggugcagaucaaguacgagggcaccgacgcccccugcaagauccccuucagcacccaggacgagaagggggucacgcagaacggccggcugaucaccgccaacccgaucgugaccgacaaggagaagcccgugaacaucgaggccgagccgcccuucggggaguccuacaucgucaucggcgcgggcgagaaggcccugaagcucagcugguucaagaagggguccagcaucggcaagauguucgaggccaccgcccgcggggcccggcgcauggcgauccugggcgacacggccugggacuucggguccgugggcggcguguucaccagcgucgggaagcuggugcaccagaucuucggcaccgccuacgggguccuguucuccggcgucagcuggaccaugaagaucgggaucggcgugcugcugacguggcucggccugaacucccgcagcaccucccugagcaugaccugcaucgccguggggcucgucacccuguaccugggcgugauggugcaggccgacuccgggugcgucaucaacuggaagggccgggagcucaagugcgggagcggcaucuucgugacgaacgaggugcacaccuggaccgagcaguacaaguuccaggcggacagcccgaagcgccuguccgccgccaucggcaaggccugggaggagggggucugcggcauccggagcgccacccgccuggagaacaucauguggaagcagaucuccaacgagcucaaccacauccugcuggagaacgacaugaaguucaccgugguggucggggacguggugggcauccucgcgcaggggaagaagaugauccggccccagcccauggagcacaaguacagcuggaaguccuggggcaaggccaagaucaucggcgccgacguccagaacacgaccuucaucaucgacgggcccaacaccccggagugccccgacgaccagcgcgccuggaacaucugggagguggaggacuacggcuucgggaucuucaccacgaacaucuggcugaagcugcgggacagcuacacccaggugugcgaccaccgccucauguccgcggccaucaaggacagcaaggccguccacgccgacaugggcuacuggaucgaguccgagaagaacgagaccuggaagcuggcccgggcgagcuucaucgaggugaagaccugcaucuggcccaagucccacacgcuguggagcaacggcgugcucgaguccgagaugaucauccccaagaucuacgggggcccgaucagccagcacaacuaccgccccggguacuucacccagaccgccggccccuggcaccuggggaagcuggagcucgacuucgaccugugcgagggcaccacggucgugguggacgagcacugcggcaaccgggggccgucccugcgcaccaccaccgucacgggcaagaucauccacgaguggugcugccggagcugcacccugccgccccuccgcuucaagggggaggacggcugcugguacgggauggagauccggcccgugaaggagaaggaggagaaccuggugaaguccauggucagcgccggcagcggcgagguggacuccuucagccucgggcugcugugcaucuccaucaugguggaggaggucaugcgcagccgguggucccgcaagaugcucaugaccggcacccuggccguguuccugcuccugaucauggggcagcugacguggaacgaccucauccggcugugcaucauggugggcgccaacgcgagcgaccgcauggggaugggcaccaccuaccuggcccucauggccaccuucaagauccgcccgauguucgccgucggccugcuguuccggcgccucacgucccgggaggugcugcugcucaccaucgggcugagccuggucgccuccguggagcuccccaacagccuggaggagcugggcgacgggcucgcgaugggcaucaugauccugaagcugcucaccgacuuccagucccaccagcugugggccacccugcucagccugacguucaucaagaccacccugucccuccacuacgccuggaagaccauggccauggugcugagcaucgucucccuguucccccucugccugagcacgaccucccagaagaccaccuggcugcccgugcuccugggcagccuggggugcaagccgcucacgauguuccugaucaccgagaacaagaucuggggccgcaaguccuggccccugaacgaggggaucauggcggugggcgucgugagcauccuccugagcucccugcucaagaacgacgugccccuggccgggccccugaucgccggcggcaugcucaucgccugcuacgucaucagcggguccagcgccgaccugucccuggagaaggcggccgaggugagcugggaggaggaggccgagcacuccggcgccagccacaacauccucguggagguccaggacgacgggaccaugaagaucaaggacgaggagcgggacgacacccugaccauccugcucaaggccacgcugcuggcgguguccggcguguacccgcucagcauccccgccacccuguucgucugguacuucuggcagaagaagaagcagcgcuccggggugcugugggacacccccagcccgcccgagguggagcgggccguccuggacgacggcaucuaccgcaucaugcagcggggccuccuggggcgcucccaggugggcgugggggucuuccaggagaacguguuccacaccauguggcacgugacgcggggcgccguccugauguaccaggggaagcgccucgagcccagcugggccuccgugaagaaggaccugaucagcuacggcggcggguggcggcugcagggcuccuggaacaccggggaggaggugcaggucaucgcgguggagcccggcaagaaccccaagaacgugcagaccgcccccgggaccuucaagacgcccgagggcgaggucggcgccaucgcccucgacuucaagcccgggaccagcggcucccccaucgugaaccgcgaggggaagaucgugggccuguacggcaacggggucgugaccaccagcggcacguacgugagcgccaucgcgcaggccaaggccucccaggaggggccgcugcccgagaucgaggacgaggucuuccggaagcgcaaccucaccaucauggaccugcaccccggcagcgggaagacccggcgcuaccugccggccaucgugcgggaggcgaucaagcgcaagcuccggacccugauccuggcccccacgcgcguggucgccuccgagauggccgaggcccucaagggcaugcccauccgcuaccagaccaccgcggucaagagcgagcacaccggcaaggagaucguggaccugaugugccacgccacguucaccaugcggcugcucucccccguccgcgugccgaacuacaacaugaucaucauggacgaggcccacuucaccgaccccagcuccaucgccgcccggggguacaucagcacccgcgugggcaugggggaggcggccgccaucuucaugacggccacgccgcccggcuccgucgaggccuucccgcagagcaacgcggugauccaggacgaggagcgggacauccccgagcgcuccuggaacagcggguacgaguggaucaccgacuuccccggcaagaccgugugguucguccccuccaucaagagcggcaacgacaucgccaacugccugcggaagaacgggaagcgcgugauccagcugucccggaagacguucgacaccgaguaccagaagaccaagaacaacgacugggacuacguggucaccacggacaucagcgagaugggcgccaacuuccgcgccgaccgggugaucgacccgcgccggugccucaagcccgucauccugaaggacgggcccgagcgcgugauccuggcgggccccaugccggugaccgucgccuccgccgcccagcggcgcgggcggaucggccgcaaccacaacaaggagggcgaccaguacaucuacauggggcagccccucaacaacgacgaggaccacgcccacuggaccgaggcgaagaugcugcuggacaacaucaacacccccgagggcaucauccccgcccucuucgagccggagcgggagaaguccgccgccaucgacggggaguaccgccugcgcggcgaggcccggaagacguucguggagcugaugcgccgcggggaccuccccguguggcuguccuacaaggucgcgagcgagggcuuccaguacagcgaccgccgguggugcuucgacggcgagcgcaacaaccaggugcuggaggagaacauggacguggagaucuggaccaaggagggggagcggaagaagcuccgcccccgguggcuggacgcccgcaccuacuccgacccccuggcccuccgggaguucaaggaguucgccgccggccgccggagcgucuccggggaccugauccuggagaucggcaagcucccgcagcaccugacccagcgcgcgcagaacgcccuggacaaccucgugaugcugcacaacagcgagcagggcgggcgggccuaccgccacgccauggaggagcugcccgacacgaucgagacccucaugcugcuggcgcucaucgccgugcugaccggcggggucacccuguucuuccucuccggccgggggcugggcaagaccagcaucggccugcucugcgugauggccuccagcgugcugcuguggauggccuccgucgagccccacuggaucgccgcgagcaucauccucgaguucuuccugauggugcugcucauccccgagccggaccgccagcggacgccccaggacaaccagcuggccuacguggucaucgggcuccucuucaugauccugaccguggccgccaacgagaugggccugcucgagaccaccaagaaggaccuggggaucggccacguggccgucgagaaccaccaccacgcgacgaugcuggacguggaccuccaccccgccuccgccuggacccuguacgccguggccaccaccaucaucacgccgaugaugcgccacaccaucgagaacaccaccgcgaacaucagccugacggccaucgccaaccaggccgccauccucauggggcuggacaagggcuggcccaucuccaagauggacaucggcgucccccugcucgcgcuggggugcuacagccaggugaacccccugacccucaccgccgccgugcugaugcuggucgcccacuacgcgaucaucggcccggggcuccaggccaaggccacccgggaggcccagaagcgcacggccgcgggcaucaugaagaaccccaccguggacgggaucguggccaucgaccuggaccccgucguguacgacgccaaguucgagaagcagcugggccagaucaugcuccugauccugugcaccucccagauccuccugaugcgcaccacgugggcccugugcgagagcaucacccucgccaccggcccccugaccacgcugugggagggguccccgggcaaguucuggaacaccaccaucgcggugagcauggccaacaucuuccggggguccuaccucgccggcgccggccuggccuucagccugaugaagucccucgggggcgggcgccggggcaccggggcgcagggcgagacgcugggcgagaaguggaagcgccagcugaaccagcucuccaagagcgaguucaacaucuacaagcgguccgggaucauggaggucgaccgcagcgaggccaaggagggccugaagcgcggggagaccacccgccacgccgugucccggggcaccgccaagcugcgcugguucguggagcggaaccuggucaagcccgaggggaaggugaucgaccucggcugcggccgcgggggcuggagcuacuacugcgcggggcugaagaaggugacggaggucaagggcuacaccaagggcgggcccggccacgaggagcccaucccgauggccaccuacggguggaaccuggugaagcuccacuccggcaaggacguguucuucacgccgcccgagaagugcgacacgcugcugugcgacaucggggagagcucccccaacccgaccaucgaggagggccggacccuccgcguccugaagaugguggagcccuggcugcgggggaaccaguucugcaucaagauccucaaccccuacaugcccagcguggucgagacccuggagcagaugcagcgcaagcacggcggcaugcuggugcggaacccgcucucccgcaacagcacccacgagauguacuggguguccugcgggacgggcaacaucgucagcgccgugaacaugaccucccggaugcugcugaaccgcuucaccauggcccaccgcaagcccaccuacgagcgggacguggaccucggggccggcacgcgccacgucgcgguggagcccgaggucgccaaccuggacaucaucggccagcggaucgagaacaucaagcacgagcacaagagcaccuggcacuacgacgaggacaaccccuacaagaccugggccuaccacggguccuacgaggugaagccgagcggcuccgccagcagcauggugaacggggucgugaagcugcucaccaagcccugggacgugauccccauggucacgcagaucgccaugaccgacaccacccccuucggccagcagcgcguguucaaggagaagguggacacgcggaccccgaaggcgaagcgcgggaccgcccagaucauggaggucaccgcccgguggcuguggggcuuccugucccgcaacaagaagccccggaucugcacgcgcgaggaguucacccggaaggugcgcagcaacgccgccaucggcgcgguguucgucgacgagaaccaguggaacuccgccaaggaggccguggaggacgagcgguucugggaccucgugcagaaggagcgcgagcugcacaagcaggggaagugcgcgaccugcgucuacaacaugaugggcaagcgggagaagaagcugggggaguucggcaaggcgaaggggagccgcgccaucugguacauguggcucggcgcccgguuccuggaguucgaggcccugggcuucaugaacgaggaccacugguucucccgcgagaacagccucuccgggguggagggcgaggggcugcacaagcugggcuacauccuccgggacaucagcaagauccccgggggcaacauguacgccgacgacaccgcgggcugggacacgcgcaucaccgaggacgaccugcagaacgaggccaagaucaccgacaucauggagccggagcacgcccugcucgccaccuccaucuucaagcugacguaccagaacaaggugguccgggugcagcgccccgccaagaacgggaccgugauggacgucaucagccgccgggaccagcgcggcuccggccaggugggcaccuacggccugaacaccuucacgaacauggaggcgcagcucauccggcagauggagagcgaggggaucuuccugcccuccgagcuggagacccccaaccucgccgagcgcgugcuggacuggcuggagaaguacggcgucgagcggcucaagcgcauggccaucagcggggacgacugcguggugaagccgaucgacgaccgguucgccaccgcccugaccgcgcugaacgacaugggcaagguccgcaaggacaucccccagugggagcccuccaagggguggaacgacuggcagcagguccccuucugcagccaccacuuccaccagcucaucaugaaggacggccgggagaucguggucccgugccgcaaccaggacgagcuggugggccgggcccgcgugucccagggggccggcuggagccugcgggagacggccugccucggcaagagcuacgcccagauguggcagcugauguacuuccaccgccgggaccugcgccucgcggccaacgccaucugcuccgccguccccguggacugggugcccaccagccggaccaccugguccauccacgcgcaccaccaguggaugacgaccgaggacaugcugagcgucuggaaccgcguguggaucgaggagaaccccuggauggaggacaagacccacguguccagcuggggcgacgucccguaccuggggaagcgggaggaccaguggugcggcucccucaucggccugaccgcccgcgccaccugggccagcaacauccagguggccaucaaccaggugcgccggcugaucgggaacgagaacuaccucgacuacaugacguccaugaagcgcuucaagaacgagggcgaccccgagggggcgcugugguga

SEQ ID NO: 8394 - RNA, 9879 nt, Artificial Sequence
  derived and/or modified CDS sequence (opt1) from DENV-1__FJ410225__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccgcaucaccgagaccgagcccgacgacguggacugcuggugcaacgccacggacaccugggugaccuacgggaccugcagccagacgggcgagcaccggcgcgacaagcgguccguggcccucgcgccccacgugggccuggggcuggagacccgcaccgagaccuggaugagcuccgagggcgcguggaagcagauccagcgggucgagacgugggcccuccgccaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagguggccgagacccagcacggcaccgugcugguccagaucaaguacgagggcaccgacgcgcccugcaagauccccuucagcacgcaggacgagaagggggugacccagaacggccggcugaucaccgccaacccgaucgugaccgacaaggagaagcccgucaacaucgaggccgagccgcccuucggggaguccuacaucgugaucggcgccggcgagaaggcgcugaagcucagcugguucaagaagggguccagcaucggcaagauguucgaggccacggcccgcggggcccggcgcauggccauccugggcgacaccgcgugggacuucggguccaucggcggcguguucaccagcaucgggaagcugguccaccagaucuucggcaccgccuacggggugcuguucuccggcgugagcuggacgaugaagaucgggaucggcguccugcugaccuggcucggccugaacucccgcagcaccucccugagcaugaccugcaucgccguggggcucgugacgcuguaccugggcgucauggugcaggccgacuccgggugcgugaucaacuggaagggccgggagcucaagugcgggagcggcaucuucgucaccaacgaggugcacaccuggaccgagcaguacaaguuccaggccgacagcccgaagcgccuguccgcggccaucggcaaggccugggaggagggggugugcggcauccggagcgccacccgccuggagaacaucauguggaagcagaucuccaacgagcucaaccacauccugcuggagaacgacaugaaguucacggucguggugggggacgucgccggcauccucgcgcaggggaagaagaugauccggccccagcccauggaguacaaguacagcuggaaguccuggggcaaggccaagaucaucggcgccgacgugcagaacaccaccuucaucaucgacgggcccaacaccccggagugccccgacgaccagcgcgccuggaacaucugggagguggaggacuacggcuucgggaucuucacgaccaacaucuggcugaagcugcgggacagcuacacccaggucugcgaccaccgccucauguccgcggccaucaaggacagcaaggccgugcacgccgacaugggcuacuggaucgaguccgagaagaacgagaccuggaagcuggcccgggcgagcuucaucgaggugaagacgugcaucuggcccaagucccacacccuguggagcaacggcguccucgaguccgagaugaucauccccaagaucuacgggggcccgaucagccagcacaacuaccgccccggguacuucacccaggccgccggccccuggcaccuggggaagcuggagcucgacuucgaccugugcgagggcaccacggugguggucgacgagcacugcggcaaccgggggccgucccugcgcaccaccaccgugacgggcaagaucauccacgaguggugcugccggagcugcacccugccgccccuccgcuuccgcggggaggacggcugcugguacgggauggagauccgccccgugaaggagaaggaggagaaccuggucaaguccauggugagcgccggcagcggcgagguggacuccuucagccucgggcugcugugcaucuccaucaugaucgaggaggucaugcggagccgcuggucccggcgcaugcucaugaccggcacccuggccguguucuuccugcucaucauggggcagcugacguggaacgaccugauccgccucugcaucauggugggcgcgaacgccagcgaccggauggggaugggcaccaccuaccuggcccugauggccaccuucaagaugcgcccgauguucgccgucggccuccuguuccggcgccugacgucccgggaggugcuccugcugaccaucgggcucagccugguggcguccgucgagcugcccaacagccucgaggagcugggcgacgggcuggccaugggcaucaugauccucaagcugcugaccgacuuccagucccaccagcucugggccacccugcugagccucacguucaucaagaccaccuucucccugcacuacgccuggaagaccauggcgauggugcugagcaucgucucccucuucccccugugccugagcacgaccucccagaagaccaccuggcuccccgugcugcugggcagccucgggugcaagccgcugacgauguuccugaucgccgagaacaagaucuggggccgccgguccuggccccucaacgaggggaucauggccgugggcaucgucagcauccugcugagcucccuccugaagaacgacgugccccuggccgggccccucaucgccggcggcaugcugaucgcgugcuacgugaucagcggguccagcgccgaccugucccucgagaaggccgccgagaucagcugggaggaggaggccgagcacuccggcgcgagccacaacauccuggucgaggugcaggacgacgggaccaugaagaucaaggacgaggagcgcgacgacacccugaccauccuccugaaggccacccugcucgccguguccggcgucuacccgcugagcauccccgccacgcuguucgugugguacuucuggcagaagaagaagcagcgguccggggugcucugggacacccccagcccgcccgaggucgagcgcgccgugcuggacgacggcaucuaccggaucaugcagcgcggccugcuggggcggucccaggugggcgucgggguguuccaggagaacguguuccacaccauguggcacgucacccgcggcgcggugcucauguaccaggggaagcggcuggagcccagcugggccuccgugaagaaggaccugaucagcuacggcggcggguggcgccuccagggcuccuggaacacgggggaggagguccaggugaucgccguggagcccggcaagaaccccaagaacguccagaccgcccccgggaccuucaagacccccgagggcgaggugggcgccaucgcgcuggacuucaagcccgggacgagcggcucccccaucgugaaccgggaggggaagaucgucggccuguacggcaacgggguggugaccaccagcggcaccuacgucagcgccaucgcccaggccaaggcgucccaggaggggccgcuccccgagaucgaggacgagguguuccgcaagcggaaccugacgaucauggaccugcaccccggcagcgggaagacccgccgguaccucccggccaucgugcgcgaggccaucaagcgcaagcugcggacccugauccucgcccccacccgcgucguggccuccgagauggcggaggcccugaagggcaugcccauccgguaccagacgaccgccgucaagagcgagcacaccggcaaggagaucgucgaccugaugugccacgccaccuucacgaugcgccuccugucccccgcccgggugccgaacuacaacaugaucaucauggacgaggcgcacuucaccgaccccagcuccaucgccgcccgcggguacaucagcacccgggugggcaugggggaggccgccgcgaucuucaugaccgccacgccgcccggcuccgucgaggccuucccgcagagcaacgccgugauccaggacgaggagcgcgacauccccgagcgguccuggaacagcggguacgaguggaucaccgacuuccccggcaagaccgugugguucguccccuccaucaagagcggcaacgacaucgcgaacugccugcgcaagaacgggaagcgggugauccagcucucccgcaagaccuucgacacggaguaccagaagaccaagaacaacgacugggacuacguggucaccaccgacaucagcgagaugggcgccaacuuccgggccgaccgcgugaucgacccgcggcgcugccugaagcccgugauccugaaggacgggcccgagcgggucauccucgccggccccaugccggugacgguggccuccgcggcccagcgccgggggcgcaucggccgcaaccacaacaaggagggcgaccaguacaucuacauggggcagccccugaacaacgacgaggaccacgcccacuggaccgaggccaagaugcugcucgacaacaucaacacccccgagggcaucauccccgcccuguucgagccggagcgggagaaguccgcggccaucgacggggaguaccgccugcggggcgaggcccgcaagaccuucgucgagcucaugcggcgcggggaccugcccguguggcuguccuacaaggucgccagcgagggcuuccaguacagcgaccggcgcuggugcuucgacggcgagcggaacaaccaggugcucgaggagaacauggacguggagaucuggacgaaggagggggagcgcaagaagcugcggccccgcuggcuggacgcccggaccuacuccgacccccucgcgcugcgcgaguucaaggaguucgccgccggccggcgcagcgucuccggggaccugauccucgagaucggcaagcugccgcagcaccugacccagcgggcccagaacgcgcucgacaaccuggugaugcugcacaacagcgagcagggcgggcgcgccuaccggcacgccauggaggagcuccccgacaccaucgagacgcugaugcugcucgcccugaucgccgugcugaccggcggggucacccucuucuuccuguccggccgcgggcugggcaagaccagcaucggccuccugugcgugauggcguccagcgugcugcucuggauggccuccgucgagccccacuggaucgccgccagcaucauccuggaguucuuccugauggugcuccugauccccgagccggaccggcagcgcacgccccaggacaaccagcuggccuacguggucaucgggcuccuguucaugauccugacgguggcggccaacgagaugggccuccuggagaccaccaagaaggaccuggggaucggccacguggccgucgagaaccaccaccacgccgccaugcucgacguggaccugcaccccgcguccgccuggacccuguacgccguggccacgaccaucaucaccccgaugaugcgccacaccaucgagaacacgaccgccaacaucagccucaccgcgaucgccaaccaggccgccauccugauggggcuggacaagggcuggcccaucuccaagauggacaucggcgucccccuccuggcgcuggggugcuacagccaggugaacccccucacccugacggccgccgugcugaugcucgucgcccacuacgccaucaucggcccggggcugcaggcgaaggccacccgggaggcccagaagcgcaccgccgccggcaucaugaagaaccccaccguggacgggaucguggcgaucgaccuggaccccgucguguacgacgccaaguucgagaagcagcucggccagaucaugcugcugauccucugcacgucccagauccugcugaugcggaccaccugggcccucugcgagagcaucacccuggccacgggcccccugaccacccucugggagggguccccgggcaaguucuggaacaccacgaucgccgugagcauggcgaacaucuuccgcggguccuaccuggccggcgccggccuggccuucagccucaugaagucccucgggggcgggcggcgcgggaccggggcgcagggcgagacccugggcgagaaguggaagcggcagcucaaccagcuguccaagagcgaguucaacaccuacaagcgcuccgggaucauggaggucgaccggagcgaggccaaggagggccugaagcgcggggagacgaccaagcacgccgugucccggggcaccgccaagcuccgcugguucguggagcggaaccuggucaagcccgaggggaaggugaucgaccugggcugcggccgcgggggcuggagcuacuacugcgccgggcugaagaaggugaccgaggucaagggcuacacgaagggcggccccggccacgaggagcccaucccgauggcgaccuacggguggaaccucgugaagcugcacuccggcaaggacguguucuucaucccgcccgagaagugcgacacccugcucugcgacaucggggagagcucccccaacccgaccaucgaggagggccggacgcugcgcguccugaagaugguggagcccuggcuccgggggaaccaguucugcaucaagauccugaaccccuacaugcccagcguggucgagacccuggagcagaugcagcgcaagcacggcggcaugcucgugcggaacccgcugucccgcaacagcacccacgagauguacuggguguccugcgggaccggcaacaucgucagcgccgugaacaugaccucccgcaugcugcucaaccgguucacgauggcccaccgcaagcccaccuacgagcgggacguggaccugggggccggcacccgccacgucgccguggagcccgagguggcgaaccuggacaucaucggccagcggaucgagaacaucaagcacgagcacaagagcaccuggcacuacgacgaggacaaccccuacaagacgugggccuaccacggguccuacgaggucaagccgagcggcuccgccagcagcauggugaacgggguggucaagcuccugaccaagcccugggacgugauccccauggucacccagaucgccaugaccgacacgacccccuucggccagcagcgcguguucaaggagaagguggacacccggaccccgaaggccaagcgcgggacggcgcagaucauggaggucaccgccaaguggcuguggggcuuccucucccggaacaagaagccccgcaucugcacccgggaggaguucacccgcaaggugcggagcaacgccgccaucggcgcgguguucgucgacgagaaccaguggaacuccgccaaggaggccguggaggacgagcgcuucugggaccuggugcaccgggagcgcgagcugcacaagcaggggaagugcgccacgugcgucuacaacaugaugggcaagcgggagaagaagcucggggaguucggcaaggccaaggggagccgcgcgaucugguacauguggcugggcgcccgguuccuggaguucgaggcccucggcuucaugaacgaggaccacugguucucccgcgagaacagccuguccgggguggagggcgaggggcugcacaagcucggcuacauccugcgggacaucagcaagauccccgggggcaacauguacgccgacgacaccgccggcugggacacccgcaucaccgaggacgaccugcagaacgaggcgcgcaucacggacaucauggagccggagcacgcccuccuggccaaguccaucuucaagcugaccuaccagaacaaggugguccgggugcagcgccccgccaagaacgggaccgugauggacgucaucagccggcgcgaccagcggggcuccggccagguggggaccuacggccucaacacguucaccaacauggaggcccagcugauccgccagauggagagcgaggggaucuucucccccagcgagcuggagacccccaaccucgcggagcgggugcuggacuggcuggagaaguacggcgucgagcgccucaagcggauggccaucuccggggacgacugcguggugaagccgaucgacgaccgcuucgccaccgcccugacggcccugaacgacaugggcaagguccggaaggacaucccccagugggagcccagcaagggguggaacgacuggcagcagguccccuucugcucccaccacuuccaccagcucaucaugaaggacggccgcgagaucguggucccgugccggaaccaggacgagcuggugggccgcgcgcgggugagccagggggccggcuggagccugcgcgagaccgccugccucgggaaguccuacgcccagauguggcagcugauguacuuccaccggcgcgaccugcggcucgcggccaacgccaucugcagcgccguccccguggacuggauccccaccucccgcaccacguggagcauccacgcccaccaccaguggaugaccaccgaggacaugcuguccguguggaaccgcgucuggaucgaggagaaccccuggauggaggacaagacccacaucagcuccuggggcgacgugccguaccuggggaagcgggaggaccaguggugcggcagccucaucggccugacggcgcgcgccaccugggccaccaacauccagguggccaucaaccagguccggcgccugaucgggaacgagaacuaccucgacuacaugaccuccaugaagcgguucaagaacgagagcgaccccgagggcgcccugugguga

SEQ ID NO: 8395 - RNA, 9879 nt, Artificial Sequence
  derived and/or modified CDS sequence (opt1) from DENV-1__FJ410226__SS-prME
agcgugaccaugcugcucaugcugaugcccaccgcccuggccuuccaccucacgacccggggcggggagccccacaugaucgugagcaagcaggagcggggcaagagccugcuguucaagaccagcgccggggugaacaugugcacccucaucgccauggaccugggcgaguucugcgaggacaccaugaccuacaagugcccccgcaucaccgaggccgagcccgacgacguggacugcuggugcaacgccaccgacacgugggugaccuacgggaccugcagccagaccggcgagcaccggcgggacaagcgguccguggcccuggcgccccacgugggccucgggcuggagacgcgcaccgagaccuggaugagcuccgagggcgccuggaagcagauccagcgggucgagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugcccgacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaagaucguccaguacgagaaccugaaguacagcgugaucgugaccguccacaccggcgaccagcaccagguggggaacgaguccacggagcacggcaccaccgcgaccaucacgccccaggcccccagcacggagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccagcggggccuccaccagccaggagaccuggaaccggcaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcauguccuacgucaugugcaccgggagcuucaagcuggagaaggagguggcggagacccagcacggcacggugcucguccagaucaaguacgagggcaccgacgcccccugcaagauccccuucuccacccaggacgagaagggggugacccagaacggccggcugaucacggccaacccgaucgugaccgacaaggacaagcccgucaacaucgaggccgagccgcccuucggggagagcuacaucgugaucggcgcgggcgagaaggcccugaagcuguccugguucaagaaggggagcuccaucggcaagauguucgaggccaccgcccgcggggcccggcgcauggcgauccucggcgacaccgccugggacuucgggagcaucggcggcguguucacguccgucgggaagcuggugcaccagaucuucggcaccgccuacggggugcuguucagcggcgucuccuggaccaugaagaucgggaucggcgugcuccugaccuggcugggccucaacagccgcuccacgagccuguccaugaccugcaucgccguggggcuggucacccucuaccugggcgugauggugcaggccgacagcgggugcgucgugaacuggaagggccgggagcugaagugcgggagcggcaucuucgugaccaacgagguccacacguggaccgagcaguacaaguuccaggcggacuccccgaagcgccucagcgccgccaucggcaaggccugggaggagggggugugcggcauccgguccgccacccgccuggagaacaucauguggaagcagaucagcaacgagcugaaccacauccuccuggagaacgacaugaaguucaccguggucgugggggacguggcgggcauccuggcccaggggaagaagaugauccggccccagcccauggaguacaaguacuccuggaaguccuggggcaaggccaagaucaucggcgccgacguccagaacaccacguucaucaucgacgggcccaacaccccggagugccccgacgaccagcgcgcguggaacaucugggagguggaggacuacggcuucgggaucuucaccaccaacaucuggcucaagcugcgggacuccuacacccaggugugcgaccaccgccugaugagcgccgccaucaaggacuccaaggccguccacgccgacaugggcuacuggaucgagagcgagaagaacgagaccuggaagcucgcgcgggccuccuucaucgaggugaagaccugcaucuggcccaagagccacacccugugguccaacggcgugcuggagagcgagaugaucauccccaagaucuacgggggcccgaucucccagcacaacuaccgccccggguacuucacgcagaccgccggccccuggcaccucgggaagcuggagcuggacuucgaccucugcgagggcaccaccgucgugguggacgagcacugcggcaaccgggggccgagccugcgcacgaccaccgucaccggcaagaucauccacgaguggugcugccgguccugcacgcugccgccccugcgcuucaagggggaggacggcugcugguacgggauggagauccggcccgugaaggagaaggaggagaaccuggucaagagcauggucagcgccggcuccggcgagguggacagcuucucccuggggcuccugugcaucagcaucaugaucgaggaggugaugcgcucccgguggagccgcaagaugcugaugaccggcacccucgccgucuucuuccugcugaucauggggcagcucaccuggaacgaccugauccggcugugcaucauggugggcgcgaacgccuccgaccgcauggggaugggcacgaccuaccucgcccugauggccaccuucaagaugcgcccgauguucgccgugggccuccuguuccggcgccugaccagccgggagguccugcuccugacgaucgggcugucccucguggcgagcgucgagcugcccaacucccuggaggagcucggcgacgggcuggccaugggcaucaugauccugaagcuccugaccgacuuccagagccaccagcugugggccacccuccugucccugaccuucaucaagacgaccuucagccuccacuacgccuggaagaccauggcgauggugcuguccaucgugagccuguucccccucugcauguccaccacgagccagaagaccaccuggcugcccguccugcucggcucccuggggugcaagccgcugaccauguuccucaucgccgagaacaagaucuggggccgcaagagcuggccccugaacgaggggaucauggccgugggcaucgugagcauccugcucuccagccugcugaagaacgacgucccccucgccgggccccugaucgccggcggcaugcugaucgcgugcuacgugaucuccgggagcuccgccgaccucagccuggagaaggccgccgagguguccugggaggaggaggccgagcacagcggcgcgucccacaacauccuggucgaggugcaggacgacgggacgaugaagaucaaggacgaggagcgggacgacacccucaccauccugcugaaggccacccuccuggccgugagcggcgucuacccgcuguccauccccgccacccucuucgugugguacuucuggcagaagaagaagcagcgcagcggggugcugugggacacgcccagcccgcccgaggucgagcgggccgugcuggacgacggcaucuaccgcaucaugcagcggggccuccuggggcgcagccaggugggcgucgggguguuccaggagaacguguuccacaccauguggcacgucacccggggcgcggugcugauguaccaggggaagcgccuggagcccuccugggccagcgugaagaaggaccucaucuccuacggcggcggguggcggcugcagggcagcuggaacaccggggaggagguccaggugaucgccguggagcccggcaagaaccccaagaacguccagacggcccccgggaccuucaagaccuccgagggcgaggugggcgccaucgcgcuggacuucaagcccgggaccagcggcagccccaucgugaaccgcgaggggaagaucgucggccucuacggcaacgggguggugacgaccuccggcaccuacgucagcgccaucgcccaggccaaggcgucccaggaggggccccugccggagaucgaggacgagguguuccggaagcgcaaccugaccaucauggaccuccaccccggcagcgggaagacgcggcgcuaccugcccgccaucgugcgggaggccaucaagcgcaagcugcggacccucauccuggccccgacccgcgucguggccuccgagauggcggaggcccugaagggcaugcccauccgcuaccagaccacggccgucaagagcgagcacaccggcaaggagaucgucgaccucaugugccacgccaccuucaccaugcggcugcugucccccgugcgcgugcccaacuacaacaugaucaucauggacgaggcccacuucacggacccgagcuccaucgcggcccggggguacaucagcacccgcgucggcaugggggaggccgccgccaucuucaugaccgcgacgccgcccggcuccguggaggccuucccccagagcaacgccgugauccaggacgaggagcgggacaucccggagcgcuccuggaacagcggguacgaguggaucacggacuuccccggcaagaccgucugguucgugcccuccaucaagagcggcaacgacaucgccaacugccuccggaagaacgggaagcgcgugauccagcugucccggaagaccuucgacaccgaguaccagaagacgaagaacaacgacugggacuacgucgugaccaccgacaucagcgagaugggcgcgaacuuccgcgccgaccgggugaucgacccccgccggugccugaagccggucauccucaaggacgggcccgagcgcgugauccuggccggccccaugcccgucaccguggccuccgccgcgcagcggcgcgggcggaucggccgcaaccacaacaaggagggcgaccaguacguguacauggggcagccgcugaacaacgacgaggaccacgcccacuggacggaggccaagaugcuccuggacaacaucaacacccccgagggcaucauccccgcccuguucgagcccgagcgggagaaguccgccgcgaucgacggggaguaccgccuccgcggcgaggcccggaagaccuucgucgagcugaugcgccgcggggaccugccgguguggcucagcuacaagguggccuccgagggcuuccaguacagcgaccgccgguggugcuucgacggcgagcgcaacaaccagguccuggaggagaacauggacguggagaucuggaccaaggagggggagcggaagaagcugcgcccccgguggcucgacgcccgcacguacuccgacccccuggcccugcgggaguucaaggaguucgcggccggccgccggagcguguccggggaccucauccuggagaucggcaagcugccccagcaccucacccagcgcgcccagaacgcccuggacaaccuggucaugcuccacaacagcgagcagggcgggcgggcguaccgccacgccauggaggagcugccggacaccaucgagacccugaugcuccuggcccugaucgccgugcucacgggcggggugacccuguucuuccuguccggccgggggcucggcaagaccagcaucggccugcugugcgucauggccuccagcgugcuccuguggauggcguccguggagccccacuggaucgccgccagcaucauccuggaguucuuccucaugguccugcugauccccgagcccgaccgccagcggaccccgcaggacaaccagcucgccuacguggugaucgggcugcuguucaugauccucaccgucgccgcgaacgagaugggccugcuggagacgaccaagaaggaccucgggaucggccacguggccguggagaaccaccaccacgccgccaugcuggacgucgaccugcaccccgccuccgcguggacccucuacgccguggccaccacgaucaucacccccaugaugcgccacaccaucgagaacaccacggccaacaucagccugaccgccaucgcgaaccaggccgccauccugauggggcucgacaagggcuggccgaucuccaagauggacaucggcgugccccugcuggcccucgggugcuacagccaggucaacccccugacccugaccgcggccgugcucaugcugguggcccacuacgccaucaucggccccgggcugcaggccaaggcgacgcgggaggcccagaagcgcaccgccgccggcaucaugaagaacccgaccgucgacgggaucguggccaucgaccucgaccccguggucuacgacgcgaaguucgagaagcagcugggccagaucaugcugcucauccugugcaccucccagauccugcucaugcgcacgaccugggcccugugcgagagcaucacccuggccaccggcccccucacgacccugugggaggggucccccggcaaguucuggaacaccaccaucgccgugagcauggccaacaucuuccgggggagcuaccuggcgggcgccggccucgccuucucccugaugaagucccucgggggcgggcgccgggggacgggggcccagggcgagacccucggcgagaaguggaagcgccagcugaaccagcuguccaagagcgaguucaacaccuacaagcgguccgggaucauggagguggaccgcagcgaggcgaaggagggccucaagcgcggggagaccacgaagcacgccgucucccgcggcaccgccaagcugcggugguucguggagcgcaaccuggugaagccggaggggaaggucaucgaccucggcugcggccgcggcggguggagcuacuacugcgccgggcugaagaaggugaccgaggugaagggguacaccaagggcggccccggccacgaggagcccauccccauggccacguacggguggaaccuggucaagcugcacuccggcaaggacguguucuucaucccgcccgagaagugcgacacccuccugugcgacaucggggagagcucccccaaccccaccaucgaggagggccgcacccugcgggugcucaagauggucgagccguggcugcgcgggaaccaguucugcaucaagauccugaaccccuacaugcccagcgugguggagacgcucgagcagaugcagcggaagcacggcggcaugcugguccgcaacccccugucccggaacagcacccacgagauguacuggguguccugcgggaccggcaacaucgugagcgcggucaacaugaccucccgcaugcuccugaaccgguucaccauggcccaccgcaagccgacguacgagcgcgacguggaccugggggccggcacccggcacguggccgucgagcccgagguggccaaccucgacaucaucggccagcgcaucgagaacaucaagcacgagcacaagagcaccuggcacuacgacgaggacaaccccuacaagaccugggcguaccacggguccuacgaggucaagcccagcggcagcgccuccagcauggugaacgggguggucaagcugcugacgaagccgugggacgugauccccauggugacccagaucgccaugaccgacaccacgcccuucggccagcagcgggucuucaaggagaagguggacacccgcacccccaaggccaagcgggggaccgcccagaucauggaggugacggcgaaguggcucuggggcuuccugucccgcaacaagaagccgcggaucugcacccgcgaggaguucacccggaagguccgcagcaacgccgccaucggcgccguguucguggacgagaaccaguggaacuccgcgaaggaggccgucgaggacgagcgguucugggaccuggugcaccgcgagcgggagcuccacaagcaggggaagugcgcgaccugcguguacaacaugaugggcaagcgcgagaagaagcugggggaguucggcaaggccaaggggagccgggccaucugguacauguggcugggcgcgcgcuuccucgaguucgaggcccugggcuucaugaacgaggaccacugguucucccgggagaacagccuguccggggucgagggcgaggggcuccacaagcugggcuacauccugcgcgacaucagcaagauccccgggggcaacauguacgccgacgacacggccggcugggacacccggaucaccgaggacgaccuccagaacgaggccaagaucaccgacaucauggagcccgagcacgcgcugcuggccaaguccaucuucaagcucacguaccagaacaagguggugcgcguccagcggccggccaagaacgggaccgugauggacgugaucagccgccgcgaccagcggggcuccgggcaggucggcaccuacggccugaacaccuucacgaacauggaggcccagcugauccgccagauggagagcgaggggaucuucucccccagcgagcucgagacccccaaccuggccggccgggugcuggacuggcucgagaagcacgggguggagcgccugaagcggauggcgaucuccggcgacgacugcgucgugaagcccaucgacgaccgcuucgccaccgcccugaccgcccucaacgacauggggaaggugcggaaggacaucccgcagugggagcccagcaagggcuggaacgacuggcagcagguccccuucugcagccaccacuuccaccagcugaucaugaaggacggccgcgagaucguggugcccugccggaaccaggacgagcuggucgggcgcgcccgggugucccagggcgcgggguggagccuccgcgagacggccugccugggcaaguccuacgcccagauguggcagcugauguacuuccaccggcgcgaccuccggcuggccgcgaacgccaucugcagcgccgugccggucgacugggugcccaccucccgcaccaccuggagcauccacgcccaccaccaguggaugacgaccgaggacaugcuguccguguggaaccgggucuggaucgaggagaaccccuggauggaggacaagacccacaucagcuccuggggcgacgugcccuaccucggcaagcgcgaggaccaguggugcggcagccugaucgggcugaccgcccgggcgacgugggccaccaacauccagguggccaucaaccagguccgccgccucaucggcaacgagaacuaccuggacuacaugaccuccaugaagcgguucaagaacgagagcgacccggagggggcccugugguga

SEQ ID NO: 8396 - RNA, 9879 nt, Artificial Sequence
  derived and/or modified CDS sequence (opt1) from DENV-1__FJ410227__SS-prME
agcgugaccaugcugcucaugcugaugcccaccgcccuggccuuccaccucaccacccggggcggggagccccacaugaucgugagcaagcaggagcggggcaagagccugcuguucaagaccagcgcgggggugaacaugugcacccucaucgccauggaccugggcgaguucugcgaggacacgaugaccuacaagugcccccgcaucaccgaggccgagcccgacgacguggacugcuggugcaacgccaccgacacgugggugaccuacgggaccugcagccagaccggcgagcaccggcgggacaagcgguccguggcccuggcgccccacgugggccucgggcuggagacgcgcaccgagaccuggaugagcuccgagggcgccuggaagcagauccagcgggucgagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugcccgacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaagaucguccaguacgagaaccugaaguacagcgugaucgugaccguccacaccggcgaccagcaccagguggggaacgaguccacggagcacggcaccaccgcgaccaucacgccccaggcccccagcacggagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccagcggggccuccaccagccaggagaccuggaaccggaaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcauguccuacgucaugugcaccgggagcuucaagcuggagaaggagguggcggagacccagcacggcacggugcucguccagaucaaguacgagggcaccgacgcccccugcaagauccccuucuccacccaggacgagaagggggugacccagaacggccggcugaucacggccaacccgaucgugaccgacaaggagaagcccgucaacaucgaggccgagccgcccuucggggagagcuacaucgugaucggcgcgggcgagaaggcccugaagcuguccugguucaagaaggggagcuccaucggcaagauguucgaggccaccgcccgcggggcccggcgcauggcgauccucggcgacaccgccugggacuucgggagcaucggcggcguguucacguccgucgggaagcuggugcaccagaucuucggcaccgccuacggggugcuguucagcggcgucuccuggaccaugaagaucgggaucggcgugcuccugaccuggcugggccucaacagccgcuccacgagccuguccaugaccugcaucgccguggggcuggucacccucuaccugggcgugauggugcaggccgacagcgggugcgucaucaacuggaagggccgggagcugaagugcgggagcggcaucuucgugaccaacgaggugcacacguggaccgagcaguacaaguuccaggcggacuccccgaagcgccucagcgccgccaucggcaaggccugggaggagggggucugcggcauccgguccaccacccgccuggagaacaucauguggaagcagaucagcaacgagcugaaccacauccuccuggagaacgacaugaaguucaccgugguggucggggacguggccggcauccuggcgcaggggaagaagaugauccggccccagcccauggaguacaaguacuccuggaaguccuggggcaaggccaagaucaucggcgccgacgugcagaacacgaccuucaucaucgacgggcccaacaccccggagugccccgacgaccagcgcgccuggaacaucugggaggucgaggacuacggcuucgggaucuucaccacgaacaucuggcucaagcugcgggacuccuacacccaggugugcgaccaccgccugaugagcgcggccaucaaggacuccaaggccgugcacgccgacaugggcuacuggaucgagagcgagaagaacgagaccuggaagcucgcccgggcguccuucaucgaggucaagaccugcaucuggcccaagagccacacgcugugguccaacggcgugcuggagagcgagaugaucauccccaagaucuacgggggcccgaucucccagcacaacuaccgccccggguacuucacccagaccgccggccccuggcaccucgggaagcuggagcuggacuucgaccucugcgagggcaccacgguggucguggacgagcacugcggcaaccgggggccgagccugcgcaccaccaccgugacgggcaagaucauccacgaguggugcugccgguccugcacccugccgccccugcgcuucaagggggaggacggcugcugguacgggauggagauccggcccgucaaggagaaggaggagaaccuggucaagagcauggugagcgccggcuccggcgaggucgacagcuucucccuggggcuccugugcaucagcaucaugaucgaggaggugaugcgcucccgguggagccgcaagaugcugaugaccggcacccucgccguguucuuccugcugaucauggggcagcucacguggaacgaccugauccggcugugcaucauggucggcgccaacgcguccgaccgcauggggaugggcaccaccuaccucgcccugauggccaccuucaagaugcgcccgauguucgccgugggccuccuguuccggcgccugacgagccgggaggugcugcuccugaccaucgggcugucccucgucgccagcguggagcugcccaacucccuggaggagcucggcgacgggcuggcgaugggcaucaugauccugaagcuccugaccgacuuccagagccaccagcugugggccacccuccugucccugacguucaucaagaccaccuucagccuccacuacgccuggaagaccauggccaugguccuguccaucgugagccuguucccccucugccuguccacgaccagccagaagaccaccuggcugcccgugcuccugggcucccuggggugcaagccgcucacgauguuccugaucgcggagaacaagaucuggggccgcaagagcuggccccugaacgaggggaucauggccgucggcaucgugagcauccuccuguccagccugcucaagaacgacgugccccuggccgggccccugaucgccggcggcaugcucaucgccugcuacgucaucuccgggagcuccgcggaccugagccuggagaaggccgccgagguguccugggaggaggaggccgagcacagcggcgccucccacaacauccucguggagguccaggacgacgggaccaugaagaucaaggacgaggagcgggacgacacccugaccauccugcucaaggcgacccugcuggccgugagcggcguguacccgcucuccauccccgccacgcuguucgucugguacuucuggcagaagaagaagcagcgcagcggggugcugugggacacccccagcccgcccgagguggagcgggccguccucgacgacggcaucuaccgcaucaugcagcggggccugcuggggcgcagccaggugggcgugggggucuuccaggagaacguguuccacaccauguggcacgugacccggggcgccguccugauguaccaggggaagcgccucgagcccuccugggcgagcgugaagaaggaccugaucuccuacggcggcggguggcggcugcagggcagcuggaacacgggggaggaggugcaggucaucgccguggagcccggcaagaaccccaagaacgugcagaccgcccccgggaccuucaagaccuccgagggcgaggucggcgccaucgcccucgacuucaagcccgggacgagcggcagccccaucgugaaccgcgaggggaagaucgugggccuguacggcaacggggucgugaccaccuccggcaccuacgugagcgcgaucgcccaggccaaggccucccaggaggggccccugccggagaucgaggacgaggucuuccggaagcgcaaccucacgaucauggaccugcaccccggcagcgggaagacccggcgcuaccugcccgcgaucgugcgggaggccaucaagcgcaagcuccggacccugauccuggccccgacccgcguggucgccuccgagauggccgaggcgcucaagggcaugcccauccgcuaccagacgaccgccgucaagagcgagcacaccggcaaggagaucguggaccugaugugccacgccaccuucacgaugcggcugcucucccccguccgcgugcccaacuacaacaugaucaucauggacgaggcccacuucaccgacccgagcuccaucgccgcgcggggguacaucagcacccgcgugggcaugggggaggccgccgccaucuucaugaccgccacgccgcccggcuccgucgaggcguucccccagagcaacgccgugauccaggacgaggagcgggacaucccggagcgcuccuggaacagcggguacgaguggaucaccgacuuccccggcaagaccgugugguucguccccuccaucaagagcggcaacgacaucgccaacugccugcggaagaacgggaagcgcgugauccagcugucccggaagaccuucgacacggaguaccagaagaccaagaacaacgacugggacuacguggucaccaccgacaucagcgagaugggcgccaacuuccgcgcggaccgggugaucgacccccgccggugccucaagccggugauccugaaggacgggcccgagcgcgucauccuggccggccccaugcccgugacggucgccuccgccgcccagcggcgcgggcggaucggccgcaaccacaacaaggagggcgaccaguacaucuacauggggcagccgcucaacaacgacgaggaccacgcgcacuggaccgaggccaagaugcugcuggacaacaucaacacccccgagggcaucauccccgcccucuucgagcccgagcgggagaaguccgccgccaucgacggggaguaccgccugcgcggcgaggcgcggaagaccuucguggagcugaugcgccgcggggaccucccgguguggcugagcuacaaggucgccuccgagggcuuccaguacagcgaccgccgguggugcuucgacggcgagcgcaacaaccaggugcuggaggagaacauggacguggagaucuggacgaaggagggggagcggaagaagcuccgcccccgguggcuggacgcccgcaccuacuccgacccccuggcccuccgggaguucaaggaguucgccgcgggccgccggagcgucuccggggaccugauccuggagaucggcaagcucccccagcaccugacccagcgcgcccagaacgcccuggacaaccucgugaugcugcacaacagcgagcagggcgggcgggccuaccgccacgcgauggaggagcugccggacaccaucgagacgcucaugcugcuggcccucaucgccgugcugaccggcggggucacccuguucuuccucuccggccgggggcugggcaagaccagcaucggccugcucugcgugauggccuccagcgugcugcuguggauggccuccgucgagccccacuggaucgcggccagcaucauccucgaguucuuccugauggugcugcucauccccgagcccgaccgccagcggaccccgcaggacaaccagcuggccuacguggucaucgggcuccucuucaugauccugacgguggccgccaacgagaugggccugcucgagaccaccaagaaggaccuggggaucggccacguggcggccgagaaccaccaccacgccgccaugcuggacgucgaccuccaccccgccuccgcguggacccuguacgccguggccacgaccaucaucacccccaugaugcgccacaccaucgagaacacgaccgccaacaucagccugaccgccaucgcgaaccaggccgccauccucauggggcuggacaagggcuggccgaucuccaagauggacaucggcgugccccugcucgcccuggggugcuacagccaggucaacccccugacccucacggcggccgugcugaugcugguggcccacuacgccaucaucggccccgggcuccaggccaaggcgacccgggaggcccagaagcgcaccgccgccggcaucaugaagaacccgaccgucgacgggaucguggccaucgaccuggaccccguggucuacgacgcgaaguucgagaagcagcugggccagaucaugcuccugauccugugcacgucccagauccuccugaugcgcaccaccugggcccugugcgagagcaucacccucgccacgggcccccugaccacccugugggaggggucccccggcaaguucuggaacaccacgaucgccgugagcauggccaacaucuuccgggggagcuaccucgcgggcgccggccuggccuucucccugaugaagucccucgggggcgggcgccggggcaccggggcccagggcgagacccugggcgagaaguggaagcgccagcugaaccagcucuccaagagcgaguucaacaccuacaagcgguccgggaucauggagguggaccgcagcgaggcgaaggagggccugaagcgcggggagacgaccaagcacgccgucucccgcggcaccgccaagcugcggugguucguggagcgcaaccucgugaagccggaggggaaggucaucgaccugggcugcggccgcggcggguggagcuacuacugcgccgggcugaagaaggugaccgaggugaagggguacacgaagggcgggcccggccacgaggagcccauccccauggccaccuacggguggaaccuggucaagcuccacuccggcaaggacguguucuucaucccgcccgagaagugcgacacccugcugugcgacaucggggagagcucccccaaccccaccaucgaggagggccgcacgcuccgggugcugaagauggucgagccguggcugcgcgggaaccaguucugcaucaagauccucaaccccuacaugcccagcgugguggagacccuggagcagaugcagcggaagcacggcggcaugcugguccgcaacccccucucccggaacagcacccacgagauguacuggguguccugcgggaccggcaacaucgugagcgcggucaacaugaccucccgcaugcugcugaaccgguucacgauggcccaccgcaagccgaccuacgagcgcgacguggaccucggggccggcacccggcacguggccgucgagcccgagguggccaaccuggacaucaucggccagcgcaucgagaacaucaagcacgagcacaagagcaccuggcacuacgacgaggacaaccccuacaagacgugggcguaccacggguccuacgaggugaagcccagcggcagcgccuccagcauggucaacgggguggucaagcugcucaccaagccgugggacgugauccccauggugacccagaucgccaugaccgacacgacccccuucggccagcagcgggucuucaaggagaagguggacacccgcacccccaaggccaagcgggggacggcccagaucauggaggugaccgcgaaguggcuguggggcuuccugucccgcaacaagaagccgcggaucugcacccgcgaggaguucacccggaagguccgcagcaacgccgccaucggcgccguguucguggacgagaaccaguggaacuccgcgaaggaggccgucgaggacgagcgguucugggaccucgugcaccgcgagcgggagcugcacaagcaggggaagugcgccacgugcguguacaacaugaugggcaagcgcgagaagaagcugggggaguucggcaaggccaaggggagccgggccaucugguacauguggcucggcgcgcgcuuccuggaguucgaggcccugggcuucaugaacgaggaccacugguucucccgggagaacagccucuccggggucgagggcgaggggcugcacaagcugggcuacauccuccgcgacaucagcaagauccccgggggcaacauguacgccgacgacaccgccggcugggacacccggaucaccgaggacgaccugcagaacgaggccaagaucacggacaucauggagcccgagcacgcgcugcucgccaaguccaucuucaagcugaccuaccagaacaagguggugcgcguccagcggccggccaagaacgggaccgugauggacgugaucagccgccgcgaccagcggggcuccgggcaggucggcaccuacggccugaacacguucaccaacauggaggcccagcucauccgccagauggagagcgaggggaucuucucccccagcgagcuggagacccccaaccuggccggccgggugcucgacuggcuggagaagcacgggguggagcgccugaagcggauggcgaucuccggcgacgacugcgucgugaagcccaucgacgaccgcuucgccaccgcccucacggcccugaacgacauggggaaggugcggaaggacaucccgcagugggagcccagcaagggcuggaacgacuggcagcagguccccuucugcagccaccacuuccaccagcugaucaugaaggacggccgcgagaucguggugcccugccggaaccaggacgagcucgucgggcgcgcccgggugucccagggcgcgggguggagccugcgcgagaccgccugccugggcaaguccuacgcccagauguggcagcucauguacuuccaccggcgcgaccugcggcuggccgcgaacgccaucugcagcgccgugccggucgacugggugcccaccucccgcaccacguggagcauccacgcccaccaccaguggaugaccaccgaggacaugcucuccguguggaaccgggucuggaucgaggagaaccccuggauggaggacaagacccacaucagcuccuggggcgacgugcccuaccugggcaagcgcgaggaccaguggugcggcagccugaucgggcucacggcccgggcgaccugggccaccaacauccagguggccaucaaccagguccgccgccugaucggcaacgagaacuaccuggacuacaugaccuccaugaagcgguucaagaacgagagcgacccggagggggcccucugguga

SEQ ID NO: 8397 - RNA, 9879 nt, Artificial Sequence
  derived and/or modified CDS sequence (opt1) from DENV-1__FJ859029__SS-prME
agcgugaccaugcugcucaugcugaugcccaccgcccuggccuuccaccucacgacccggggcggggagccccacaugaucguguccaagcaggagcggggcaagagccugcuguucaagaccuccgccggggugaacaugugcacccucaucgccauggaccugggcgaguucugcgaggacaccaugaccuacaagugcccccggaucaccgaggccgagcccgacgacguggacugcuggugcaacgccaccgacacgugggucaccuacgggaccugcagccagaccggcgagcaccggcgcgacaagcgguccguggcccuggcgccccacgugggccucgggcuggagacgcgcaccgagaccuggaugagcuccgagggcgccuggaagcagauccagaaggucgagaccugggcccugcggcaccccggguucacggugaucgcccucuuccuggcgcacgccaucggcaccagcaucacccagaaggggaucaucuucauccugcucaugcuggugacccccuccauggccaugcgcugcgucggcaucggcagccgggacuucguggaggggcuguccggcgccacguggguggacgucgugcucgagcacgggagcugcgugaccaccauggccaaggacaagcccacccuggacaucgagcugcucaagacggaggucaccaaccccgcggugcugcgcaagcugugcaucgaggccaagaucuccaacaccaccacggacagccggugcccgacccagggcgaggccacccucguggaggagcaggacgccaacuucgucugccgccggaccuucguggaccgcggcugggggaacggcugcgggcuguucggcaaggggucccugaucacgugcgccaaguucaagugcgugaccaagcucgagggcaagaccguccagcacgagaaccugaaguacagcgugaucgugaccguccacacgggcgaccagcaccagguggggaacgaguccaccgagcacggcaccaccgcgaccaucacgccccaggcccccagcaccgagauccagcugaccgacuacggggcccucacccuggacugcagcccccggacgggccuggacuucaacgagaugguccuccugaccaugaaggagaaguccuggcuggugcacaagcagugguuccucgaccugccgcugcccuggaccagcggggccuccaccagccaggagacguggaaccgcaaggaccuccuggugaccuucaagaccgcccacgcgaagaagcaggaggucguggugcugggcucccaggagggcgccaugcacaccgcccucacgggggccaccgagauccagaccagcggcaccacgaccaucuucgccgggcaccugaagugccggcugaagauggacaagcucacccugaagggcaccuccuacgucaugugcacggggagcuucaagcuggagaaggagguggcggagacccagcacggcaccgugcucguccagaucaaguacgagggcaccgacgcccccugcaagauccccuucuccacgcaggacgagaagggggugacccagaacggccgccugaucaccgccaacccgaucgugaccgacaaggagaagcccgucaacaucgaggccgagccgcccuucggggagagcuacaucgugaucggcgcgggcgagaaggcccugaagcuguccugguucaagaaggggagcuccaucggcaagauguucgaggccacggcccgcggggcccgccggauggcgauccucggcgacaccgccugggacuucgggagcaucggcggcguguucaccuccgucgggaagcuggugcaccagaucuucggcaccgccuacggggugcuguucagcggcgucuccuggacgaugaagaucgggaucggcgugcuccugaccuggcugggccucaacagccgcuccaccagccuguccaugaccugcaucgccguggggcuggucacgcucuaccugggcgugauggugcaggccgacagcgggugcgucaucaacuggaagggccgcgagcugaagugcgggagcggcaucuucgugaccaacgaggugcacaccuggaccgagcaguacaaguuccaggcggacuccccgaagcggcucagcgccgccaucggcaaggccugggaggagggggucugcggcauccgcuccgccacccggcuggagaacaucauguggaagcagaucagcaacgagcugaaccacauccuccuggagaacgacaugaaguucacggugguggucggggacguggcgggcauccuggcccaggggaagaagaugauccgcccccagcccauggaguacaaguacuccuggaaguccuggggcaaggccaagaucaucggcgccgacgugcagaacaccaccuucaucaucgacgggcccaacaccccggagugccccgacgaccagcgggcguggaacaucugggaggucgaggacuacggcuucgggaucuucacgaccaacaucuggcucaagcugcgcgacuccuacacccaggugugcgaccaccggcugaugagcgccgccaucaaggacuccaaggccgugcacgccgacaugggcuacuggaucgagagcgagaagaacgagaccuggaagcucgcgcgcgccuccuucaucgaggucaagacgugcaucuggcccaagagccacacccugugguccaacggcgugcuggagagcgagaugaucauccccaagaucuacgggggcccgaucucccagcacaacuaccggcccggguacuucacccagaccgccggccccuggcaccucgggaagcuggagcuggacuucgaccucugcgagggcacgaccguggucguggacgagcacugcggcaaccgcgggccgagccugcggaccaccacggugaccggcaagaucauccacgaguggugcugccgcuccugcacccugccgccccuccgguucaagggggaggacggcugcugguacgggauggagauccgccccgucaaggagaaggaggagaaccuggucaagagcauggugagcgccggcuccggcgaggucgacagcuucucccuggggcuccugugcaucagcaucaugaucgaggaggugaugcggucccgcuggagccggaagaugcugaugaccggcacgcucgccguguuccugcugcucaucauggggcagcugaccuggaacgaccugauccgccucugcaucauggucggcgcgaacgccuccgaccggauggggaugggcaccaccuaccuggcccugauggccacguucaagaugcgcccgauguucgccguggggcuccuguuccgccggcugaccagccgcgaggugcuccugcugaccaucgggcucucccuggucgcgagcguggagcugcccaacucccucgaggagcugggcgacgggcuggccaugggcaucaugauccucaagcugcugaccgacuuccagagccaccagcucugggccacgcugcugucccucaccuucaucaagaccaccuucagccugcacuacgccuggaagacgauggcgaugguccuguccaucgugagccucuucccccugugccuguccaccaccagccagaagaccacguggcuccccgugcugcugggcucccucgggugcaagccgcugaccauguuccugaucgccgagaacaagaucuggggccgcaagagcuggccccucaacgaggggaucauggccgucggcaucgugagcauccugcuguccagccuccugaagaacgacgugccccuggccgggccccucaucgccggcggcaugcugaucgcgugcuacgucaucuccgggagcuccgccgaccugagccucgagaaggccgccgagguguccugggaggaggaggccgagcacagcggcgcgucccacaacauccugguggagguccaggacgacgggaccaugaagaucaaggacgaggagcgcgacgacacccugaccauccuccugaaggccacgcugcucgccgugagcggcguguacccgcuguccauccccgccacccuguucgucugguacuucuggcagaagaagaagcagcggagcggggugcucugggacacccccagcccgcccgagguggagcgcgccguccuggacgacggcaucuaccggaucaugcagcgcggccugcuggggcggagccaggugggcgugggggucuuccaggagaacguguuccacaccauguggcacgugacgcgcggcgcgguccucauguaccaggggaagcggcuggagcccuccugggccagcgugaagaaggaccugaucuccuacggcggcggguggcgccuccagggcagcuggaacaccggggaggaggugcaggucaucgccguggagcccggcaagaaccccaagaacgugcagaccgcccccgggaccuucaagacguccgagggcgaggucggcgccaucgcgcuggacuucaagcccgggaccagcggcagccccaucgugaaccgggaggggaagaucgugggccuguacggcaacggggucgugaccaccuccggcacguacgugagcgccaucgcccaggccaaggcgucccaggaggggccccucccggagaucgaggacgaggucuuccgcaagcggaaccugaccaucauggaccugcaccccggcagcgggaagacccgccgguaccuccccgccaucgugcgcgaggccaucaagcggaagcugcgcacccugauccucgccccgacgcggguggucgccuccgagauggcggaggcccugaagggcaugcccauccgcuaccagaccaccgccgugaagggcgagcacaccgggaaggagaucguggaccugaugugccacgccacguucaccaugcgccuccugagccccguccgggugcccaacuacaacaugaucaucauggacgaggcccacuucaccgacccguccagcaucgcggcccgcggcuacaucuccacccggguggggaugggcgaggccgccgccaucuucaugacggcgacgccgcccgggagcgucgaggccuucccccaguccaacgccgugauccaggacgaggagcgcgacaucccggagcggagcuggaacuccggcuacgaguggaucaccgacuuccccggcaagaccgugugguucguccccagcaucaaguccgggaacgacaucgccaacugccugcgcaagaacggcaagcgggugauccagcucagccgcaagacguucgacaccgaguaccagaagaccaagaacaacgacugggacuacguggucaccacggacaucuccgagaugggggcgaacuuccgggccgaccgcgugaucgacccccggcgcugccugaagccggugauccugaaggacggccccgagcgggucauccucgccgggcccaugcccgugaccgucgccagcgccgcgcagcgccggggccgcaucggccggaaccacaacaaggagggggaccaguacaucuacaugggccagccgcugaacaacgacgaggaccacgcccacuggaccgaggccaagaugcugcucgacaacaucaacacccccgaggggaucauccccgcccuguucgagcccgagcgcgagaaguccgccgcgaucgacggcgaguaccggcugcgcggggaggcccgcaagacguucguggagcucaugcggcgcggcgaccugccgguguggcugagcuacaaggucgccagcgagggcuuccaguacuccgaccggcgcuggugcuucgacggggagcggaacaaccaggugcucgaggagaacauggacguggagaucuggaccaaggagggcgagcgcaagaagcugcggccccgcuggcuggacgcccggaccuacagcgacccccucgcccugcgcgaguucaaggaguucgcggccgggcggcgcuccgucagcggcgaccugauccucgagaucggcaagcugccccagcaccugacccagcgggcccagaacgcccucgacaaccuggugaugcugcacaacuccgagcagggcgggcgcgcguaccggcacgccauggaggagcucccggacacgaucgagacccugaugcugcucgcccugaucgccgugcugaccgggggcgucacccucuucuuccugagcgggcgcggccugggcaagaccuccaucgggcuccugugcgugauggccagcuccgcgcugcucuggauggccagcguggagccccacuggaucgccgccuccaucauccuggaguucuuccugaugguccuccugauccccgagcccgaccggcagcgcacgccgcaggacaaccagcuggccuacguggugaucggccuccuguucaugauccugaccgucgcggccaacgagauggggcuccuggagaccaccaagaaggaccugggcaucgggcacguggccguggagaaccaccaccacgccgccaugcucgacgucgaccugcaccccgcgagcgccuggacgcuguacgccguggccaccaccaucaucacccccaugaugcggcacacgaucgagaacaccaccgccaacaucucccucaccgcgaucgccaaccaggccgccauccugaugggccuggacaagggcuggccgaucagcaagauggacaucggggugccccuccuggcgcugggcugcuacucccaggucaacccccucacgcugaccgccgccgugcugaugcucguggcccacuacgccaucaucgggcccggccugcaggcgaaggccacccgcgaggcccagaagcggaccgccgccgggaucaugaagaacccgacggucgacggcaucguggcgaucgaccuggaccccguggucuacgacgccaaguucgagaagcagcucggccagaucaugcugcuggugcucugcaccagccagauccugcugaugcgcaccaccugggcccucugcgaguccaucacgcuggccaccgggccccugaccacccucugggagggcagccccgggaaguucuggaacacgaccaucgccguguccauggcgaacaucuuccgcggcagcuaccuggccggcgccgggcuggccuucagccucaugaagucccugggcgggggccggcgcgggaccggcgcgcagggcgagacccugggggagaaguggaagcggcagcucaaccagcugagcaaguccgaguucaacacguacaagcgcagcggcaucauggaggucgaccgguccgaggccaaggaggggcugaagcgcggcgagaccaccaagcacgccgugagccgggggaccgccaagcuccgcugguucguggagcggaaccuggucaagccggagggcaaggugaucgaccugggcugcgggcgcggcgggugguccuacuacugcgccggccugaagaaggugacggaggucaagggguacaccaagggcggccccgggcacgaggagcccauccccauggcgaccuacggcuggaaccucgugaagcugcacagcgggaaggacguguucuucaucccgcccgagaagugcgacacccugcucugcgacaucggcgaguccagccccaaccccacgaucgaggaggggcggacccugcgcguccugaagaugguggagccguggcuccggggcaaccaguucugcaucaagauccugaaccccuacaugcccuccguggucgagacccuggagcagaugcagcgcaagcacggcgggaugcucgugcggaacccccugagccgcaacuccacccacgagauguacugggugagcugcggcaccgggaacaucgucuccgccgugaacaugacgagccggaugcugcucaaccgcuucaccauggcccaccggaagccgaccuacgagcgcgacguggaccugggcgccggcacccgccacgucgccguggagcccgagguggcgaaccuggacaucaucgggcagcggaucgagaacaucaagcacgagcacaaguccacguggcacuacgacgaggacaaccccuacaagaccugggccuaccacggcagcuacgaggccaagcccuccgggagcgccagcuccauggucaacggcguggucaagcuccugaccaagccgugggacgugauccccauggugacccagaucgccaugacggacaccacccccuucgggcagcagcgcgucuucaaggagaagguggacacccggacgcccaaggcgaagcgcggcaccgcccagaucauggaggugaccgccaaguggcuguggggcuuccucagccggaacaagaagccgcgcaucugcacccgggaggaguucacgcgcaagguccgguccaacgccgcgaucggggccguguucguggacgagaaccaguggaacagcgccaaggaggccgucgaggacgagcgcuucugggaccuggugcaccgggagcgcgagcugcacaagcagggcaagugcgcgaccugcguguacaacaugauggggaagcgggagaagaagcucggcgaguucgggaaggcgaagggcucccgcgccaucugguacauguggcugggcgcccgguuccuggaguucgaggcccucggguucaugaacgaggaccacugguucagccgcgagaacucccugagcggcgucgagggggagggccugcacaagcucggguacauccugcgggacaucuccaagauccccggcggcaacauguacgccgacgacaccgcggggugggacacccgcaucacggaggacgaccugcagaacgaggccaagaucaccgacaucauggagcccgagcacgcccuccuggccaagagcaucuucaagcugaccuaccagaacaagguggugcggguccagcgcccggccaagaacggcaccgugauggacgugaucucccggcgcgaccagcgcgggagcggccaggucggcacguacgggcucaacaccuucaccaacauggaggcgcagcugauccggcagauggaguccgaggagaucuucagccccuccgagcuggagacccccaaccucgccggccgcgugcuggacuggcuggagaagcacgggguggagcggcucaagcgcauggccaucagcggcgacgacugcgucgugaagcccaucgacgaccgguucgccacggcccugaccgcgcugaacgacauggggaaggugcgcaaggacaucccgcagugggagcccuccaagggcuggaacgacuggcagcagguccccuucugcagccaccacuuccaccagcucaucaugaaggacggccgggagaucguggugcccugccgcaaccaggacgagcuggucgggcgggcccgcgugagccagggcgccggguggucccugcgggagaccgccugccucggcaagagcuacgcgcagauguggcagcugauguacuuccaccgccgggaccugcgccucgccgccaacgccaucugcuccgccgugccggucgacugggugcccaccagccggacgaccugguccauccacgcgcaccaccaguggaugaccaccgaggacaugcugagcguguggaaccgcgucuggaucgaggagaaccccuggauggaggacaagacgcacaucuccagcuggggcgacgugcccuaccugggcaagcgggaggaccaguggugcggcucccucaucgggcugaccgcccgcgccaccugggccaccaacauccagguggccaucaaccagguccggcgccugaucggcaacgagaacuaccucgacuacaugaccagcaugaagcgcuucaagaacgaguccgacccggagggggcgcugugguga

SEQ ID NO: 8398 - RNA, 9879 nt, Artificial Sequence
  derived and/or modified CDS sequence (opt1) from DENV-1__FJ547065__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacacgaugaccuacaagugcccccggaucaccgagaccgagcccgacgacguggacugcuggugcaacgccacggacaccugggugaccuacgggaccugcagccagacgggcgagcaccggcgcgacaagcgguccguggcccucgcgccccacgugggccuggggcuggagacccgcaccgagaccuggaugagcuccgagggcgcguggaagcagauccagcgggucgagacgugggcccuccgccaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagguggccgagacccagcacggcaccgugcugguccagaucaaguacgagggcaccgacgcgcccugcaagauccccuucagcacgcaggacgagaagggggugacccagaacggccggcugaucaccgccaacccgaucgugaccgacaaggagaagcccgucaacaucgaggccgagccgcccuucggggaguccuacaucgugaucggcgccggcgagaaggcgcugaagcucagcugguucaagaagggguccagcaucggcaagauguucgaggccacggcccgcggggcccggcgcauggccauccugggcgacaccgcgugggacuucggguccaucggcggcguguucaccagcgucgggaagcuggugcaccagaucuucggcaccgccuacggggugcuguucuccggcgucagcuggacgaugaagaucgggaucggcgugcugcugaccuggcucggccugaacucccgcagcaccucccugagcaugaccugcaucgccguggggcucgucacgcuguaccugggcgugauggugcaggccgacuccgggugcgucaucaacuggaagggccgggagcucaagugcgggagcggcaucuucgugaccaacgaggugcacaccuggaccgagcaguacaaguuccaggccgacagcccgaagcgccuguccgcggccaucggcaaggccugggaggagggggucugcggcauccggagcgccacccgccuggagaacaucauguggaagcagaucuccaacgagcucaaccacauccugcuggagaacgacaugaaguucacggugguggucggggacguggccggcauccucgcgcaggggaagaagaugauccggccccagcccauggaguacaaguacagcuggaaguccuggggcaaggccaagaucaucggcgccgacgugcagaacaccaccuucaucaucgacgggcccaacaccccggagugccccgacgaccugcgcgccuggaacaucugggaggucgaggacuacggcuucgggaucuucacgaccaacaucuggcugaagcuccgggacagcuacacccaggugugcgaccaccgccugauguccgcggccaucaaggacagcaaggccgugcacgccgacaugggcuacuggaucgaguccgagaagaacgagaccuggaagcuggcccgggcgagcuucaucgaggucaagacgugcaucuggcccaagucccacacccucuggagcaacggcgugcuggaguccgagaugaucauccccaagaucuacgggggcccgaucagccagcacaacuaccgccccggguacuucacccaggccgccggccccuggcaccuggggaagcucgagcuggacuucgaccugugcgagggcaccacgguggucguggacgagcacugcggcaaccgggggccgucccuccgcaccaccaccgugacgggcaagaucauccacgaguggugcugccggagcugcacccugccgccccugcgcuuccgcggggaggacggcugcugguacgggauggagauccgccccgucaaggagaaggaggagaaccucgugaaguccauggugagcgccggcagcggcgaggucgacuccuucagccuggggcugcucugcaucuccaucaugaucgaggaggugaugcggagccgcuggucccggcgcaugcugaugaccggcacccuggccguguucuuccuccugaucauggggcagcugacguggaacgaccucauccgccugugcaucauggucggcgcgaacgccagcgaccggauggggaugggcaccaccuaccuggcccucauggccaccuucaagaugcgcccgauguucgccgugggccugcuguuccggcgccucacgucccgggaggugcugcugcucaccaucgggcugagccuggucgcguccguggagcuccccaacagccuggaggagcugggcgacgggcucgccaugggcaucaugauccugaagcugcucaccgacuuccagucccaccagcugugggccacccugcucagccugacguucaucaagaccaccuucucccugcacuacgccuggaagaccauggcgaugguccucagcaucgugucccuguucccccugugccucagcacgaccucccagaagaccaccuggcugcccgugcugcucggcagccuggggugcaagccgcugacgauguuccucaucgccgagaacaagaucuggggccgccgguccuggccccugaacgaggggaucauggccgucggcaucgugagcauccugcucagcucccugcugaagaacgacgugccccucgccgggccccugaucgccggcggcaugcugaucgcgugcuacgucaucagcggguccagcgccgaccucucccuggagaaggccgccgaggugagcugggaggaggaggccgagcacuccggcgcgagccacaacauccugguggagguccaggacgacgggaccaugaagaucaaggacgaggagcgcgacgacacccucaccauccugcugaaggccacccuccuggccguguccggcguguacccgcugagcauccccgccacccucuucgucugguacuucuggcagaagaagaagcagcgguccggggugcugugggacacccccagcccgcccgagguggagcgcgccguccuggacgacggcaucuaccggaucaugcagcgcggccugcucgggcggucccaggugggcgugggggucuuccaggagaacguguuccacaccauguggcacgugacccgcggcgcgguccugauguaccaggggaagcggcuggagcccagcugggccuccgugaagaaggaccucaucagcuacggcggcggguggcgccugcagggcuccuggaacacgggggaggaggugcaggucaucgccguggagcccggcaagaaccccaagaacgugcagaccgcccccgggaccuucaagacccccgagggcgaggucggcgccaucgcgcuggacuucaagcccgggacgagcggcucccccaucgugaaccgggaggggaagaucgugggccucuacggcaacggggucgugaccaccagcggcaccuacgugagcgccaucgcccaggccaaggcgucccaggaggggccgcugcccgagaucgaggacgaggucuuccgcaagcggaaccugacgaucauggaccuccaccccggcagcgggaagacccgccgguaccugccggccaucgugcgcgaggccaucaagcgcaagcugcggacccucauccuggcccccacccgcguggucgccuccgagauggcggaggcccugaagggcaugcccauccgguaccagacgaccgccgucaagagcgagcacaccggcaaggagaucguggaccucaugugccacgccaccuucacgaugcgccugcugucccccguccgggugccgaacuacaacaugaucaucauggacgaggcccacuucaccgaccccagcuccaucgcggcccgcggguacaucagcacccgggugggcaugggggaggccgccgccaucuucaugaccgcgacgccgcccggcuccgucgaggccuucccgcagagcaacgccgugauccaggacgaggagcgcgacauccccgagcgguccuggaacagcggguacgaguggaucaccgacuuccccggcaagaccgugugguucguccccuccaucaagagcggcaacgacaucgccaacugccuccgcaagaacgggaagcgggugauccagcugucccgcaagaccuucgacacggaguaccagaagacccggaacaacgacugggacuacguggucaccaccgacaucagcgagaugggcgcgaacuuccgcgccgaccgggugaucgacccgcgccggugccugaagcccgugauccucaaggacgggcccgagcgcgucauccuggccggccccaugccggugacggucgccuccgccgcgcagcggcgcgggcgcaucggccggaaccacaacaaggagggcgaccaguacaucuacauggggcagccccugaacaacgacgaggaccacgcccacuggaccgaggccaagaugcuccuggacaacaucaacacccccgagggcaucauccccgcccuguucgagccggagcgcgagaaguccgccgcgaucgacggggaguaccggcuccgcggcgaggcccggaagaccuucguggagcugaugcgccgcggggaccugcccguguggcucuccuacaaggucgccagcgagggcuuccaguacagcgaccgcaaguggugcuucgacggcgagcggaacaaccaggugcuggaggagaacauggacguggagaucuggacgaaggagggggagcgcaagaagcugcggccccgcuggcucgacgcccggaccuacuccgacccccuggcccugcgcgaguucaaggaguucgcggccggccggcgcagcgucuccggggaccucauccuggagaucggcaagcugccgcagcaccucacccagcgggcccagaacgcccuggacaaccuggugaugcuccacaacagcgagcagggcgggcgcgcguaccggcacgccauggaggagcugcccgacaccaucgagacgcugaugcuccuggcccugaucgccgugcucaccggcggggucacccuguucuuccuguccggccgcgggcucggcaagaccagcaucggccugcugugcgugauggccuccagcgugcuccuguggauggcguccgucgagccccacuggaucgccgccagcaucauccuggaguucuuccucauggugcugcugauccccgagccggaccggcagcgcacgccccaggacaaccagcucgccuacguggucaucgggcugcuguucaugauccucacgguggccgcgaacgagaugggccugcuggagaccaccaagaaggaccucgggaucggccacguggccgucgagaaccaccaccacgccgccaugcuggacguggaccugcaccccgccuccgcguggacccucuacgccguggccacgaccaucaucaccccgaugaugcgccacaccaucgagaacacgaccgccaacaucagccugaccgccaucgcgaaccaggccgccauccugauggggcucgacaagggcuggcccaucuccaagauggacaucggcgucccccugcuggcccucgggugcuacagccaggugaacccccugacccugacggcggccgugcucaugcuggucgcccacuacgccaucaucggcccggggcugcaggccaaggcgacccgggaggcccagaagcgcaccgccgccggcaucaugaagaaccccaccguggacgggaucguggccaucgaccucgaccccgucguguacgacgcgaaguucgagaagcagcugggccagaucaugcugcucauccugugcacgucccagauccugcucaugcggaccaccugggcccugugcgagagcaucacccuggccacgggcccccucaccacccugugggagggguccccgggcaaguucuggaacaccacgaucgccgugagcauggccaacaucuuccgcggguccuaccuggcgggcgccggccucgccuucagccugaugaagucccucgggggcgggcggcgcgggaccggggcccagggcgagacccucggcgagaaguggaagcggcagcugaaccagcuguccaagagcgaguucaacaccuacaagcgcuccgggaucauggaggucgaccggagcgaggcgaaggagggccucaagcgcggggagacgaccaagcacgccgugucccggggcaccgccaagcugcgcugguucguggagcggaaccuggucaagcccgaggggaaggugaucgaccugggcugcggccgcgggggcuggagcuacuacugcgccgggcucaagaaggugaccgaggucaagggcuacacgaagggcggccccggccacgaggagcccaucccgauggccaccuacggguggaaccuggugaagcugcacuccggcaaggacguguucuucaucccgcccgagaagugcgacacccuccugugcgacaucggggagagcucccccaacccgaccaucgaggagggccggacgcugcgcguccucaagaugguggagcccuggcugcgggggaaccaguucugcaucaagauccugaaccccuacaugcccagcguggucgagacccucgagcagaugcagcgcaagcacggcggcaugcuggugcggaacccgcugucccgcaacagcacccacgagauguacuggguguccugcgggaccggcaacaucgucagcgcggugaacaugaccucccgcaugcuccugaaccgguucacgauggcccaccgcaagcccaccuacgagcgggacguggaccugggggccggcacccgccacgucgccguggagcccgagguggccaaccucgacaucaucggccagcggaucgagaacaucaagcacgagcacaagagcaccuggcacuacgacgaggacaaccccuacaagacgugggcguaccacggguccuacgaggucaagccgagcggcuccgccagcagcauggugaacggggucgugaagcugcugaccaagcccugggacgugauccccauggucacccagaucgccaugaccgacacgacccccuucggccagcagcgcguguucaaggagaagguggacacccggaccccgaaggccaagcgcgggacggcccagaucauggaggucaccgcgaaguggcucuggggcuuccugucccggaacaagaagccccgcaucugcacccgggaggaguucacccgcaaggugcggagcaacgccgccaucggcgccguguucgucgacgagaaccaguggaacuccgcgaaggaggccguggaggacgagcgcuucugggaccuggugcaccgggagcgcgagcuccacaagcaggggaagugcgccacgugcgucuacaacaugaugggcaagcgggagaagaagcugggggaguucggcaaggccaaggggagccgcgccaucugguacauguggcugggcgcgcgguuccucgaguucgaggcccugggcuucaugaacgaggaccacugguucucccgcgagaacagccuguccgggguggagggcgaggggcuccacaagcugggcuacauccugcgggacaucagcaagauccccgggggcaacauguacgccgacgacaccgccggcugggacacccgcaucaccgaggacgaccuccagaacgaggcccgcaucacggacaucauggagccggagcacgcgcugcuggccaaguccaucuucaagcucaccuaccagaacaaggugguccgggugcagcgccccgccaagaacgggaccgugauggacgucaucagccggcgcgaccagcggggcuccggccagguggggaccuacggccugaacacguucaccaacauggaggcccagcugauccgccagauggagagcgaggggaucuucucccccagcgagcucgagacccccaaccuggccgagcgggugcuggacuggcucgagaaguacggcgucgagcgccugaagcggauggcgaucuccggggacgacugcguggugaagccgaucgacgaccgcuucgccaccgcccugacggcccucaacgacaugggcaagguccggaaggacaucccccagugggagcccagcaagggguggaacgacuggcagcagguccccuucugcucccaccacuuccaccagcugaucaugaaggacggccgcgagaucguggucccgugccggaaccaggacgagcuggugggccgcgcccgggugagccagggggcgggcuggagccuccgcgagaccgccugccuggggaaguccuacgcccagauguggcagcugauguacuuccaccggcgcgaccuccggcuggccgcgaacgccaucugcagcgccguccccguggacuggauccccaccucccgcaccacguggagcauccacgcccaccaccaguggaugaccaccgaggacaugcuguccguguggaaccgcgucuggaucgaggagaaccccuggauggaggacaagacccacaucagcuccuggggcgacgugccguaccucgggaagcgggaggaccaguggugcggcagccugaucggccugacggcccgcgcgaccugggccaccaacauccagguggccaucaaccagguccggcgccucaucgggaacgagaacuaccuggacuacaugaccuccaugaagcgguucaagaacgagagcgaccccgagggcgcccugugguga

SEQ ID NO: 8399 - RNA, 9879 nt, Artificial Sequence
  derived and/or modified CDS sequence (opt1) from DENV-1__FJ410230__SS-prME
agcgugaccaugcugcucaugcugaugcccaccgcccuggccuuccaccucaccacccggggcggggagccccacaugaucgugagcaagcaggagcggggcaagagccugcuguucaagaccuccgccggggugaacaugugcacccucaucgccauggaccugggcgagcugugcgaggacacgaugaccuacaagugcccccggaucaccgagaccgagcccgacgacguggacugcuggugcaacgccacggacaccugggucaccuacgggaccugcagccagacgggcgagcaccggcgcgacaagcgguccguggcccucgcgccccacgugggccuggggcuggagacccgcaccgagaccuggaugagcuccgagggcgcguggaagcagauccagcgggucgagacgugggcccuccgccaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaucggggccaccgagauccagaccuccggcaccacgaccaucuucgccgggcaccugaagugccgccucaagauggacaagcugacccugaagggcaugagcuacgucaugugcaccggguccuucaagcucgagaaggagcuggccgagacgcagcacggcaccgugcuggugcagaucaaguacgagggcaccgacgcgcccugcaagauccccuucagcacccaggacgagaagggggucacgcagaacggccggcugaucaccgccaacccgaucgugaccgacaaggagaagcccgugaacaucgaggccgagccgcccuucggggaguccuacaucgucaucggcgccggcgagaaggcgcucaagcugagcugguucaagaagggguccagcaucggcaagauguucgaggccaccgcccgcggggcccggcgcauggccauccugggcgacacggcgugggacuucggguccaucggcggcguguucaccagcguggggaagcucguccaccagaucuucggcaccgccuacggggugcuguucuccggcgugagcuggaccaugaagaucgggaucggcguccugcucacguggcugggccugaacucccgcagcaccucccucagcaugaccugcaucgccguggggcuggugacccuguaccucggcgucauggugcaggccgacuccgggugcgugaucaacuggaagggccgggagcugaagugcgggagcggcaucuucgucacgaacgaggugcacaccuggaccgagcaguacaaguuccaggccgacagcccgaagcgccuguccgcggccaucggcaaggccugggaggagggggugugcggcauccggagcgccacccgccucgagaacaucauguggaagcagaucuccaacgagcugaaccacauccugcucgagaacgacaugaaguucaccgucguggugggggacgucgccggcauccuggcgcaggggaagaagaugauccggccccagcccauggagcacaaguacagcuggaaguccuggggcaaggccaagaucaucggcgccgacgugcagaacacgaccuucaucaucgacgggcccaacaccccggagugccccgacgaccagcgcgccuggaacaucugggagguggaggacuacggcuucgggaucuucaccacgaacaucuggcugaagcuccgggacagcuacacccaggucugcgaccaccgccugauguccgcggccaucaaggacagcaaggccgugcacgccgacaugggcuacuggaucgaguccgagaagaacgagaccuggaagcuggcccgggcgagcuucaucgaggugaagaccugcaucuggcccaagucccacacgcucuggagcaacggcguccuggaguccgagaugaucauccccaagaucuacgggggcccgaucagccagcacaacuaccgccccggguacuucacccagaccgccggccccuggcaccuggggaagcucgagcuggacuucgaccugugcgagggcaccacggugguggucgacgagcacugcggcaaccgggggccgucccuccgcaccaccaccgugacgggcaagaucauccacgaguggugcugccggagcugcacccugccgccccugcgcuuccgcggggaggacggcugcugguacgggauggagauccgccccgugaaggagaaggaggagaaccucgucaaguccauggugagcgccggcagcggcgagguggacuccuucagccuggggcugcucugcaucuccaucaugaucgaggaggucaugcggagccgcuggucccggaagaugcugaugaccggcacccuggccguguucuuccuccugaucauggggcagcugacguggaacgaccucauccgccugugcaucauggugggcgccaacgcgagcgaccgcauggggaugggcaccaccuaccuggcccucauggccaccuucaagaugcggccgauguucgccgucggccugcuguuccgccggcucacgucccgcgaggugcugcugcucaccaucgggcugagccugguggccuccgucgagcuccccaacagccuggaggagcugggcgacgggcucgcgaugggcaucaugauccugaagcugcucaccgacuuccagucccaccagcugugggccacccugcucagccugacguucaucaagaccaccuucucccugcacuacgccuggaagaccauggccauggugcucagcaucgucucccuguucccccugugccucagcacgaccucccagaagaccaccuggcugcccgugcugcucggcagccuggggugcaagccgcugacgauguuccucaucgcggagaacaagaucuggggccggcgcuccuggccccugaacgaggggaucauggccgugggcaucgucagcauccugcucagcucccugcugaagaacgacgugccccucgccgggccccugaucgccggcggcaugcugaucgccugcuacgugaucagcggguccagcgcggaccucucccuggagaaggccgccgaggucagcugggaggaggaggccgagcacuccggcgccagccacaacauccugguggaggugcaggacgacgggaccaugaagaucaaggacgaggagcgggacgacacccucaccauccugcugaaggcgacccuccuggccgucuccggcguguacccgcugagcauccccgccacccuguucgugugguacuucuggcagaagaagaagcagcgcuccgggguccugugggacacccccagcccgcccgagguggagcgggccgugcuggacgacggcaucuaccgcaucaugcagcggggccugcucgggcgcucccaggucggcguggggguguuccaggagaacgucuuccacaccauguggcacgugacccggggcgccgugcugauguaccaggggaagcgccuggagcccagcugggcguccgucaagaaggaccucaucagcuacggcggcggguggcggcugcagggcuccuggaacacgggggaggagguccaggugaucgccgucgagcccggcaagaaccccaagaacgugcagaccgcccccgggaccuucaagacccccgagggcgaggugggcgccaucgcccuggacuucaagcccgggacgagcggcucccccaucgucaaccgcgaggggaagaucgugggccucuacggcaacgggguggucaccaccagcggcaccuacgugagcgcgaucgcccaggccaaggccucccaggaggggccgcugcccgagaucgaggacgagguguuccggaagcgcaaccugacgaucauggaccuccaccccggcagcgggaagacccggcgcuaccugccggcgaucguccgggaggccaucaagcgcaagcugcgcacccucauccuggcccccacccgggugguggccuccgagauggccgaggcgcugaagggcaugcccauccgcuaccagacgaccgccgucaagagcgagcacaccggcaaggagaucguggaccucaugugccacgccaccuucacgaugcggcugcugucccccgugcgcgucccgaacuacaacaugaucaucauggacgaggcccacuucaccgaccccagcuccaucgccgcgcggggguacaucagcacccgcgugggcaugggggaggccgccgccaucuucaugaccgccacgccgcccggcuccguggaggcguucccgcagagcaacgccgucauccaggacgaggagcgggacauccccgagcgcuccuggaacagcggguacgaguggaucaccgacuuccccggcaagaccgugugguucgugcccuccaucaagagcggcaacgacaucgccaacugccuccggaagaacgggaagcgcgucauccagcugucccggaagaccuucgacacggaguaccagaagaccaagaacaacgacugggacuacguggugaccaccgacaucagcgagaugggcgccaacuuccgcgcggaccgggucaucgacccgcgccggugccugaagcccgugauccucaaggacgggcccgagcgcgugauccuggccggccccaugccggucacgguggccuccgccgcccagcggcgcgggcggaucggccgcaaccacaacaaggagggcgaccaguacaucuacauggggcagccccugaacaacgacgaggaccacgcgcacuggaccgaggccaagaugcuccuggacaacaucaacacccccgagggcaucauccccgcccuguucgagccggagcgcgagaaguccgccgccaucgacggggaguaccggcuccgcggcgaggcgcggaagaccuucgucgagcugaugcgccgcggggaccugcccguguggcucuccuacaagguggccagcgagggcuuccaguacagcgaccgccgguggugcuucgacggcgagcgcaacaaccagguccuggaggagaacauggacguggagaucuggacgaaggagggggagcggaagaagcugcgcccccgguggcucgacgcccgcaccuacuccgacccccuggcccugcgggaguucaaggaguucgccgcgggccgccggagcguguccggggaccucauccuggagaucggcaagcugccgcagcaccucacccagcgcgcccagaacgcccuggacaaccuggucaugcuccacaacagcgagcagggcgggcgggccuaccgccacgcgauggaggagcugcccgacaccaucgagacgcugaugcuccuggcccugaucgccgugcucaccggcggggugacccuguucuuccuguccggccgggggcucggcaagaccagcaucggccugcugugcgucauguccagcuccgugcuccuguggauggccagcguggagccccacuggaucgccgcguccaucauccuggaguucuuccucaugguccugcugauccccgagccggaccgccagcggacgccccaggacaaccagcucgccuacguggugaucgggcugcuguucaugauccucacggucgccgccaacgagaugggccugcuggagaccaccaagaaggaccucgggaucggccacguggccguggagaaccaccaccacgcggccaugcuggacgucgaccugcaccccgccagcgccuggacccucuacgccguggcgacgaccaucaucaccccgaugaugcgccacaccaucgagaacacgaccgccaacaucucccugaccgccaucgccaaccaggccgcgauccugauggggcucgacaagggcuggcccaucagccgcauggacaucggcgugccccugcuggcccucgggugcuacucccaggucaacccccugacccugacggccgccgugcucaugcugguggcgcacuacgccaucaucggcccggggcugcaggccaaggccacccgggaggcccagaagcgcaccgcggccggcaucaugaagaaccccaccgucgacgggaucguggccaucgaccucgaccccguggucuacgacgccaaguucgagaagcagcugggccagaucaugcugcucauccugugcacgagccagauccugcucaugcggaccaccugggcccugugcgaguccaucacccuggcgacgggcccccucaccacccugugggaggggagcccgggcaaguucuggaacaccacgaucgccguguccauggccaacaucuuccgcgggagcuaccuggccggcgccggccucgcguucagccugaugaagucccucgggggcgggcggcgcgggaccggggcccagggcgagacccucggcgagaaguggaagcggcagcugaaccagcugagcaaguccgaguucaacaccuacaagcgcagcgggaucauggagguggaccgguccgaggccaaggagggccucaagcgcggggagacgaccaagcacgccgucagccggggcaccgcgaagcugcgcugguucguggagcggaaccuggugaagcccgaggggaaggucaucgaccugggcugcggccgcgggggcugguccuacuacugcgccgggcucaagaaggugaccgaggugaagggcuacacgaagggcgggcccggccacgaggagcccaucccgauggccaccuacggguggaaccuggucaagcugcacagcggcaaggacguguucuucaucccgcccgagaagugcgacacccuccugugcgacaucggggaguccagccccaacccgaccaucgaggagggccggacgcugcgcgugcucaagauggucgagcccuggcugcgggggaaccaguucugcaucaagauccugaaccccuacaugcccuccgugguggagacccucgagcagaugcagcgcaagcacggcggcaugcugguccggaacccgcugagccgcaacuccacccacgagauguacugggugagcugcgggaccggcaacaucguguccgccgucaacaugaccagccgcaugcuccugaaccggcugacgauggcccaccgcaagcccaccuacgagcgggacguggaccucggggcgggcacccgccacguggccgucgagcccgagguggccaaccuggacaucaucggccagcggaucgagaacaucaagcacgagcacaaguccaccuggcacuacgacgaggacaaccccuacaagacgugggccuaccacgggagcuacgaggugaagccguccggcagcgccagcuccauggucaacgggguggucaagcugcucaccaagcccugggacgugauccccauggugacccagaucgcgaugaccgacacgacccccuucggccagcagcgcgucuucaaggagaagguggacacccggaccccgaaggccaagcgcgggacggcccagaucauggaggugaccgccaaguggcuguggggcuuccugagccggaacaagaagccccgcaucugcacccgggaggaguucacccgcaagguccgguccaacgccgcgaucggcgccguguucguggacgagaaccaguggaacagcgccaaggaggccgucgaggacgagcgcuucugggaccucgugcaccgggagcgcgagcugcacaagcaggggaagugcgcgacgugcguguacaacaugaugggcaagcgggagaagaagcugggggaguucggcaaggccaaggggucccgcgccaucugguacauguggcucggcgcccgguuccuggaguucgaggcccugggcuucaugaacgaggaccacugguucagccgcgagaacucccucagcggggucgagggcgaggggcugcacaagcugggcuacauccuccgggacaucuccaagauccccgggggcaacauguacgcggacgacaccgccggcugggacacccgcaucaccgaggacgaccugcagaacgaggcccgcaucacggacaucauggagccggagcacgcccugcucgccaagagcaucuucaagcugaccuaccagaacaagguggugcggguccagcgccccgcgaagaacgggaccgugauggacgugaucucccggcgcgaccagcggggcagcgggcaggucggcaccuacggccugaacacguucaccaacauggaggcccagcucauccgccagauggaguccgaggggaucuucagccccuccgagcuggagacccccaaccuggccgagcgggugcucgacuggcuggagaaguacggcguggagcgccugaagcggauggccaucagcggggacgacugcgucgugaagccgaucgacgaccgcuucgccaccgcgcucacggcccugaacgacaugggcaaggugcggaaggacaucccccagugggagcccuccaagggguggaacgacuggcagcagguccccuucugcagccaccacuuccaccagcugaucaugaaggacggccgcgagaucguggugccgugccggaaccaggacgagcucgucggccgcgcccgggugagccagggggccggcuggucccugcgcgagaccgccugccugggcaagagcuacgcgcagauguggcagcucauguacuuccaccggcgcgaccugcggcuggccgccaacgccaucugcuccgcggugcccgucgacuggauccccaccagccgcaccacgugguccauccacgcccaccaccaguggaugaccaccgaggacaugcucagcguguggaaccgcguguggaucgaggagaaccccuggauggaggacaagacccacaucuccagcuggggcgacgucccguaccuggggaagcgggaggaccaguggugcggcucccugaucggccucacggcccgcgccaccugggccaccaacauccagguggcgaucaaccaggugcggcgccugaucgggaacgagaacuaccuggacuacaugaccagcaugaagcgguucaagaacgaguccgaccccgagggcgcccucugguga

SEQ ID NO: 8400 - RNA, 9879 nt, Artificial Sequence
  derived and/or modified CDS sequence (opt1) from DENV-1__FJ410231__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccgcaucaccgagguggagcccgacgacguggacugcuggugcaacaccaccgacaccugggugaccuacgggaccugcagccagacgggcgagcaccggcgcgacaagcggagcguggcccucgcgccccacgucggccuggggcuggagacccgcgccgagaccuggaugagcuccgagggcgcguggaagcagauccagaagguggagaccugggcccuccggcaccccggguucacggugaucgcccuguuccuggcccacgcgaucggcaccagcaucacccagaaggggaucaucuucauccuccugaugcuggucacccccuccauggccaugcgcugcgugggcaucggcagccgggacuucguggaggggcucuccggcgccacgugggucgacguggugcuggagcacgggagcugcgucaccaccauggccaaggacaagcccacccuggacaucgagcuccugaagacggaggugaccaaccccgccgugcugcgcaagcucugcaucgaggcgaagaucuccaacaccaccacggacagccggugcccgacccagggcgaggccacccuggucgaggagcaggacgccaacuucgugugccgccggaccuucguggaccgcggcugggggaacggcugcgggcuguucggcaaggggucccucaucacgugcgccaaguucaagugcgucaccaagcuggagggcaagaucgugcaguacgagaaccugaaguacagcgugaucgucaccgugcacaccggcgaccagcaccaggucgggaacgaguccacggagcacggcaccaccgccaccaucacgccccaggcgcccacgagcgagauccagcucaccgacuacggggcccugacccuggacugcagcccccggaccggccucgacuucaacgagauggugcugcugacgaugaaggagaaguccuggcucgugcacaagcagugguuccuggaccugccccuccccuggaccagcggggccuccaccagccaggagaccuggaaccgccaggaccugcuggucacguucaagaccgcccacgccaagaagcaggagguggugguccucggcucccaggagggcgcgaugcacaccgcccugaccggggccacggagauccagaccagcggcaccaccacgaucuucgccgggcaccugaagugccggcucaagauggacaagcugacccugaagggcauguccuacgugaugugcaccgggagcuucaagcucgagaaggagguggccgagacccagcacggcacgguccuggugcagaucaaguacgagggcaccgacgcgcccugcaagauccccuucuccacccaggacgagaagggggugacccagaacggccgccugaucacggccaacccgaucgucaccgacaaggagaagcccgugaacaucgaggccgagccgcccuucggggagagcuacaucgugaucggcgccggcgagaaggcgcugaagcucuccugguucaagaaggggagcuccaucggcaagauguucgaggccaccgcccgcggggcccgccggauggccauccugggcgacaccgcgugggacuucgggagcaucggcggcgucuucacguccguggggaagcuggugcaccagaucuucggcaccgccuacgggguccucuucagcggcguguccuggaccaugaagaucgggaucggcgugcugcugaccuggcucggccugaacagccgcuccacgagccuguccaugaccugcaucgccgucgggcucgugacccuguaccugggcgugaugguccaggccgacagcgggugcgugaucaacuggaagggccgcgagcucaagugcgggagcggcaucuucgugaccaacgagguccacacguggaccgagcaguacaaguuccaggccgacuccccgaagcggcugagcgcggccaucggcaaggccugggaggagggggugugcggcauccgcuccgccacccggcuggagaacaucauguggcgccagaucagcaacgagcucaaccacauccugcuggagaacgacaugaaguucaccguggucgugggggacguggucggcauccucgcccaggggaagaagaugauccggccccagcccauggagcacaaguacuccuggaaguccuggggcaaggcgaagaucaucggcgccgacgugcagaacaccacguucaucaucgacgggcccaacaccccggagugccccgacgaccagcgcgccuggaacaucugggagguggaggacuacggcuucgggaucuucaccaccaacaucuggcugaagcugcgggacuccuacacgcaggucugcgaccaccgccucaugagcgccgcgaucaaggacuccaaggccgugcacgccgacaugggcuacuggaucgagagcgagaagaacgagaccuggaagcuggcccgggccuccuucaucgaggugaagaccugcaucuggcccaagagccacacccugugguccaacggcguccucgagagcgagaugaucauccccaagaucuacgggggcccgaucucccagcacaacuaccgccccggguacuucacgcagaccgcgggccccuggcaccuggggaagcuggagcucgacuucgaccugugcgagggcaccaccgugguggucgacgagcacugcggcaaccgggggccgagccugcgcacgaccaccgugaccggcaagaucauccacgaguggugcugccgguccugcacgcugccgccccuccgcuucaagggggaggacggcugcugguacgggauggagauccggcccgugaaggagaaggaggagaaccuggucaagagcauggugagcgccggcuccggcgagguggacagcuucucccucgggcugcugugcaucagcaucaugaucgaggaggucaugcgcucccgguggagccgcaagaugcucaugaccggcacccuggccguguucuuccugcucaucauggggcagcugaccuggaacgaccugauccgguccugcaucauggugggcgccaacgccagcgaccgcauggggaugggcacgaccuaccucgcgcugauggccaccuucaagaugcgcccgauguucgccgucgggcugcuguuccggcgccugaccucccgggaggugcugcuccugacgaucgggcugagccucgucgccuccguggagcugcccaacagccuggaggagcucggcgacgggcuggccaugggcaucaugauccugaagcuccugaccgacuuccaguccuaccagcugugggcgacccuccugagccugaccuucaucaagacgaccuucucccuccacuacgccuggaagaccauggccauggugcugagcaucgucucccugcucccccugugccugagcaccacgucccagaagaccaccuggcuccccgugcugcugggcagccucgggugcaagccgcugaccauguuccugaucgccgagaacaagaucuggggccgcaagagcuggccccucaacgaggggaucauggcggugggcaucgucuccauccugcugagcucccuccugaagaacgacgugccccuggccgggccccucaucgccggcggcaugcugaucgccugcuacgugaucagcggguccagcgccgaccugucccucgagaaggcggccgaggucagcugggaggaggaggccgagcacuccggcgccagccacaacauccugguggaggugcaggacgacgggacgaugaagaucaaggacgaggagcgggacgacacccugaccauccuccugaaggccacccugcucgcggucuccggcguguacccgcugagcauccccgccacccuguucgugugguacuucuggcagaagaagaagcagcgcuccgggguccucugggacacgcccagcccgcccgagguggagcgggccgugcuggacgacggcaucuaccgcaucaugcagcggggccugcuggggcgcucccaggucggcguggggguguuccaggagaacgucuuccacaccauguggcacgugacccggggcgccgugcucauguaccaggggaagcgccuggagcccagcugggccuccgucaagaaggaccugaucagcuacggcggcggguggcggcuccagggcuccuggaacaccggggaggagguccaggugaucgcggucgagcccggcaagaaccccaagaacgugcagacggcccccgggaccuucaagacccccgagggcgaggugggcgccaucgcccuggacuucaagcccgggaccagcggcagccccaucgucaaccgcgaggggaagaucgugggccuguacggcaacgggguggucacgaccuccggcaccuacgugagcgccaucgcgcaggccaaggccucccaggaggggccgcuccccgagaucgaggacgagguguuccggaagcgcaaccugaccaucauggaccugcaccccggcagcgggaagacgcggcgcuaccucccggccaucguccgggaggcgaucaagcgcaagcugcggacccugauccucgcccccacccgcgugguggccuccgagauggccgaggcccugaagggcaugcccauccgcuaccagaccacggcggucaagagcgagcacaccggccgggagaucguggaccugaugugccacgccaccuucaccaugcgccuccugucccccgugcgggucccgaacuacaacaugaucaucauggacgaggcccacuucacggaccccagcuccaucgccgcccgcggguacaucagcacccgggugggcaugggggaggcggccgccaucuucaugaccgccacgccgcccggcuccguggaggccuucccgcagagcaacgcggucauccaggacgaggagcgcgacauccccgagcgguccuggaacagcggguacgaguggaucacggacuuccccggcaagaccgugugguucgugcccuccaucaagagcggcaacgacaucgccaacugccugcgcaagaacgggaagcgggucauccagcucucccgcaagaccuucgacaccgaguaccagaagacgaagaacaacgacugggacuacguggugaccaccgacaucagcgagaugggcgccaacuuccgggccgaccgcgucaucgacccgcggcgcugccugaagcccgugauccugaaggacgggcccgagcgggucauccucgcgggccccaugccggugaccguggccuccgccgcccagcgccgggggcgcaucggccggaaccacaacaaggagggcgaccaguacaucuacauggggcagccccugaacaacgacgaggaccacgcccacuggacggaggcgaagaugcugcucgacaacaucaacacccccgagggcaucauccccgcccuguucgagccggagcgcgagaaguccgccgccaucgacggggaguaccgccugcggggcgaggcccgcaagaccuucgucgagcucaugcggcgcggggaccugcccguguggcugagcuacaagguggcguccgagggcuuccaguacagcgaccggcgcuggugcuucgacggcgagcggaacaaccagguccucgaggagaacauggacguggagaucuggaccaaggagggggagcgcaagaagcugcggccccgcuggcuggacgcccggacguacuccgacccccucgcccugcgcgaguucaaggaguucgccgccggccggcgcagcguguccggggaccugauccucgagaucggcaagcugccgcagcaccugacccagcgggcgcagaacgcccucgacaaccuggucaugcugcacaacagcgagcagggcgggcgcgccuaccggcacgccauggaggagcuccccgacaccaucgagacccugaugcugcucgcgcugaucgccgugcugacgggcggggugacccucuucuuccuguccggcaaggggcugggcaagaccagcaucggccuccugugcgucauggccuccagcgcccugcucuggauggccuccguggagccccacuggaucgcggccagcaucauccuggaguucuuccugauggugcuccugauccccgagccggaccgccagcggacgccccaggacaaccagcuggccuacgucgugaucgggcuccuguucaugauccugaccguggccgccaacgagaugggccuccuggagacgaccaagaaggaccuggggaucggccacgucgcgguggagaaccaccaccacgccaccaugcucgacguggaccugcaccccgccuccgccuggacccuguacgccgucgcgacgaccaucaucaccccgaugaugcgccacaccaucgagaacacgaccgccaacaucagccucaccgccaucgccaaccaggccgcgauccugauggggcuggacaagggcuggcccaucuccaagauggacaucggcgugccccuccuggcccuggggugcuacagccaggugaacccccucacccugacggccgccguccugaugcucguggcgcacuacgccaucaucggcccggggcugcaggccaaggccacccgggaggcccagaagcgcaccgcggccggcaucaugaagaaccccaccguggacgggaucgucgccaucgaccuggaccccgugguguacgacgccaaguucgagaagcagcucggccagaucaugcugcugauccucugcacgucccagauccugcugaugcgcaccaccugggcccucugcgagagcaucacccuggcgacgggcccccugaccacccucugggagggguccccgggcaaguucuggaacaccacgaucgccgucagcauggccaacaucuuccgggggagcuaccuggccggcgccggccuggcguucucccucaugaagucccucgggggcgggcgccgggggaccggggcccagggcgagacccugggcgagaaguggaagcgccagcucaaccagcuguccaagagcgaguucaacaccuacaagcgguccgggaucauggagguggaccgcagcgaggccaaggagggccugcggcgcggggagacgaccaagcacgccgugucccggggcaccgcgaagcuccgcugguucgucgagcggaaccuggugaagcccgaggggaaggugaucgaccugggcugcggccgcgggggcuggagcuacuacugcgccgggcugaagaaggucaccgaggugaagggcuacacgaagggcgggcccggccacgaggagcccaucccgauggccaccuacggguggaaccucgugaagcugcacuccggcaaggacgucuucuucaucccgcccgagaagugcgacacccugcucugcgacaucggggagagcucccccaacccgaccaucgaggagggccggacgcugcgcgugcugaagaugguggagcccuggcuccgggggaaccaguucugcaucaagauccugaaccccuacaugcccagcgucguggagacccuggagcagaugcagcgcaagcacggcggcaugcucgugcggaacccgcugucccgcaacagcacccacgagauguacugggucuccugcgggaccggcaacaucgugagcgccgugaacaugaccucccggaugcugcucaaccgcuucacgauggcccaccgcaagcccaccuacgagcgggacgucgaccugggggcgggcacccgccacguggccguggagcccgaggucgccaaccuggacaucaucggccagcggaucgagaacaucaagcacgagcacaagagcaccuggcacuacgacgaggacaaccccuacaagacgugggccuaccacggguccuacgaggugaagccgagcggcagcgccuccagcauggucaacgggguggugaagcuccugaccaagcccugggacgucauccccauggugacccagaucgcgaugaccgacacgacccccuucggccagcagcgcguguucaaggagaaggucgacacccggaccccgaaggccaagcgcgggacggcccagaucauggaggugaccgccaaguggcuguggggcuuccucucccggaacaagaagccccgcaucugcacccgggaggaguucacccgcaaggugcggagcaacgccgcgaucggcgccgucuucguggacgagaaccaguggaacuccgccaaggaggccguggaggacgagcgcuucugggaccugguccaccgggagcgcgagcugcacaagcaggggaagugcgcgacgugcguguacaacaugaugggcaagcgggagaagaagcucggggaguucggcaaggccaaggggagccgcgccaucugguacauguggcugggcgcccgguuccuggaguucgaggcccucggcuucaugaacgaggaccacugguucucccgcgagaacagccuguccgggguggagggcgaggggcugcacaagcucggcuacauccugcgggacaucagcaagauccccgggggcaacauguacgcggacgacaccgccggcugggacacccgcaucaccgaggacgaccugcagaacgaggccaagaucacggacaucauggagccggagcacgcccuccuggccaccuccaucuucaagcugaccuaccagaacaaggucgugcgggugcagcgccccgcgcgcaacgggaccgucauggacgugaucagccggcgcgaccagcggggcuccggccaggugggcacguacggccucaacaccuucaccaacauggaggcccagcugauccgccagauggagagcgaggggaucuucucccccagcgagcuggagacccccaaccucgccgagcggguccuggacuggcuggagaagcacggcguggagcgccucaagcggauggccaucuccggggacgacugcguggucaagccgaucgacgaccgcuucgccacggcgcugagcgcccugaacgacaugggcaaggugcggaaggacaucccccagugggagcccagcaagggguggaacgacuggcagcagguccccuucugcucccaccacuuccaccagcucaucaugaaggacggccgcgagaucgucgugccgugccggaaccaggacgagcuggugggccgcgcccgggucagccagggggccggcuggucccugcgcgagaccgccugccucggcaagagcuacgcgcagauguggcagcugauguacuuccaccggcgcgaccugcggcucgccgccaacgccaucugcuccgcggugcccguggacuggguccccaccagccgcaccacgugguccauccacgcccaccaccaguggaugaccaccgaggacaugcugagcguguggaaccggguguggaucgaggagaaccccuggauggaggacaagacccacaucuccagcuggggcgacgucccguaccuggggaagcgcgaggaccaguggugcggcucccucaucggccugacggcccgcgccaccugggccaccaacauccagguggcgaucaaccaggugcggcgccugaucgggaacgagaacuaccucgacuacaugaccagcaugaagcgguucaagaacgaguccgaccccgagggcgcccugugguga

SEQ ID NO: 8401 - RNA, 9879 nt, Artificial Sequence
  derived and/or modified CDS sequence (opt1) from DENV-1__FJ461323__SS-prME
agcgugaccaugcugcucaugcugaugcccaccgcccuggccuuccaccucaccacccgcggcggggagccccacaugaucgugagcaagcaggagcggggcaagagccugcuguucaagaccagcgcgggggugaacaugugcacccucaucgccauggaccugggcgagcugugcgaggacacgaugaccuacaagugcccccgcaucaccgaggccgagcccgacgacguggacugcuggugcaacgccaccgacacgugggugaccuacgggaccugcagccagaccggcgagcaccggcgcgacaagcgguccguggcccucgcgccccacgugggccuggggcuggagacgcgcaccgagaccuggaugagcuccgagggcgccuggaagcagauccagcgggucgagaccugggugcuccgccaccccggguucacggugaucgcccuguuccuggcccacgcgaucggcaccagcaucacccagaaggggaucaucuucauccuccugaugcuggucacccccuccauggccaugcggugcgugggcaucggcagccgcgacuucguggaggggcucuccggcgccacgugggucgacguggugcuggagcacgggagcugcgucaccaccauggccaaggacaagcccacccuggacaucgagcuccugaagacggaggugaccaaccccgccgugcugcggaagcucugcaucgaggcgaagaucuccaacaccaccacggacagccgcugcccgacccagggcgaggccacccuggucgaggagcaggacgccaacuucgugugccggcgcaccuucguggaccggggcugggggaacggcugcgggcuguucggcaaggggucccucaucacgugcgccaaguucaagugcgucaccaagcuggagggcaagaucgugcaguacgagaaccugaaguacagcgugaucgucaccgugcacaccggcgaccagcaccaggucgggaacgaguccacggagcacggcaccaccgccaccaucacgccccaggcgcccacgaccgagauccagcucaccgacuacggggcccugacccuggacugcagcccccgcacgggccucgacuucaacgagauggugcugcugaccaugaaggagaaguccuggcucgugcacaagcagugguuccuggaccugccccuccccuggaccagcggggccagcaccucccaggagacguggaaccggcaggaccugcuggucaccuucaagaccgcccacgccaagaagcaggagguggugguccucggcagccaggagggcgcgaugcacaccgcccugacgggggccaccgagauccagaccuccggcaccacgaccaucuucgccgggcaccugaagugccgccucaagauggacaagcugacccugaagggcaugagcuacgugaugugcaccggguccuucaagcucgagaaggagguggccgagacgcagcacggcaccguccuggugcagaucaaguacgagggcaccgacgcgcccugcaagauccccuucagcacccaggacgagaagggggugacgcagaacggccggcugaucaccgccaacccgaucgucaccgacaaggagaagcccgugaacaucgaggccgagccgcccuucggggaguccuacaucgugaucggcgccggcgagaaggcgcugaagcucagcugguucaagaagggguccagcaucggcaagauguucgaggccaccgcccgcggggcccggcgcauggccauccugggcgacacggcgugggacuucggguccaucggcggcgucuucaccagcguggggaagcuggugcaccagaucuucggcaccgccuacgggguccucuucuccggcgugagcuggaccaugaagaucgggaucggcgugcugcugacguggcucggccugaacucccgcagcaccucccugagcaugaccugcaucgccgucgggcucgugacccuguaccugggcgugaugguccaggccgacuccgggugcgugaucaacuggaagggccgggagcucaagugcgggagcggcaucuucgugacgaacgagguccacaccuggaccgagcaguacaaguuccaggccgacagcccgaagcgccuguccgcggccaucggcaaggccugggaggagggggugugcggcauccggagcgccacccgccuggagaacaucauguggaagcagaucuccaacgagcucaaccacauccugcuggagaacgacaugaagcucaccguggucgugggggacguggccggcauccuggggcagggcaagaagaugauccggccccagcccauggaguacaaguacagcuggaaguccuggggcaaggcgaagaucaucggggccgacgcccagaacacgaccuucaucaucgacggccccaacaccccggagugccccgacgaccagcgcgccuggaacaucugggaggucgaggacuacggguucggcaucuucaccacgaacaucuggcugaagcuccgggacagcuacacccaggugugcgaccaccgccugauguccgcggccaucaaggacagcaaggccgugcacgccgacaugggcuacuggaucgaguccgagaagaacgagaccuggaagcuggcccgggcgagcuucaucgaggucaagaccugcaucuggcccaagucccacacgcucuggagcaacggggugcuggaguccgagaugaucauccccaagaucuacggcgggccgaucagccagcacaacuaccgccccggcuacuucacccagaccgccgggcccuggcaccugggcaagcucgagcuggacuucgaccugugcgagggcaccacgguggucguggacgagcacugcgggaaccggggcccgucccuccgcaccaccaccgugacggggaagaucauccacgaguggugcugccggagcugcacccugccgccccugcgcuuccggggcgaggacgggugcugguacggcauggagauccgccccgucaaggagaaggaggagaaccucgugaaguccauggugagcgccggcagcggggaggucgacuccuucagccugggccugcucugcaucuccaucaugaucgaggaggugaugcggagccgcuggucccggaagaugcugaugaccgggacccuggccguguucuuccuccugaucaugggccagcugacguggaacgaccucauccgccugugcaucauggucggggccaacgcgagcgaccgcaugggcaugggcaccaccuaccuggcccucauggccaccuucaagaugcggccgauguucgccguggggcugcuguuccgccggcucacgucccgcgaggugcugcugcucaccaucggccugagccuggucgccuccguggagcuccccaacagccuggaggagcugggggacggccucgcgaugggcaucaugauccugaagcugcucaccgacuuccagucccaccagcugugggccacccugcucagccugacguucaucaagaccaccuucucccugcacuacgccuggaagaccauggccaugguccucagcaucgugucccuguucccccugugccucagcacgaccucccagaagaccaccuggcugcccgugcugcucgggagccugggcugcaagccgcugacgauguuccucaucgcggagaacaagaucugggggcggaaguccuggccccugaacgagggcaucauggccgucgggaucgugagcauccugcucagcucccugcugaagaacgacgugccccucgccggcccccugaucgccggcgggaugcugaucgccugcuacgucaucagcggcuccagcgcggaccucucccuggagaaggccgccgaggugagcugggaggaggaggccgagcacuccggggccagccacaacauccugguggagguccaggacgacggcaccaugaagaucaaggacgaggagcgcgacgacacccucaccauccugcugaaggcgacccuccuggccguguccgggguguacccgcugagcauccccgccacccucuucgucugguacuucuggcagaagaagaagcagcgguccggcgugcugugggacacccccagcccgcccgagguggagcgcgccguccuggacgacggcaucuaccggaucaugcagcgcgggcugcucggccggucccaggugggggugggcgucuuccaggagaacguguuccacaccauguggcacgugacccgcggggccguccugauguaccagggcaagcggcuggagcccagcugggcguccgugaagaaggaccucaucagcuacggcgggggcuggcgccugcggggguccuggaacacgggcgaggaggugcaggucaucgccguggagcccgggaagaaccccaagaacgugcagaccgcccccggcaccuucaagacccccgagggcgaggucggggccaucgcccuggacuucaagcccggcacgagcgggucccccaucgugaaccgcgagggcaagaucgugggccucuacgggaacggcgucgugaccaccagcgggaccuacgugagcgcgaucgcccaggccaaggccucccaggagggcccgcugcccgagaucgaggacgaggucuuccggaagcgcaaccugacgaucauggaccuccaccccgggagcggcaagacccggcgcuaccugccggcgaucgugcgggaggccaucaagcgcaagcugcgcacccucauccuggcccccacccggguggucgccuccgagauggccgaggcgcugaagggcaugcccauccgcuaccagacgaccgccgucaagagcgagcacaccgggaaggagaucguggaccucaugugccacgccaccuucacgaugcggcugcugucccccguccgcgugccgaacuacaacaugaucaucauggacgaggcccacuucaccgaccccagcuccaucgccgcgcggggcuacaucagcacccgcguggggaugggcgaggccgccgccaucuucaugaccgccacgccgcccggguccgucgaggcguucccgcagagcaacgccgugauccaggacgaggagcgggacauccccgagcgcuccuggaacagcggcuacgaguggaucaccgacuuccccggcaagaccgugugguucguccccuccaucaagagcgggaacgacaucgccaacugccuccggaagaacggcaagcgcgugauccagcugucccggaagaccuucgacacggaguaccagaagaccaagaacaacgacugggacuacguggucaccaccgacaucagcgagaugggggccaacuuccgcgcggaccgggugaucgacccgcgccggugccugaagcccgugauccucaaggacggccccgagcgcgucauccuggccgggcccaugccggugacggucgccuccgccgcccagcggcgcggccggaucggccgcaaccacaacaaggagggggaccaguacaucuacaugggccagccccugaacaacgacgaggaccacgcgcacuggaccgaggccaagaugcuccuggacaacaucaacacccccgaggggaucauccccgcccuguucgagccggagcgcgagaaguccgccgccguggacggcgaguaccggcuccgcggggaggcgcggaagaccuucguggagcugaugcgccggggcgaccugcccgucuggcucuccuacaagguggccagcgagggcuuccaguacagcgaccgccgguggugcuucgacggggagcgcaacaaccaggugcuggaggagaacauggacgucgagaucuggacgaaggagggcgagcggaagaagcugcgcccccgguggcucgacgcccgcaccuacuccgacccccuggcccugcgggaguucaaggaguucgccgcggggcgccggagcguguccggcgaccucauccuggagaucggcaagcugccgcagcaccucacccagcgcgcccagaacgcccuggacaaccuggugaugcuccacaacagcgagcagggcgggcgggccuaccgccacgcgauggaggagcugcccgacaccaucgagacgcugaugcuccuggcccugaucgccguccucaccgggggcgugacccuguucuuccuguccgggcggggccucggcaagaccagcaucgggcugcugugcgugauggccuccagcguccuccuguggauggccuccguggagccccacuggaucgcggccagcaucauccuggaguucuuccucauggugcugcugauccccgagccggaccgccagcggacgccccaggacaaccagcucgccuacgucgugaucggccugcuguucaugauccucacgguggccgccaacgagauggggcugcuggagaccaccaagaaggaccucggcaucgggcacgucgcgguggagaaccaccaccacgccgccaugcuggacguggaccugcaccccgccuccgccuggacccucuacgcggucgccacgaccaucaucaccccgaugaugcgccacaccaucgagaacacgaccgccaacaucagccugaccgccaucgccaaccaggcggccauccugaugggccucgacaagggcuggcccaucuccaagauggacaucggggugccccugcuggcccucggcugcuacagccaggugaacccccugacccugacggccgcgguccucaugcugguggcccacuacgccaucaucgggccgggccugcaggccaaggccacccgcgaggcgcagaagcggaccgccgccgggaucaugaagaaccccaccguggacggcaucgucgccaucgaccucgaccccgugguguacgacgccaaguucgagaagcagcugggccagaucaugcugcucauccugugcacgucccagauccugcucaugcgcaccaccugggcgcugugcgagagcaucacccuggccacggggccccucaccacccugugggagggcuccccggggaaguucuggaacaccacgaucgccgucagcauggccaacaucuuccggggcuccuaccuggccggcgcggggcucgccuucagccugaugaagucccugggcgggggccgccgggggaccggcgcccagggcgagacccucggggagaaguggaagcgccagcugaaccagcuguccaagagcgaguucaacaccuacaagcgguccggcaucauggagguggaccgcagcgaggccaaggaggggcucaagcggggcgagacgaccaagcacgcggugucccgcgggaccgccaagcugcggugguucgucgagcgcaaccuggugaagcccgagggcaaggugaucgaccugggcugcgggcggggcggguggagcuacuacugcgccggccucaagaaggucaccgaggugaagggguacacgaagggcggccccgggcacgaggagcccaucccgauggccaccuacggcuggaaccuggugaagcugcacuccgggaaggacgucuucuucaucccgcccgagaagugcgacacccuccugugcgacaucggcgagagcucccccaacccgaccaucgaggaggggcgcacgcugcgggugcucaagaugguggagcccuggcugcgcggcaaccaguucugcaucaagauccugaaccccuacaugcccagcgucguggagacccucgagcagaugcagcggaagcacggcgggaugcuggugcgcaacccgcugucccggaacagcacccacgagauguacugggucuccugcggcaccgggaacaucgugagcgccgugaacaugaccucccgcaugcuccugaaccgcuucacgauggcgcaccggaagcccaccuacgagcgcgacgucgaccugggcaccggcacccggcacguggccguggagcccgaggucgccaaccucgacaucaucgggcagcgcaucgagaacaucaagcacgagcacaagagcacguggcacuacgacgaggacaaccccuacaagaccugggccuaccacggcuccuacgaggugaagccgagcggguccgccagcagcauggucaacggcguggugaagcugcugaccaagcccugggacgucauccccauggugacccagaucgcgaugacggacaccacccccuucgggcagcagcggguguucaaggagaaggucgacacccgcacgccgaaggccaagcggggcaccgcccagaucauggaggugaccgcccgcuggcucuggggcuuccugucccggaacaagaagccccgcaucugcacccgggaggaguucacgcgcaaggugcggagcaacgccgcgaucggggccgucuucguggacgagaaccaguggaacuccgccaaggaggccguggaggacgagcgcuucugggaccugguccaccgggagcgcgagcuccacaagcagggcaagugcgcgaccugcguguacaacaugauggggaagcgggagaagaagcugggcgaguucgggaaggccaagggcagccgcgccaucugguacauguggcugggcgcccgguuccucgaguucgaggcccugggguucaugaacgaggaccacugguucucccgcgagaacagccuguccggcguggagggggagggccuccacaagcugggguacauccugcgggacaucagcaagauccccggcggcaacauguacgcggacgacaccgccgggugggacacccgcaucacggaggacgaccuccagaacgaggccaagaucaccgacaucauggagccggagcacgcccugcuggccaaggcgaucuucaagcucaccuaccagaacaaggucgugcgcgugcagcggcccgccaagaacggcaccgucauggacgugaucucccgccgggaccagcgcgggagcggccaggugggcacguacgggcugaacaccuucaccaacauggaggcccagcugauccggcagauggaguccgagggcaucuucagccccuccgagcucgagacccccaaccuggccgagcgcgcccuggacuggcucgagaaguacggggucgagcggcugaagcgcauggcgaucagcggcgacgacugcguggugaagccgaucgacgaccgguucgccacggcccugaccgcccucaacgacauggggaagguccgcaaggacaucccccagugggagcccuccaagggcuggaacgacuggcagcagguccccuucugcagccaccacuuccaccagcugaucaugaaggacggccgggagaucguggucccgugccgcaaccaggacgagcugguggggcgggcccgcgugucccagggcgcgggguggagccuccgggagaccgccugccugggcaagagcuacgcccagauguggcagcugauguacuuccaccgccgggaccuccgccuggccgcgaacgccaucugcuccgccguccccguggacugggugcccaccagccggacgaccugguccauccacgcccaccaccaguggaugaccaccgaggacaugcugagcgucuggaaccgcguguggaucgaggagaaccccuggauggaggacaagacgcacaucuccagcugggaggacgugccguaccucgggaagcgcgaggaccaguggugcggcucccugaucggccugaccgcccgggcgaccugggccaccaacauccaggucgccaucaaccaggugcgccggcucaucgggaacgagaacuaccuggacuacaugaccagcaugaagcgcuucaagaacgagacggaccccgagggcgcccugugguga

SEQ ID NO: 8402 - RNA, 9879 nt, Artificial Sequence
  derived and/or modified CDS sequence (opt1) from DENV-1__FJ461325__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccgcaucaccgagaccgagcccgacgacguggacugcuggugcaacgccacggacaccugggugaccuacgggaccugcagccagacgggcgagcaccggcgcgacaagcgguccguggcccucgcgccccacgugggccuggggcuggagacccgcaccgagaccuggaugagcuccgagggcgccuggaagcagauccagcgggucgagacgugggcccuccgccaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagguggccgagacccagcacggcaccgugcugguccagaucaaguacgagggcaccgacgcgcccugcaagauccccuucagcacgcaggacgagaagggggugacccagaacggccggcugaucaccgccaacccgaucgugaccgacaaggagaagcccgucaacaucgaggccgagccgcccuucggggaguccuacaucgugaucggcgccggcgagaaggcgcugaagcucagcugguucaagaagggguccagcaucggcaagauguucgaggccacggcccgcggggcccggcgcauggccauccugggcgacaccgcgugggacuucggguccaucggcggcguguucaccagcgucgggaagcuggugcaccagaucuucggcaccgccuacggggugcuguucuccggcgucagcuggacgaugaagaucgggaucggcgugcugcugaccuggcucggccugaacucccgcagcaccucccugagcaugaccugcaucgccguggggcucgucacgcuguaccugggcgugauggugcaggccgacuccgggugcgucaucaacuggaagggccgggagcucaagugcgggagcggcaucuucgugaccaacgaggugcacaccuggaccgagcaguacaaguuccaggccgacagcccgaagcgccuguccgcggccaucggcaaggccugggaggagggggucugcggcauccggagcgccacccgccuggagaacaucauguggaagcagaucuccaacgagcucaaccacauccugcuggagaacgacaugaaguucacggugguggucggggacguggccggcauccucgcgcaggggaagaagaugauccggccccagcccauggaguacaaguacagcuggaaguccuggggcaaggccaagaucaucggcgccgacgugcagaacaccaccuucaucaucgacgggcccaacaccccggagugccccgacgaccagcgcgccuggaacaucugggaggucgaggacuacggcuucgggaucuucacgaccaacaucuggcugaagcugcgggacagcuacacccaggugugcgaccaccgccucauguccgcggccaucaaggacagcaaggccgugcacgccgacaugggcuacuggaucgaguccgagaagaacgagaccuggaagcuggcccgggcgagcuucaucgaggucaagacgugcaucuggcccaagucccacacccuguggagcaacggcgugcucgaguccgagaugaucauccccaagaucuacgggggcccgaucagccagcacaacuaccgccccggguacuucacccaggccgccggccccuggcaccuggggaagcuggagcucgacuucgaccugugcgagggcaccacgguggucguggacgagcacugcggcaaccgggggccgucccugcgcaccaccaccgugacgggcaagaucauccacgaguggugcugccggagcugcacccugccgccccuccgcuuccgcggggaggacggcugcugguacgggauggagauccgccccgucaaggagaaggaggagaaccuggugaaguccauggugagcgccggcagcggcgaggucgacuccuucagccucgggcugcugugcaucuccaucaugaucgaggaggugaugcggagccgcuggucccggcgcaugcucaugaccggcacccuggccguguucuuccugcucaucauggggcagcugacguggaacgaccugauccgccucugcaucauggucggcgcgaacgccagcgaccggauggggaugggcaccaccuaccuggcccugauggccaccuucaagaugcgcccgauguucgccgugggccuccuguuccggcgccugacgucccgggaggugcuccugcugaccaucgggcucagccuggucgcguccguggagcugcccaacagccucgaggagcugggcgacgggcuggccaugggcaucaugauccucaagcugcugaccgacuuccagucccaccagcucugggccacccugcugagccucacguucaucaagaccaccuucucccugcacuacgccuggaagaccauggcgaugguccugagcaucgugucccucuucccccugugccugagcacgaccucccagaagaccaccuggcuccccgugcugcugggcagccucgggugcaagccgcugacgauguuccugaucaccgagaacaagaucuggggccgccgguccuggccccucaacgaggggaucauggccgucggcaucgugagcauccugcugagcucccuccugaagaacgacgugccccuggccgggccccucaucgccggcggcaugcugaucgccugcuacgucaucagcggguccagcgcggaccugucccucgagaaggccgccgaggugagcugggaggaggaggccgagcacuccggcgccagccacaacauccugguggagguccaggacgacgggaccaugaagaucaaggacgaggagcgcgacgacacccugaccauccuccugaaggcgacgcugcucgccguguccggcguguacccgcugagcauccccgccacccuguucgucugguacuucuggcagaagaagaagcagcgguccggggugcucugggacacccccagcccgcccgagguggagcgcgccguccuggacgacggcaucuaccggaucaugcagcgcggccugcuggggcggucccaggugggcgugggggucuuccaggagaacguguuccacaccauguggcacgugacgcgcggcgccguccucauguaccaggggaagcggcuggagcccagcugggcguccgugaagaaggaccugaucagcuacggcggcggguggcgccuccagggcuccuggaacaccggggaggaggugcaggucaucgccguggagcccggcaagaaccccaagaacgugcagaccgcccccgggaccuucaagacgcccgagggcgaggucggcgccaucgcccuggacuucaagcccgggaccagcggcucccccaucgugaaccgggaggggaagaucgugggccuguacggcaacggggucgugaccaccagcggcacguacgugagcgcgaucgcccaggccaaggccucccaggaggggccgcuccccgagaucgaggacgaggucuuccgcaagcggaaccugaccaucauggaccugcaccccggcagcgggaagacccgccgguaccucccggcgaucgugcgcgaggccaucaagcgcaagcugcggacccugauccucgcccccacgcgcguggucgccuccgagauggccgaggcgcugaagggcaugcccauccgguaccagaccaccgccgucaagagcgagcacaccggcaaggagaucguggaccugaugugccacgccacguucaccaugcgccuccugucccccguccgggugccgaacuacaacaugaucaucauggacgaggcccacuucaccgaccccagcuccaucgccgcgcgcggguacaucagcacccgggugggcaugggggaggccgccgccaucuucaugacggccacgccgcccggcuccgucgaggcguucccgcagagcaacgccgugauccaggacgaggagcgcgacauccccgagcgguccuggaacagcggguacgaguggaucaccgacuuccccggcaagaccgugugguucguccccuccaucaagagcggcaacgacaucgccaacugccugcgcaagaacgggaagcgggugauccagcucucccgcaagacguucgacaccgaguaccagaagaccaagaacaacgacugggacuacguggucaccacggacaucagcgagaugggcgccaacuuccgggcggaccgcgugaucgacccgcggcgcugccugaagcccgugauccugaaggacgggcccgagcgggucauccucgccggccccaugccggugaccgucgccuccgccgcccagcgccgggggcgcaucggccgcaaccacaacaaggagggcgaccaguacaucuacauggggcagccccugaacaacgacgaggaccacgcgcacuggaccgaggccaagaugcugcucgacaacaucaacacccccgagggcaucauccccgcccuguucgagccggagcgggagaaguccgccgccaucgacggggaguaccgccugcggggcgaggcgcgcaagacguucguggagcucaugcggcgcggggaccugcccguguggcuguccuacaaggucgccagcgagggcuuccaguacagcgaccggcgcuggugcuucgacggcgagcggaacaaccaggugcucgaggagaacauggacguggagaucuggaccaaggagggggagcgcaagaagcugcggccccgcuggcuggacgcccggaccuacuccgacccccucgcccugcgcgaguucaaggaguucgccgcgggccggcgcagcgucuccggggaccugauccucgagaucggcaagcugccgcagcaccugacccagcgggcccagaacgcccucgacaaccuggugaugcugcacaacagcgagcagggcgggcgcgccuaccggcacgcgauggaggagcuccccgacacgaucgagacccugaugcugcucgcccugaucgccgugcugaccggcggggucacccucuucuuccuguccggccgcgggcugggcaagaccagcaucggccuccugugcgugauggccuccagcgugcugcucuggauggccuccgucgagccccacuggaucgcggccagcaucauccuggaguucuuccugauggugcuccugauccccgagccggaccggcagcgcacgccccaggacaaccagcuggccuacguggucaucgggcuccuguucaugauccugaccguggccgccaacgagaugggccuccuggagaccaccaagaaggaccuggggaucggccacguggcggucgagaaccaccaccacgccgccaugcucgacguggaccugcaccccgccuccgccuggacgcuguacgcgguggccaccaccaucaucaccccgaugaugcgccacacgaucgagaacaccaccgccaacaucagccucaccgccaucgccaaccaggcggccauccugauggggcuggacaagggcuggcccaucuccaagauggacaucggcgucccccuccuggcccuggggugcuacagccaggugaacccccucacgcugaccgccgcggugcugaugcucgucgcccacuacgccaucaucggcccggggcugcaggccaaggccacccgggaggcgcagaagcgcaccgccgccggcaucaugaagaaccccacgguggacgggaucguggccaucgaccuggaccccgucguguacgacgccaaguucgagaagcagcucggccagaucaugcugcugauccucugcaccucccagauccugcugaugcggaccaccugggcgcucugcgagagcaucacgcuggccaccggcccccugaccacccucugggagggguccccgggcaaguucuggaacacgaccaucgccgugagcauggccaacaucuuccgcggguccuaccuggccggcgcgggccuggccuucagccucaugaagucccucgggggcgggcggcgcgggaccggggcccagggcgagacccugggcgagaaguggaagcggcagcucaaccagcuguccaagagcgaguucaacacguacaagcgcuccgggaucauggaggucgaccggagcgaggccaaggagggccugaagcgcggggagaccaccaagcacgcggugucccggggcaccgccaagcuccgcugguucguggagcggaaccuggucaagcccgaggggaaggugaucgaccugggcugcggccgcgggggcuggagcuacuacugcgccgggcugaagaaggugacggaggucaagggcuacaccaagggcggccccggccacgaggagcccaucccgauggccaccuacggguggaaccucgugaagcugcacuccggcaaggacguguucuucaucccgcccgagaagugcgacacccugcucugcgacaucggggagagcucccccaacccgacgaucgaggagggccggacccugcgcguccugaagaugguggagcccuggcuccgggggaaccaguucugcaucaagauccugaaccccuacaugcccagcguggucgagacccuggagcagaugcagcgcaagcacggcggcaugcucgugcggaacccgcugucccgcaacagcacccacgagauguacuggguguccugcgggaccggcaacaucgucagcgccgugaacaugacgucccgcaugcugcucaaccgguucaccauggcgcaccgcaagcccaccuacgagcgggacguggaccugggggccggcacccgccacgucgccguggagcccgagguggccaaccuggacaucaucggccagcggaucgagaacaucaagcacgagcacaagagcacguggcacuacgacgaggacaaccccuacaagaccugggccuaccacggguccuacgaggucaagccgagcggcuccgcgagcagcauggugaacggggucgugaagcuccugaccaagcccugggacgugauccccauggucacccagaucgccaugacggacaccacccccuucggccagcagcgcguguucaaggagaagguggacacccggacgccgaaggccaagcgcgggaccgcccagaucauggaggucaccgccaaguggcuguggggcuuccucucccggaacaagaagccccgcaucugcacccgggaggaguucacgcgcaaggugcggagcaacgcggccaucggcgccguguucgucgacgagaaccaguggaacuccgccaaggaggcgguggaggacgagcgcuucugggaccuggugcaccgggagcgcgagcugcacaagcaggggaagugcgcgaccugcgucuacaacaugaugggcaagcgggagaagaagcucggggaguucggcaaggccaaggggagccgcgccaucugguacauguggcugggcgcccgguuccuggaguucgaggcgcucggcuucaugaacgaggaccacugguucucccgcgagaacagccuguccgggguggagggcgaggggcugcacaagcucggcuacauccugcgggacaucagcaagauccccgggggcaacauguacgccgacgacaccgccggcugggacacccgcaucacggaggacgaccugcagaacgaggcccgcaucaccgacaucauggagccggagcacgcccuccuggcgaaguccaucuucaagcugaccuaccagaacaaggugguccgggugcagcgccccgccaagaacgggaccgugauggacgucaucagccggcgcgaccagcggggcuccggccagguggggacguacggccucaacaccuucaccaacauggaggcccagcugauccgccagauggagagcgaggggaucuucucccccagcgagcuggagacccccaaccucgccgagcgggugcuggacuggcuggagaaguacggcgucgagcgccucaagcggauggccaucuccggggacgacugcguggugaagccgaucgacgaccgcuucgcgacggcccugaccgcccugaacgacaugggcaagguccggaaggacaucccccagugggagcccagcaagggguggaacgacuggcagcagguccccuucugcucccaccacuuccaccagcucaucaugaaggacggccgcgagaucguggucccgugccggaaccaggacgagcuggugggccgcgcccgggugagccagggggccggcuggagccugcgcgagaccgcgugccucgggaaguccuacgcccagauguggcagcugauguacuuccaccggcgcgaccugcggcucgccgccaacgcgaucugcagcgccguccccguggacuggauccccaccucccgcacgaccuggagcauccacgcccaccaccaguggaugaccaccgaggacaugcuguccguguggaaccgcgucuggaucgaggagaaccccuggauggaggacaagacgcacaucagcuccuggggcgacgugccguaccuggggaagcgggaggaccaguggugcggcagccucaucggccugaccgcccgcgccaccugggcgaccaacauccagguggccaucaaccagguccggcgccugaucgggaacgagaacuaccucgacuacaugaccuccaugaagcgguucaagaacgagagcgaccccgagggcgcccugugguga

SEQ ID NO: 8403 - RNA, 9879 nt, Artificial Sequence
  derived and/or modified CDS sequence (opt1) from DENV-1__FJ410232__SS-prME
agcgugaccaugcugcucaugcugaugcccaccgcccuggccuuccaccucaccacccgcggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccgcaucaccgaggccgagcccgacgacguggacugcuggugcaacgccaccgacacgugggugaccuacgggaccugcagccagaccggcgagcaccggcgcgacaagcgguccguggcccucgcgccccacgugggccuggggcuggagacgcgcaccgagaccuggaugagcuccgagggcgccuggaagcagauccagcgggucgagaccugggcccuccgccaccccggguucacggugaccgcccuguuccuggcgcacgccaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgcggugcugcggaagcucugcaucgaggccaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgcgaccaucacgccccaggcccccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgcgaagaagcaggaggucguggugcucggcagccaggagggcgccaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagguggcggagacccagcacggcaccgugcugguccagaucaaguacgagggcaccgacgcccccugcaagauccccuucagcacgcaggacgagaagggggugacccagaacggccggcugaucaccgccaacccgaucgugaccgacaaggagaagcccgucaacaucgaggccgagccgcccuucggggaguccuacaucgugaucggcgcgggcgagaaggcccugaagcucagcugguucaagaagggguccagcaucggcaagauguucgaggccacggcccgcggggcccggcgcauggcgauccugggcgacaccgccugggacuucggguccaucggcggcguguucaccagcgucgggaagcuggugcaccagaucuucggcaccgccuacgggguccucuucuccggcgucagcuggacgaugaagaucgggaucggcgugcugcugaccuggcucggccugaacucccgcagcaccucccugagcaugaccugcaucgccguggggcucgucacgcuguaccugggcgugauggugcaggccgacuccgggugcgucaucaacuggaagggccgggagcucaagugcgggagcggcaucuucgugaccaacgaggugcacaccuggaccgagcaguacaaguuccaggcggacagcccgaagcgccuguccgccgccaucggcaaggccugggaggagggggucugcggcauccggagcgccacccgccuggagaacaucauguggaagcagaucuccaacgagcucaaccacauccugcuggagaacgacaugaagcucacggugguggucggggacguggcgggcauccuggggcagggcaagaagaugauccggccccagcccauggaguacaaguacagcuggaaguccuggggcaaggccaagaucaucggggccgacgcccagaacaccaccuucaucaucgacggccccaacaccccggagugccccgacgaccagcgcgcguggaacaucugggagguggaggacuacggguucggcaucuucacgaccaacaucuggcugaagcuccgggacagcuacacccaggucugcgaccaccgccugauguccgccgccaucaaggacagcaaggccgugcacgccgacaugggcuacuggaucgaguccgagaagaacgagaccuggaagcuggcgcgggccagcuucaucgaggugaagacgugcaucuggcccaagucccacacccucuggagcaacgggguccuggaguccgagaugaucauccccaagaucuacggcgggccgaucagccagcacaacuaccgccccggcuacuucacccagaccgccgggcccuggcaccugggcaagcucgagcuggacuucgaccugugcgagggcacgaccgugguggucgacgagcacugcgggaaccggggcccgucccuccgcaccaccacggugaccgggaagaucauccacgaguggugcugccggagcugcacccugccgccccugcgcuuccggggcgaggacgggugcugguacggcauggagauccgccccgugaaggagaaggaggagaaccucgucaaguccauggugagcgccggcagcggggagguggacuccuucagccugggccugcucugcaucuccaucaugaucgaggaggucaugcggagccgcuggucccggaagaugcugaugaccgggacgcuggccguguucuuccuccugaucaugggccagcugaccuggaacgaccucauccgccugugcaucauggugggggcgaacgccagcgaccgcaugggcaugggcaccaccuaccuggcccucauggccacguucaagaugcggccgauguucgccgucgggcugcuguuccgccggcucaccucccgcgaggugcugcugcucaccaucggccugagccugguggcguccgucgagcuccccaacagccuggaggagcugggggacggccucgccaugggcaucaugauccugaagcugcucaccgacuuccagucccaccagcugugggccacgcugcucagccugaccuucaucaagaccaccuucucccugcacuacgccuggaagacgauggcgauggugcucagcaucgucucccuguucccccugugccucagcaccaccucccagaagaccacguggcugcccgugcugcucgggagccugggcugcaagccgcugaccauguuccucaucgccgagaacaagaucugggggcggaaguccuggccccugaacgagggcaucauggccguggggaucgucagcauccugcucagcucccugcugaagaacgacgugccccucgccggcccccugaucgccggcgggaugcugaucgcgugcuacgugaucagcggcuccagcgccgaccucucccuggagaaggccgccgaggucagcugggaggaggaggccgagcacuccggggcgagccacaacauccugguggaggugcaggacgacggcaccaugaagaucaaggacgaggagcgcgacgacacccucaccauccugcugaaggccacgcuccuggccgucuccgggguguacccgcugagcauccccgccacccucuucgugugguacuucuggcagaagaagaagcagcgguccggcguccugugggacacccccagcccgcccgagguggagcgcgccgugcuggacgacggcaucuaccggaucaugcagcgcgggcugcucggccggucccaggucggggugggcguguuccaggagaacgucuuccacaccauguggcacgugacgcgcggggcggugcugauguaccagggcaagcggcuggagcccagcugggccuccgucaagaaggaccucaucagcuacggcgggggcuggcgccugcggggguccuggaacaccggcgaggagguccaggugaucgccgucgagcccgggaagaaccccaagaacgugcagaccgcccccggcaccuucaagacgcccgagggcgaggugggggccaucgcgcuggacuucaagcccggcaccagcgggucccccaucgucaaccgcgagggcaagaucgugggccucuacgggaacggcguggucaccaccagcgggacguacgugagcgccaucgcccaggccaaggcgucccaggagggcccgcugcccgagaucgaggacgagguguuccggaagcgcaaccugaccaucauggaccuccaccccgggagcggcaagacccggcgcuaccugccggccaucguccgggaggccaucaagcgcaagcugcgcacccucauccuggcccccacgcgggugguggccuccgagauggcggaggcccugaagggcaugcccauccgcuaccagaccaccgccgucaagagcgagcacaccgggaaggagaucguggaccucaugugccacgccacguucaccaugcggcugcugucccccgugcgcgucccgaacuacaacaugaucaucauggacgaggcccacuucaccgaccccagcuccaucgcggcccggggcuacaucagcacccgcguggggaugggcgaggccgccgccaucuucaugacggcgacgccgcccggguccguggaggccuucccgcagagcaacgccgucauccaggacgaggagcgggacauccccgagcgcuccuggaacagcggcuacgaguggaucaccgacuuccccggcaagaccgugugguucgugcccuccaucaagagcgggaacgacaucgccaacugccuccggaagaacggcaagcgcgucauccagcugucccggaagacguucgacaccgaguaccagaagaccaagaacaacgacugggacuacguggugaccacggacaucagcgagaugggggcgaacuuccgcgccgaccgggucaucgacccgcgccggugccugaagcccgugauccucaaggacggccccgagcgcgugauccuggccgggcccaugccggucaccguggccuccgccgcgcagcggcgcggccggaucggccgcaaccacaacaaggagggggaccaguacaucuacaugggccagccccugaacaacgacgaggaccacgcccacuggaccgaggccaagaugcuccuggacaacaucaacacccccgaggggaucauccccgcccuguucgagccggagcgcgagaaguccgccgcggucgacggcgaguaccggcuccgcggggaggcccggaagacguucguggagcugaugcgccggggcgaccugcccguguggcucuccuacaaggucgccagcgagggcuuccaguacagcgaccgccgguggugcuucgacggggagcgcaacaaccaggugcuggaggagaacauggacguggagaucuggaccaaggagggcgagcggaagaagcugcgcccccgguggcucgacgcccgcaccuacuccgacccccuggcccugcgggaguucaaggaguucgcggccgggcgccggagcgucuccggcgaccucauccuggagaucggcaagcugccgcagcaccucacccagcgcgcccagaacgcccuggacaaccuggugaugcuccacaacagcgagcagggcgggcgggcguaccgccacgccauggaggagcugcccgacacgaucgagacccugaugcuccuggcccugaucgccgugcucaccgggggcgucacccuguucuuccuguccgggcggggccucggcaagaccagcaucgggcugcugugcgugauggccuccagcgugcuccuguggauggcguccgucgagccccacuggaucgccgccagcaucauccuggaguucuuccucauggugcugcugauccccgagccggaccgccagcggacgccccaggacaaccagcucgccuacguggucaucggccugcuguucaugauccucaccguggccgcgaacgagauggggcugcuggagaccaccaagaaggaccucggcaucgggcacguggccgucgagaaccaccaccacgccgccaugcuggacguggaccugcaccccgccuccgcguggacgcucuacgccguggccaccaccaucaucaccccgaugaugcgccacacgaucgagaacaccaccgccaacaucagccugaccgccaucgcgaaccaggccgccauccugaugggccucgacaagggcuggcccaucuccaagauggacaucggggucccccugcuggcccucggcugcuacagccaggugaacccccugacgcugaccgcggccgugcucaugcuggucgcccacuacgccaucaucgggccgggccugcaggccaaggcgacccgcgaggcccagaagcggaccgccgccgggaucaugaagaaccccacgguggacggcaucguggccaucgaccucgaccccgucguguacgacgcgaaguucgagaagcagcugggccagaucaugcugcucauccugugcaccucccagauccugcucaugcgcaccaccugggcccugugcgagagcaucacgcuggccaccgggccccucaccacccugugggagggcuccccggggaaguucuggaacacgaccaucgccgugagcauggccaacaucuuccggggcuccuaccuggcgggcgccgggcucgccuucagccugaugaagucccugggcgggggccgccgggggaccggcgcccagggcgagacccucggggagaaguggaagcgccagcugaaccagcuguccaagagcgaguucaacacguacaagcgguccggcaucauggaggucgaccgcagcgaggcgaaggaggggcucaagcggggcgagaccaccaagcacgccgugucccgcgggaccgccaagcugcggugguucguggagcgcaaccuggucaagcccgagggcaaggugaucgaccugggcugcgggcggggcggguggagcuacuacugcgccggccucaagaaggugacggaggucaagggguacaccaagggcggccccgggcacgaggagcccaucccgauggccaccuacggcuggaaccuggugaagcugcacuccgggaaggacguguucuucaucccgcccgagaagugcgacacccuccugugcgacaucggcgagagcucccccaacccgacgaucgaggaggggcgcacccugcggguccucaagaugguggagcccuggcugcgcggcaaccaguucugcaucaagauccugaaccccuacaugcccagcguggucgagacccucgagcagaugcagcggaagcacggcgggaugcuggugcgcaacccgcugucccggaacagcacccacgagauguacuggguguccugcggcaccgggaacaucgucagcgcggugaacaugacgucccgcaugcuccugaaccgcuucaccauggcccaccggaagcccaccuacgagcgcgacguggaccugggcaccggcacgcggcacgucgccguggagcccgagguggccaaccucgacaucaucgggcagcgcaucgagaacaucaagcacgagcacaagagcaccuggcacuacgacgaggacaaccccuacaagaccugggccuaccacggcuccuacgaggucaagccgagcggguccgcgagcagcauggugaacggcgucgugaagcugcugaccaagcccugggacgugauccccauggucacgcagaucgccaugaccgacaccacccccuucgggcagcagcggguguucaaggagaagguggacacgcgcaccccgaaggccaagcggggcaccgcccagaucauggaggucaccgcccgcuggcucuggggcuuccugucccggaacaagaagccccgcaucugcacgcgggaggaguucacccgcaaggugcggagcaacgcggccaucggggccguguucgucgacgagaaccaguggaacuccgccaaggaggcgguggaggacgagcgcuucugggaccuggugcaccgggagcgcgagcuccacaagcagggcaagugcgcgaccugcgucuacaacaugauggggaagcgggagaagaagcugggcgaguucgggaaggccaagggcagccgcgccaucugguacauguggcugggcgcccgguuccucgaguucgaggcgcugggguucaugaacgaggaccacugguucucccgcgagaacagccuguccggcguggagggggagggccuccacaagcugggguacauccugcgggacaucagcaagauccccggcggcaacauguacgccgacgacaccgccgggugggacacgcgcaucaccgaggacgaccuccagaacgaggccaagaucaccgacaucauggagccggagcacgcccugcuggcgaaggccaucuucaagcucaccuaccagaacaaggugguccgcgugcagcggcccgccaagaacggcacggugauggacgucaucucccgccgggaccagcgcgggagcggccaggugggcaccuacgggcugaacaccuucaccaacauggaggcccagcugauccggcagauggaguccgagggcaucuucagccccuccgagcucgagacgcccaaccuggccgagcgcgcgcuggacuggcucgagaaguacgggguggagcggcugaagcgcauggccaucagcggcgacgacugcgucgugaagccgaucgacgaccgguucgccaccgcccugaccgcccucaacgacauggggaaggugcgcaaggacaucccccagugggagcccuccaagggcuggaacgacuggcagcagguccccuucugcagccaccacuuccaccagcugaucaugaaggacggccgggagaucguggugccgugccgcaaccaggacgagcuggucgggcgggcgcgcgugucccagggcgccggguggagccuccgggagaccgccugccugggcaagagcuacgcccagauguggcagcugauguacuuccaccgccgggaccuccgccuggcggccaacgccaucugcuccgccgugcccgucgacugggugcccacgagccggaccaccugguccauccacgcccaccaccaguggaugaccacggaggacaugcugagcguguggaaccgcgucuggaucgaggagaaccccuggauggaggacaagacccacaucuccagcugggaggacgugccguaccucgggaagcgcgaggaccaguggugcggcucccugaucggccugaccgcgcgggccaccugggccaccaacauccagguggccaucaaccagguccgccggcucaucgggaacgagaacuaccuggacuacaugacgagcaugaagcgcuucaagaacgaguccgaccccgagggcgcccugugguga

SEQ ID NO: 8404 - RNA, 9879 nt, Artificial Sequence
  derived and/or modified CDS sequence (opt1) from DENV-1__FJ461327__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccgcaucaccgagaccgagcccgacgacguggacugcuggugcaacgccacggacaccugggugaccuacgggaccugcagccagacgggcgagcaccggcgcgacaagcgguccguggcccucgcgccccacgugggccuggggcuggagacccgcaccgagaccuggaugagcuccgagggcgcguggaagcagauccagcgggucgagacgugggcccuccgccaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagguggccgagacccagcacggcaccgugcugguccagaucaaguacgagggcaccgacgcgcccugcaagauccccuucagcacgcaggacgagaagggggugacccagaacggccggcugaucaccgccaacccgaucgugaccgacaaggagaagcccgucaacaucgaggccgagccgcccuucggggaguccuacaucgugaucggcgccggcgagaaggcgcugaagcucagcugguucaagaagggguccagcaucggcaagauguucgaggccacggcccgcggggcccggcgcauggccauccugggcgacaccgcgugggacuucggguccaucggcggcguguucaccagcgucgggaagcuggugcaccagaucuucggcaccgccuacggggugcuguucuccggcgucagcuggacgaugaagaucgggaucggcgugcugcugaccuggcucggccugaacucccgcagcaccucccugagcaugaccugcaucgccguggggcucgucacgcuguaccugggcgugauggugcaggccgacuccgggugcgucaucaacuggaagggccgggagcucaagugcgggagcggcaucuucgugaccaacgaggugcacaccuggaccgagcaguacaaguuccaggccgacagcccgaagcgccuguccgcggccaucggcaaggccugggaggagggggucugcggcauccggagcgccacccgccuggagaacaucauguggaagcagaucuccaacgagcucaaccacauccugcuggagaacgacaugaaguucacggugguggucggggacguggccggcauccucgcgcaggggaagaagaugauccggccccagcccauggaguacaaguacagcuggaaguccuggggcaaggccaagaucaucggcgccgacgugcagaacaccaccuucaucaucgacgggcccaacaccccggagugccccgacgaccagcgcgccuggaacaucugggaggucgaggacuacggcuucgggaucuucacgaccaacaucuggcugaagcugcgggacagcuacacccaggugugcgaccaccgccucauguccgcggccaucaaggacagcaaggccgugcacgccgacaugggcuacuggaucgaguccgagaagaacgagaccuggaagcuggcccgggcgagcuucaucgaggucaagacgugcaucuggcccaagucccacacccuguggagcaacggcgugcucgaguccgagaugaucauccccaagaucuacgggggcccgaucagccagcacaacuaccgccccggguacuucacccaggccgccggccccuggcaccuggggaagcuggagcucgacuucgaccugugcgagggcaccacgguggucguggacgagcacugcggcaaccgggggccgucccugcgcaccaccaccgugacgggcaagaucauccacgaguggugcugccggagcugcacccugccgccccuccgcuuccgcggggaggacggcugcugguacgggauggagauccgccccgucaaggagaaggaggagaaccuggugaaguccauggugagcgccggcagcggcgaggucgacuccuucagccucgggcugcugugcaucuccaucaugaucgaggaggugaugcggagccgcuggucccggcgcaugcucaugaccggcacccuggccguguucuuccugcucaucauggggcagcugacguggaacgaccugauccgccucugcaucauggucggcgcgaacgccagcgaccggauggggaugggcaccaccuaccuggcccugauggccaccuucaagaugcgcccgauguucgccgugggccuccuguuccggcgccugacgucccgggaggugcuccugcugaccaucgggcucagccuggucgcguccguggagcugcccaacagccucgaggagcugggcgacgggcuggccaugggcaucaugauccucaagcugcugaccgacuuccagucccaccagcucugggccacccugcugagccucacguucaucaagaccaccuucucccugcacuacgccuggaagaccauggcgaugguccugagcaucgugucccucuucccccugugccugagcacgaccucccagaagaccaccuggcuccccgugcugcugggcagccucgggugcaagccgcugacgauguuccugaucgccgagaacaagaucuggggccgccgguccuggccccucaacgaggggaucauggccgucggcaucgugagcauccugcugagcucccuccugaagaacgacgugccccuggccgggccccucaucgccggcggcaugcugaucgcgugcuacgucaucagcggguccagcgccgaccugucccucgagaaggccgccgaggugagcugggaggaggaggccgagcacuccggcgcgagccacaacauccugguggagguccaggacgacgggaccaugaagaucaaggacgaggagcgcgacgacacccugaccauccuccugaaggccacccugcucgccguguccggcguguacccgcugagcauccccgccacgcuguucgucugguacuucuggcagaagaagaagcagcgguccggggugcucugggacacccccagcccgcccgagguggagcgcgccguccuggacgacggcaucuaccggaucaugcagcgcggccugcuggggcggucccaggugggcgugggggucuuccaggagaacguguuccacaccauguggcacgugacccgcggcgcgguccucauguaccaggggaagcggcuggagcccagcugggccuccgugaagaaggaccugaucagcuacggcggcggguggcgccuccagggcuccuggaacacgggggaggaggugcaggucaucgccguggagcccggcaagaaccccaagaacgugcagaccgcccccgggaccuucaagacccccgagggcgaggucggcgccaucgcgcuggacuucaagcccgggacgagcggcucccccaucgugaaccgggaggggaagaucgugggccuguacggcaacggggucgugaccaccagcggcaccuacgugagcgccaucgcccaggccaaggcgucccaggaggggccgcuccccgagaucgaggacgaggucuuccgcaagcggaaccugacgaucauggaccugcaccccggcagcgggaagacccgccgguaccucccggccaucgugcgcgaggccaucaagcgcaagcugcggacccugauccucgcccccacccgcguggucgccuccgagauggcggaggcccugaagggcaugcccauccgguaccagacgaccgccgucaagagcgagcacaccggcaaggagaucguggaccugaugugccacgccaccuucacgaugcgccuccugucccccguccgggugccgaacuacaacaugaucaucauggacgaggcccacuucaccgaccccagcuccaucgcggcccgcggguacaucagcacccgggugggcaugggggaggccgccgccaucuucaugaccgcgacgccgcccggcuccgucgaggccuucccgcagagcaacgccgugauccaggacgaggagcgcgacauccccgagcgguccuggaacagcggguacgaguggaucaccgacuuccccggcaagaccgugugguucguccccuccaucaagagcggcaacgacaucgccaacugccugcgcaagaacgggaagcgggugauccagcucucccgcaagaccuucgacacggaguaccagaagaccaagaacaacgacugggacuacguggucaccaccgacaucagcgagaugggcgcgaacuuccgggccgaccgcgugaucgacccgcggcgcugccugaagcccgugauccugaaggacgggcccgagcgggucauccucgccggccccaugccggugacggucgccuccgccgcgcagcgccgggggcgcaucggccgcaaccacaacaaggagggcgaccaguacaucuacauggggcagccccugaacaacgacgaggaccacgcccacuggaccgaggccaagaugcugcucgacaacaucaacacccccgagggcaucauccccgcccuguucgagccggagcgggagaaguccgccgcgaucgacggggaguaccgccugcggggcgaggcccgcaagaccuucguggagcucaugcggcgcggggaccugcccguguggcuguccuacaaggucgccagcgagggcuuccaguacagcgaccggcgcuggugcuucgacggcgagcggaacaaccaggugcucgaggagaacauggacguggagaucuggacgaaggagggggagcgcaagaagcugcggccccgcuggcuggacgcccggaccuacuccgacccccucgcccugcgcgaguucaaggaguucgcggccggccggcgcagcgucuccggggaccugauccucgagaucggcaagcugccgcagcaccugacccagcgggcccagaacgcccucgacaaccuggugaugcugcacaacagcgagcagggcgggcgcgcguaccggcacgccauggaggagcuccccgacaccaucgagacgcugaugcugcucgcccugaucgccgugcugaccggcggggucacccucuucuuccuguccggccgcgggcugggcaagaccagcaucggccuccugugcgugauggccuccagcgugcugcucuggauggcguccgucgagccccacuggaucgccgccagcaucauccuggaguucuuccugauggugcuccugauccccgagccggaccggcagcgcacgccccaggacaaccagcuggccuacguggucaucgggcuccuguucaugauccugacgguggccgcgaacgagaugggccuccuggagaccaccaagaaggaccuggggaucggccacguggccgucgagaaccaccaccacgccgccaugcucgacguggaccugcaccccgccuccgcguggacccuguacgccguggccacgaccaucaucaccccgaugaugcgccacaccaucgagaacacgaccgccaacaucagccucaccgccaucgcgaaccaggccgccauccugauggggcuggacaagggcuggcccaucuccaagauggacaugggcgucccccuccuggcccuggggugcuacagccaggugaacccccucacccugacggcggccgugcugaugcucgucgcccacuacgccaucaucggcccggggcugcaggccaaggcgacccgggaggcccagaagcgcaccgccgccggcaucaugaagaaccccaccguggacgggaucguggccaucgaccuggaccccgucguguacgacgcgaaguucgagaagcagcucggccagaucaugcugcugauccucugcacgucccagauccugcugaugcggaccaccugggcccucugcgagagcaucacccuggccacgggcccccugaccacccucugggagggguccccgggcaaguucuggaacaccacgaucgccgugagcauggccaacaucuuccgcggguccuaccuggcgggcgccggccuggccuucagccucaugaagucccucgggggcgggcggcgcgggaccggggcccagggcgagacccugggcgagaaguggaagcggcagcucaaccagcuguccaagagcgaguucaacaccuacaagcgcuccgggaucauggaggucgaccggagcgaggcgaaggagggccugaagcgcggggagacgaccaagcacgccgugucccggggcaccgccaagcuccgcugguucguggagcggaaccuggucaagcccgaggggaaggugaucgaccugggcugcggccgcgggggcuggagcuacuacugcgccgggcugaagaaggugaccgaggucaagggcuacacgaagggcggccccggccacgaggagcccaucccgauggccaccuacggguggaaccucgugaagcugcacuccggcaaggacguguucuucaucccgcccgagaagugcgacacccugcucugcgacaucggggagagcucccccaacccgaccaucgaggagggccggacgcugcgcguccugaagaugguggagcccuggcuccgggggaaccaguucugcaucaagauccugaaccccuacaugcccagcguggucgagacccuggagcagaugcagcgcaagcacggcggcaugcucgugcggaacccgcugucccgcaacagcacccacgagauguacuggguguccugcgggaccggcaacaucgucagcgcggugaacaugaccucccgcaugcugcucaaccgguucacgauggcccaccgcaagcccaccuacgagcgggacguggaccugggggccggcacccgccacgucgccguggagcccgagguggccaaccuggacaucaucggccagcggaucgagaacaucaagcacgagcacaagagcaccuggcacuacgacgaggacaaccccuacaagacgugggcguaccacggguccuacgaggucaagccgagcggcuccgccagcagcauggugaacggggucgugaagcuccugaccaagcccugggacgugauccccauggucacccagaucgccaugaccgacacgacccccuucggccagcagcgcguguucaaggagaagguggacacccggaccccgaaggccaagcgcgggacggcccagaucauggaggucaccgcgaaguggcuguggggcuuccucucccggaacaagaagccccgcaucugcacccgggaggaguucacccgcaaggugcggagcaacgccgccaucggcgccguguucgucgacgagaaccaguggaacuccgcgaaggaggccguggaggacgagcgcuucugggaccuggugcaccgggagcgcgagcugcacaagcaggggaagugcgccacgugcgucuacaacaugaugggcaagcgggagaagaagcucggggaguucggcaaggccaaggggagccgcgccaucugguacauguggcugggcgcgcgguuccuggaguucgaggcccucggcuucaugaacgaggaccacugguucucccgcgagaacagccuguccgggguggagggcgaggggcugcacaagcucggcuacauccugcgggacaucagcaagauccccgggggcaacauguacgccgacgacaccgccggcugggacacccgcaucaccgaggacgaccugcagaacgaggcccgcaucacggacaucauggagccggagcacgcgcuccuggccaaguccaucuucaagcugaccuaccagaacaaggugguccgggugcagcgccccgccaagaacgggaccgugauggacgucaucagccggcgcgaccagcggggcuccggccagguggggaccuacggccucaacacguucaccaacauggaggcccagcugauccgccagauggagagcgaggggaucuucucccccagcgagcuggagacccccaaccucgccgagcgggugcuggacuggcuggagaaguacggcgucgagcgccucaagcggauggcgaucuccggggacgacugcguggugaagccgaucgacgaccgcuucgccaccgcccugacggcccugaacgacaugggcaagguccggaaggacaucccccagugggagcccagcaagggguggaacgacuggcagcagguccccuucugcucccaccacuuccaccagcucaucaugaaggacggccgcgagaucguggucccgugccggaaccaggacgagcuggugggccgcgcccgggugagccagggggcgggcuggagccugcgcgagaccgccugccucgggaaguccuacgcccagauguggcagcugauguacuuccaccggcgcgaccugcggcucgccgcgaacgccaucugcagcgccguccccguggacuggauccccaccucccgcaccacguggagcauccacgcccaccaccaguggaugaccaccgaggacaugcuguccguguggaaccgcgucuggaucgaggagaaccccuggauggaggacaagacccacaucagcuccuggggcgacgugccguaccuggggaagcgggaggaccaguggugcggcagccucaucggccugacggcccgcgcgaccugggccaccaacauccagguggccaucaaccagguccggcgccugaucgggaacgagaacuaccucgacuacaugaccuccaugaagcgguucaagaacgagagcgaccccgagggcgcccugugguga

SEQ ID NO: 8405 - RNA, 9879 nt, Artificial Sequence
  derived and/or modified CDS sequence (opt1) from DENV-1__FJ461328__SS-prME
agcgugaccaugcugcugaugcugaugcccaccgcccuggccuuccaccucaccacccggggcggggagccccacaugaucgucagcaagcaggagcggggcaagagccugcuguucaagaccagcgccggggugaacaugugcacccucaucgccauggaccugggcgagcugugcgaggacaccaugaccuacaagugcccccggaucaccgaggccgagcccgacgacguggacugcuggugcaacgccaccgacacgugggucaccuacgggaccugcagccagaccggcgagcaccggcgggagaagcgguccguggcccucgcgccccacgugggccuggggcuggagacgcggaccgagaccuggaugagcuccgagggcgccuggaagcagauccagcgggucgagaccugggcccuccgccaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcggugcugcggaagcucugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccuccugacgugcgccaaguucaagugcgugaccaagcuggagggcaagaucguccaguacgagaaccucaaguacagcgugaucgugaccguccacaccggcgaccagcaccagguggggaacgaguccacggagcacggcaccaccgcgaccaucacgccccaggcccccacgaccgagauccagcugaccgacuacggggcccugacccucgacugcagcccccgcacgggccuggacuucaacgagaugguccugcucaccaugaaggagaaguccuggcuggugcacaagcagugguuccuggaccucccccugcccuggaccagcggggccagcaccucccaggagacguggaaccggcaggaccugcucgugaccuucaagaccgcccacgcgaagaagcaggaggucguggugcugggcagccaggagggcgccaugcacaccgcccugacgggggccaccgagauccagaccuccggcaccacgaccaucuucgccgggcaccucaagugccgccugaagauggacaagcugacccucaagggcaugagcuacgucaugugcaccggguccuucaagcuggagaaggagguggcggagacgcagcacggcaccgugcugguccagaucaaguacgagggcaccgacgcccccugcaagauccccuucagcacccaggacgagaagggggugacgcagaacggccggcugaucaccgccaacccgaucgugaccgacaaggagaagcccgucaacaucgaggccgagccgcccuucggggaguccuacaucgugaucggcgcgggcgagaaggcccucaagcugagcugguucaagaagggguccagcaucggcaagauguucgaggccaccgcccgcggggcccggcgcauggcgauccugggcgacacggccugggacuucggguccaucggcggcguguucaccagcgucgggaagcucgugcaccagaucuucggcaccgccuacggggugcuguucuccggcgucagcuggaccaugaagaucgggaucggcgugcugcucacguggcugggccugaacucccgcagcaccucccucagcaugaccugcaucgccguggggcuggucacccuguaccucggcgugauggugcaggccgacuccgggugcgucaucaacuggaagggccgggagcugaagugcgggagcggcaucuucgugacgaacgaggugcacaccuggaccgagcaguacaaguuccaggcggacagcccgaagcgccuguccgccgccaucggcaaggccugggaggagggggucugcggcauccggagcgccacccgccucgagaacaucauguggaagcagaucuccaacgagcugaaccacauccugcucgagaacgacaugaaguucaccgugguggucggggacguggcgggcauccuggugcaggggaagaagaugauccggccccagcccauggaguacaaguacagcuggaaguccuggggcaaggccaagaucaucggcgccgacguccagaacagcacguucaucaucgacgggcccaacaccccggagugccccgacgaccagcgcgccuggaacaucugggagguggaggacuacggcuucgggaucuucaccaccaacaucuggcugaagcuccgggacuccuacacccaggugugcgaccaccgccugaugagcgcggccaucaaggacuccaaggccguccacgccgacaugggcuacuggaucgagagcgagaagaacgagaccuggaagcuggcccgggcguccuucaucgaggugaagaccugcaucuggcccaagagccacacccucugguccaacggcgugcuggagagcgagaugaucauccccaagauccacgggggcccgaucucccagcacaacuaccgccccggguacuucacgcagaccgccggccccuggcaccuggggaagcucgagcuggacuucgaccugugcgagggcaccaccgucgugguggacgagcacugcggcaaccgggggccgagccuccgcacgaccaccgucaccggcaagaucauccacgaguggugcugccgguccugcacgcugccgccccugcgcuuccgcggggaggacggcugcugguacgggauggagauccgccccgugaaggagaaggaggagaaccucgugaaguccauggucagcgccggcuccggcgagguggacagcuucucccuggggcugcucugcaucagcaucaugaucgaggaggugaugcggucccgcuggagccggaagaugcugaugaccggcacccuggccgucuucuuccuccugaucauggggcagcugaccuggaacgaccucauccgccugugcaucauggugggcgccaacgcguccgaccgcauggggaugggcacgaccuaccuggcccucauggccaccuucaagaugcggccgauguucgccgugggccugcuguuccgccggcucaccagccgcgagguccugcugcucacgaucgggcugucccugguggccagcgucgagcuccccaacucccuggaggagcugggcgacgggcucgcgaugggcaucaugauccugaagcugcucaccgacuuccagagcuaccagcugugggccacccugcucucccugaccuucaucaagacgaccuucagccugcacuacgccuggaagaccauggccauggugcucuccaucgugagccuguucccccugugccucuccaccacgagccagaagaccaccuggcugcccguccugcucggcucccuggggugcaagccgcugaccauguuccucaucgcggagaacaagaucuggggccgcaagagcuggccccugaacgaggggaucauggccgugggcaucgugagcauccugcucuccagccugcugaagaacgacgucccccucgccgggccccugaucgccggcggcaugcugaucgccugcuacgugaucuccgggagcuccgcggaccucagccuggagaaggccgccgagguguccugggaggaggaggccgagcacagcggcgccucccacaacauccuggucgaggugcaggacgacgggacgaugaagaucaaggacgaggagcgcgacgacacccucaccauccugcugaaggcgacccuccuggccgugagcggcgucuacccgcuguccauccccgccacccucuucguguggcacuucuggcagaagaagaagcagcggagcggggugcugugggacacgcccagcccgcccgaggucgagcgcgccgugcuggacgacggcaucuaccggaucaugcagcgcggccugcucgggcggagccaggugggcgucgggguguuccaggagaacguguuccacaccauguggcacgucacccgcggcgccgugcugauguaccaggggaagcggcuggagcccuccugggcgagcgugaagaaggaccucaucuccuacggcggcggguggcgcuuccagggcagcuggaacaccggggaggagguccaggugaucgccguggagcccggcaagaaccccaagaacguccagacggcccccgggaccuucaagacccccgagggcgaggugggcgccaucgcccuggacuucaagcccgggaccuccggcagccccaucgugaaccgggaggggaagaucgucggccuguacggcaacgggguggugacgaccagcggcaccuacgucuccgcgaucgcccaggccaaggccagccaggaggggccgcuccccgagaucgaggacgagguguuccgcaagcggaaccugaccaucauggaccugcaccccggcuccgggaagacgcgccgguaccucccggcgaucgugcgcgaggccaucaagcggaagcugcgcacccugauccucgcccccacccgcgucguggccagcgagauggccgaggcgcugaagggcaugcccauccgguaccagaccacggccgugaaguccgagcacaccggcaaggagaucgucgaccugaugugccacgccaccuucaccaugcgccuccugagccccgugcgggugccgaacuacaacaugaucaucauggacgaggcccacuucacggaccccuccagcaucgccgcgcgcggguacaucuccacccgggucggcaugggggaggccgccgccaucuucaugaccgccacgccgcccggcagcauggaggcguucccgcaguccaacgccgugauccaggacgaggagcgcgacauccccgagcggagcuggaacuccggguacgaguggaucacggacuuccccggcaagaccgugugguucguccccagcaucaaggccggcaacgacaucgccaacugccugcgcaagaacgggaagcgggugauccagcucucccgcaagaccuucgacaccgaguaccagaagacgaagaacaacgacugggacuacguggucaccaccgacaucagcgagaugggcgcgaacuuccgggccgaccgcgugaucgacccgcggcgcugccugaagcccgugauccugaaggacgggcccgagcgggucauccucgccggccccaugccggugaccgucgccuccgccgcgcagcgccgggggcgcaucggccggaaccacaacaaggagggcgaccaguacaucuacauggggcagccccugaacaacgacgaggaccacgcccacuggacggaggccaagaugcugcucgacaacaucaacacccccgagggcaucauccccgcccuguucgagccggagcgcgagaaguccgccgcgaucgacggggaguaccgccugcggggcgaggcccgcaagaccuucguggagcucaugcggcgcggggaccugcccguguggcuguccuacaaggucgccagcgagggcuuccaguacagcgaccggcgcuggugcuucgacggcgagcggaacaaccaggugcucgaggagaacauggacguggagaucuggaccaaggagggggagcgcaagaagcugcggccccgcuggcuggacgcccggacguacuccgacccccucgcccugcgcgaguucaaggaguucgcggccggccggcgcagcgucuccggggaccugauccucgagaucggcaagcugccgcagcaccugacccagcgggcccagaacgcccucgacaaccuggugaugcugcacaacagcgagcagggcgggcgcgcguaccggcacgccauggaggagcuccccgacaccaucgagacccugaugcugcucgcccugaucgccgugcugacgggcggggucacccucuucuuccuguccggcaaggggcugggcaagaccagcaucggccuccugugcgugauggccuccagcgugcugcucuggauggcguccgucgagccccacuggaucgccgccagcaucauccuggaguucuuccugauggugcuccugauccccgagccggaccgccagcggacgccccaggacaaccagcuggccuacguggucaucgggcuccuguucaugauccugaccguggccgcgaacgagaugggccuccuggagacgaccaagaaggaccuggggaucggccacguggccgucgagaaccaccaccacgccgccaugcucgacguggaccugcaccccgccuccgcguggacccuguacgccguggccaccacgaucaucaccccgaugaugcgccacaccaucgagaacaccacggccaacaucagccucaccgccaucgcgaaccaggccgccauccugauggggcuggacaagggcuggcccaucuccaagauggacaucggcgucccccuccuggcccuggggugcuacagccaggugaacccccucacccugaccgcggccgugcugaugcucgucgcccacuacgccaucaucggcccggggcugcaggccaaggcgacgcgggaggcccagaagcgcaccgccgccggcaucaugaagaaccccaccaucgacgggaucguggccaucgaccuggaccccguggucuacgacgcgaaguucgagaagcagcucggccagaucaugcugcugauccucugcaccucccagauccugcugaugcgcacgaccugggcccucugcgagagcaucacccuggccaccggcccccugacgacccucugggagggguccccgggcaaguucuggaacaccaccaucgccgugagcauggccaacaucuuccggggguccuaccuggcgggcgccggccuggccuucagccucaugaagucccucgggggcgggcgccgggggacgggggcccagggcgagacccugggcgagaaguggaagcgccagcucaaccagcuguccaagagcgaguucaacaccuacaagcgguccgggaucauggagguggaccgcagcgaggcgaaggagggccugaagcgcggggagaccacgaagcacgccgucucccgcggcaccgccaagcuccggugguucguggagcgcaaccuggugaagcccgaggggaaggucaucgaccugggcugcggccgcgggggcuggagcuacuacugcgccgggcugaagaaggugaccgaggugaagggcuacaccaagggcggccccggccacgaggagcccaucccgauggccacguacggguggaaccucgucaagcugcacuccggcaaggacguguucuucaucccgcccgagaagugcgacacccugcucugcgacaucggggagagcucccccaacccgaccaucgaggagggccgcacccugcgggugcugaagauggucgagcccuggcuccgcgggaaccaguucugcaucaagauccugaaccccuacaugcccagcgugguggagacgcuggagcagaugcagcggaagcacggcggcaugcucguccgcaacccgcugucccggaacagcacccacgagauguacuggguguccugcgggaccggcaacaucgugagcgcggucaacaugaccucccgcaugcugcucaaccgguucaccauggcccaccgcaagcccacguacgagcgcgacguggaccugggggccggcacccggcacguggccgucgagcccgagguggccaaccuggacaucaucggccagcgcaucgagaacaucaagcacgagcacaagagcaccuggcacuacgacgaggacaaccccuacaagaccugggcguaccacggguccuacgaggugaagccgagcggcuccgccagcagcauggucaacgggguggucaagcuccugacgaagcccugggacgugauccccauggugacccagaucgccaugaccgacaccacgcccuucggccagcagcgggucuucaaggagaagguggacacccgcaccccgaaggccaagcgggggaccgcccagaucauggaggugacggcgcgcuggcuguggggcuuccucucccggaacaagaagccccgcaucugcacccgggaggaguucacccgcaagguccggagcaacgccgccaucggcgccguguucguggacgagaaccaguggaacuccgcgaaggaggccgucgaggacgaccgcuucugggaccuggugcaccgggagcgcgagcugcacaagcaggggaagugcgcgaccugcguguacaacaugaugggcaagcgggagaagaagcucggggaguucggcaaggccaaggggagccgcgccaucugguacauguggcugggcgcgcgguuccuggaguucgaggcccucggcuucaugaacgaggaccacugguucucccgcgagaacagccuguccggggucgagggcgaggggcugcacaagcucggcuacauccugcgggacaucagcaagauccccgggggcaacauguacgccgacgacacggccggcugggacacccgcaucaccgaggacgaccugcagaacgaggccaagaucaccgacaucauggagccggagcacgcgcuccuggccaaguccaucuucaagcugacguaccagaacaagguggugcggguccagcgccccgccaagaacgggaccgugauggacgugaucagccgccgggaccagcgcggcuccgggcaggucggcaccuacggccucaacaccuucacgaacauggaggcccagcugauccggcagauggagagcgaggggaucuuccugcccaacgagcucgagacccccaaccuggccggccgcgugcuggacuggcucgagaaguacgggguggagcggcugaagcgcauggcgaucuccggcgacgacugcgucgugaagccgaucgacgaccgguucgccaccgcccugaccgcccucaacgacauggggaaggugcgcaaggacaucccccagugggagcccagcaagggcuggaacgacuggcagcagguccccuucugcucccaccacuuccaccagcugaucaugaaggacggccgggagaucguggugccgugccgcaaccaggacgagcuggucgggcgggcccgcgugagccagggcgcgggguggucccuccgggagacggccugccugggcaagagcuacgcccagauguggcagcugauguacuuccaccgccgggaccuccgccuggccgcgaacgccaucugcagcgccgugcccgucgacugggugcccaccucccggaccaccuggagcauccacgcccaccaccaguggaugacgaccgaggacaugcuguccguguggaaccgcgucuggaucgaggagaaccccuggauggaggacaagacccggaucagcuccugggaggacgugccguaccucgggaagcgcgaggaccaguggugcggcagccugaucggccugaccgcccgcgcgacgugggccaccaacauccagguggccaucaaccagguccggcgccucaucgggaacgagaacuacuccgacuacaugaccagcaugaagcgguucaagaacgaguccgagcccgagggcgcccugugguga

SEQ ID NO: 8406 - RNA, 9879 nt, Artificial Sequence
  derived and/or modified CDS sequence (opt1) from DENV-1__FJ410234__SS-prME
agcgugaccaugcugcucaugcugaugcccaccgcccuggccuuccaccucaccacccgcggcggggagccccacaugaucguguccaagcaggagcggggcaagagccugcuguucaagaccuccgcgggggugaacaugugcacccucaucgccauggaccugggcgagcugugcgaggacaccaugaccuacaagugcccccgcaucaccgaggccgagcccgacgacguggacugcuggugcaacgccaccgacacgugggugaccuacgggaccugcagccagaccggcgagcaccggcgcgacaagcgguccguggcccucgcgccccacgugggccuggggcuggagacgcgcaccgagaccuggaugagcuccgagggcgccuggaagcagauccagcgggucgagaccugggcccuccgccaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcggugcugcggaagcucugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacaccggcgaccagcaccagguggggaacgaguccacggagcacggcaccaccgcgaccaucacgccccaggcccccacgaccgagauccagcucaccgacuacggggcccugacccuggacugcagcccccgcacgggccucgacuucaacgagaugguccugcugaccaugaaggagaaguccuggcucgugcacaagcagugguuccuggaccugccccuccccuggaccagcggggccagcaccucccaggagacguggaaccggcaggaccugcuggugaccuucaagaccgcccacgcgaagaagcaggaggucguggugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgucaugugcaccggguccuucaagcucgagaaggagguggcggagacgcagcacggcaccgugcugguccagaucaaguacgagggcaccgacgcccccugcaagauccccuucagcacccaggacgagaagggggugacgcagaacggccggcugaucaccgccaacccgaucgugaccgacaaggagaagcccgucaacaucgaggccgagccgcccuucggggaguccuacaucgugaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcgucgggaagcuggugcaccagaucuucggcaccgccuacgggguccucuucuccggcgucagcuggaccaugaagaucgggaucggcgugcugcugacguggcucggccugaacucccgcagcaccucccugagcaugaccugcaucgccguggggcucgucacccuguaccugggcgugauggugcaggccgacuccgggugcgucaucaacuggaagggccgggagcucaagugcgggagcggcaucuucgugacgaacgaggugcacaccuggaccgagcaguacaaguuccaggcggacagcccgaagcgccuguccgccgccaucggcaaggccugggaggagggggucugcggcauccggagcgccacccgccuggagaacaucauguggaagcagaucuccaacgagcucaaccacauccugcuggagaacgacaugaagcucaccgugguggucggggacguggcgggcauccuggggcagggcaagaagaugauccggccccagcccauggaguacaaguacagcuggaaguccuggggcaaggccaagaucaucggggccgacgcccagaacacgaccuucaucaucgacggccccaacaccccggagugccccgacgaccagcgcgcguggaacaucugggagguggaggacuacggguucggcaucuucaccacgaacaucuggcugaagcuccgggacagcuacacccaggucugcgaccaccgccugauguccgccgccaucaaggacagcaaggccgugcacgccgacaugggcuacuggaucgaguccgagaagaacgagaccuggaagcuggcgcgggccagcuucaucgaggugaagaccugcaucuggcccaagucccacacgcucuggagcaacgggguccuggaguccgagaugaucauccccaagaucuacggcgggccgaucagccagcacaacuaccgccccggcuacuucacccagaccgccgggcccuggcaccugggcaagcucgagcuggacuucgaccugugcgagggcaccacggugguggucgacgagcacugcgggaaccggggcccgucccuccgcaccaccaccgugacggggaagaucauccacgaguggugcugccggagcugcacccugccgccccugcgcuuccggggcgaggacgggugcugguacggcauggagauccgccccgugaaggagaaggaggagaaccucgucaaguccauggugagcgccggcagcggggagguggacuccuucagccugggccugcucugcaucuccaucaugaucgaggaggucaugcggagccgcuggucccggaagaugcugaugaccgggacccuggccguguucuuccuccugaucaugggccagcugacguggaacgaccucauccgccugugcaucauggugggggcgaacgccagcgaccgcaugggcaugggcaccaccuaccuggcccucauggccaccuucaagaugcggccgauguucgccgucgggcugcuguuccgccggcucacgucccgcgaggugcugcugcucaccaucggccugagccugguggcguccgucgagcuccccagcucccuggaggagcugggggacggccucgccaugggcaucaugauccugaagcugcucaccgacuuccagagccaccagcugugggccacccugcucucccugacguucaucaagaccgccuucagccugcacuacgcguggaagaccauggccauggugcucuccaucgucagccuguucccccugugccucuccaccacgagccagaagaccaccuggcugcccgugcugcucgggucccugggcugcaagccgcugaccauguuccucaucgccgagaacaagaucugggggcggaaguccuggccccugaacgagggcaucauggccguggggaucgucagcauccugcucuccagccugcugaagaacgacgugccccucgccggcccccugaucgcgggcgggaugcugaucgccugcuacgugaucuccggcagcuccgccgaccucagccuggagaaggccgccgaggucuccugggaggaggaggcggagcacagcggggccucccacaacauccugguggaggugcaggacgacggcacgaugaagaucaaggacgaggagcgcgacgacacccucaccauccugcugaaggccacccuccuggccgucagcgggguguacccgcuguccauccccgccacccucuucgugugguacuucuggcagaagaagaagcagcggagcggcguccugugggacacgcccagcccgcccgagguggagcgcgcggugcuggacgacggcaucuaccggaucaugcagcgcgggcugcucggccggagccaggucggggugggcguguuccaggagaacgucuuccacaccauguggcacgugacccgcggggccgugcugauguaccagggcaagcggcuggagcccuccugggccagcgucaagaaggaccucaucuccuacggcgggggcuggcgccugcgggggagcuggaacaccggcgaggagguccaggugaucgccgucgagcccgggaagaaccccaagaacgugcagacggcccccggcaccuucaagacccccgagggcgaggugggggcgaucgcccuggacuucaagcccggcaccuccgggagccccaucgucaaccgcgagggcaagaucgugggccucuacgggaacggcguggucacgaccagcgggaccuacguguccgccaucgcccaggcgaaggccagccaggagggcccgcugcccgagaucgaggacgagguguuccggaagcgcaaccugaccaucauggaccuccaccccggguccggcaagacgcggcgcuaccugccggccaucguccgggaggccaucaagcgcaagcugcgcacccucauccuggcccccacccgggugguggcgagcgagauggccgaggcccugaagggcaugcccauccgcuaccagaccacggccgucaaguccgagcacaccgggaaggagaucguggaccucaugugccacgccaccuucaccaugcggcugcugagccccgugcgcgucccgaacuacaacaugaucaucauggacgaggcgcacuucacggaccccuccagcaucgccgcccggggcuacaucuccacccgcguggggaugggcgaggccgccgcgaucuucaugaccgccacgccgcccgggagcguggaggccuucccgcaguccaacgccgucauccaggacgaggagcgggacauccccgagcgcagcuggaacuccggcuacgaguggaucacggacuuccccggcaagaccgugugguucgugcccagcaucaaguccgggaacgacaucgcgaacugccuccggaagaacggcaagcgcgucauccagcugagccggaagaccuucgacaccgaguaccagaagacgaagaacaacgacugggacuacguggugaccaccgacaucuccgagaugggggccaacuuccgcgccgaccgggucaucgacccgcgccggugccugaagcccgugauccucaaggacggccccgagcgcgugauccuggccgggcccaugccggucaccguggccagcgcggcccagcggcgcggccggaucggccgcaaccacaacaaggagggggaccaguacaucuacaugggccagccccugaacaacgacgaggaccacgcccacuggacggaggccaagaugcuccuggacaacaucaacacccccgaggggaucauccccgcccuguucgagccggagcgcgagaaguccgcggccgucgacggcgaguaccggcuccgcggggaggcccggaagaccuucguggagcugaugcgccggggcgaccugcccguguggcucagcuacaaggucgccagcgagggcuuccaguacuccgaccgccgguggugcuucgacggggagcgcaacaaccaggugcuggaggagaacauggacguggagaucuggaccaaggagggcgagcggaagaagcugcgcccccgguggcucgacgcccgcacguacagcgacccccuggcgcugcgggaguucaaggaguucgccgccgggcgccgguccgucagcggcgaccucauccuggagaucggcaagcugccgcagcaccucacccagcgcgcccagaacgcgcuggacaaccuggugaugcuccacaacuccgagcagggcgggcgggccuaccgccacgccauggaggagcugcccgacaccaucgagacccugaugcuccuggcccugaucgccgugcucaccgggggcgucacccuguucuuccugagcgggcggggccucggcaagaccuccaucgggcugcugugcgugauggcgagcuccgugcuccuguggauggccagcgucgagccccacuggaucgccgccuccaucauccuggaguucuuccucauggugcugcugauccccgagccggaccgccagcggacgccccaggacaaccagcucgccuacguggucaucggccugcuguucaugauccucaccguggcggccaacgagauggggcugcuggagacgaccaagaaggaccucggcaucgggcacguggccgucgagaaccaccaccacgccgccaugcuggacguggaccugcaccccgcgagcgccuggacccucuacgccguggccaccacgaucaucaccccgaugaugcgccacaccaucgagaacaccacggccaacaucucccugaccgcgaucgccaaccaggccgccauccugaugggccucgacaagggcuggcccaucagcaagauggacaucggggucccccugcuggcgcucggcugcuacucccaggugaacccccugacccugaccgccgccgugcucaugcuggucgcccacuacgccaucaucgggccgggccugcaggcgaaggccacgcgcgaggcccagaagcggaccgccgccgggaucaugaagaaccccaccguggacggcaucguggcgaucgaccucgaccccgucguguacgacgccaaguucgagaagcagcugggccagaucaugcugcucauccugugcaccagccagauccugcucaugcgcacgaccugggcccugugcgaguccaucacccuggccaccgggccccucacgacccugugggagggcagcccggggaaguucuggaacaccaccaucgccguguccauggcgaacaucuuccggggcagcuaccuggccggcgccgggcucgccuucagccugaugaagucccugggcgggggccgccgggggacgggcgcgcagggcgagacccucggggagaaguggaagcgccagcugaaccagcugagcaaguccgaguucaacaccuacaagcggagcggcaucauggaggucgaccgcuccgaggccaaggaggggcucaagcggggcgagaccacgaagcacgccgugagccgcgggaccgccaagcugcggugguucguggagcgcaaccuggucaagcccgagggcaaggugaucgaccugggcugcgggcggggcgggugguccuacuacugcgccggccucaagaaggugaccgaggucaagggguacaccaagggcggccccgggcacgaggagcccaucccgauggcgacguacggcuggaaccuggugaagcugcacagcgggaaggacguguucuucaucccgcccgagaagugcgacacccuccugugcgacaucggcgaguccagccccaacccgaccaucgaggaggggcgcacccugcggguccucaagaugguggagcccuggcugcgcggcaaccaguucugcaucaagauccugaaccccuacaugcccuccguggucgagacgcucgagcagaugcagcggaagcacggcgggaugcuggugcgcaacccgcugagccggaacuccacccacgagauguacugggugagcugcggcaccgggaacaucgucuccgccgugaacaugaccagccgcaugcuccugaaccgcuucaccauggcccaccggaagcccacguacgagcgcgacguggaccugggcaccggcacccggcacgucgccguggagcccgagguggccaaccucgacaucaucgggcagcgcaucgagaacaucaagcacgagcacaaguccaccuggcacuacgacgaggacaaccccuacaagacgugggcguaccacggcagcuacgaggucaagccguccgggagcgccagcuccauggugaacggcgucgugaagcugcugaccaagcccugggacgugauccccauggucacccagaucgccaugaccgacacgacccccuucgggcagcagcggguguucaaggagaagguggacacccgcaccccgaaggccaagcggggcacggcccagaucauggaggucaccgcgcgcuggcucuggggcuuccugagccggaacaagaagccccgcaucugcacccgggaggaguucacccgcaaggugcgguccaacgccgccaucggggccguguucgucgacgagaaccaguggaacagcgcgaaggaggccguggaggacgagcgcuucugggaccuggugcaccgggagcgcgagcuccacaagcagggcaagugcgccacgugcgucuacaacaugauggggaagcgggagaagaagcugggcgaguucgggaaggccaagggcucccgcgccaucugguacauguggcugggcgcgcgguuccucgaguucgaggcccugggguucaugaacgaggaccacugguucagccgcgagaacucccugagcggcguggagggggagggccuccacaagcugggguacauccugcgggacaucuccaagauccccggcggcaacauguacgccgacgacaccgccgggugggacacccgcaucaccgaggacgaccuccagaacgaggccaagaucacggacaucauggagccggagcacgcgcugcuggccaaggccaucuucaagcucaccuaccagaacaaggugguccgcgugcagcggcccgccaagaacggcaccgugauggacgucaucagccgccgggaccagcgcggguccggccaggugggcaccuacgggcugaacacguucaccaacauggaggcccagcugauccggcagauggagagcgagggcaucuucucccccagcgagcucgagacccccaaccuggcggagcgcgcccuggacuggcucgagaaguacgggguggagcggcugaagcgcauggccaucuccggcgacgacugcgucgugaagccgaucgacgaccgguucgccaccgcccugacggcgcucaacgacauggggaaggugcgcaaggacaucccccagugggagcccagcaagggcuggaacgacuggcagcagguccccuucugcucccaccacuuccaccagcugaucaugaaggacggccgggagaucguggugccgugccgcaaccaggacgagcuggucgggcgggcccgcgugagccagggcgccggguggagccuccgggagaccgccugccugggcaaguccuacgcgcagauguggcagcugauguacuuccaccgccgggaccuccgccuggccgccaacgccaucugcagcgccgugcccgucgacugggugcccaccucccggaccacguggagcauccacgcgcaccaccaguggaugaccaccgaggacaugcuguccguguggaaccgcgucuggaucgaggagaaccccuggauggaggacaagacccacaucagcuccugggaggacgugccguaccucgggaagcgcgaggaccaguggugcggcagccugaucggccugacggcccgggccaccugggccaccaacauccagguggccaucaaccagguccgccggcucaucgggaacgagaacuaccuggacuacaugaccuccaugaagcgcuucaagaacgagagcgaccccgagggcgcgcugugguga

SEQ ID NO: 8407 - RNA, 9879 nt, Artificial Sequence
  derived and/or modified CDS sequence (opt1) from DENV-1__FJ410235__SS-prME
agcgugaccaugcugcucaugcugaugcccaccgcccuggccuuccaccucacgacccgcggcggggagccccacaugaucgugagcaagcaggagcggggcaagagccugcuguucaagaccagcgcgggggugaacaugugcacccucaucgccauggaccugggcgaguucugcgaggacaccaugaccuacaagugcccccgcaucaccgaggccgagcccgacgacguggacugcuggugcaacgccaccgacacgugggugaccuacgggaccugcagccagaccggcgagcaccggcgcgacaagcgguccguggcccuggcgccccacgugggccucgggcuggagacgcgcaccgagaccuggaugagcuccgagggcgccuggaagcagauccagcggguggagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugcccgacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaagaccguccaguacgagaaccugaaguacagcgugaucgugaccguccacacgggcgaccagcaccagguggggaacgaguccaccgagcacggcaccaccgcgaccaucacgccccaggcccccagcaccgagauccagcugaccgacuacggggcccucacccuggacugcagcccccggacgggccuggacuucaacgagaugguccuccugaccaugaaggagaaguccuggcuggugcacaagcagugguuccucgaccugccgcugcccuggaccagcggggccuccaccagccaggagacguggaaccggaaggaccuccuggugaccuucaagaccgcccacgcgaagaagcaggaggucguggugcugggcucccaggagggcgccaugcacaccgcccucacgggggccaccgagauccagaccagcggcaccacgaccaucuucgccgggcaccugaagugccgccugaagauggacaagcucacccugaagggcauguccuacgucaugugcaccgggagcuucaagcuggagaaggagguggcggagacgcagcacggcaccgugcucguccagaucaaguacgagggcaccgacgcccccugcaagauccccuucuccacccaggacgagaagggggugacgcagaacggccggcugaucaccaccaacccgaucgugaccgacaaggagaagcccgucaacaucgaggccgagccgcccuucggggagagcuacaucgugaucggcgccggcgagaaggcgcugaagcuguccugguucaagaaggggagcuccaucggcaagauguucgaggccacggcccgcggggcccggcgcauggccauccucggcgacaccgcgugggacuucgggagcaucggcggcguguucaccuccgucgggaagcuggugcaccagaucuucggcaccgccuacggggugcuguucagcggcgucuccuggacgaugaagaucgggaucggcgugcuccugaccuggcugggccucaacagccgcuccaccagccuguccaugaccugcaucgccguggggcuggucacgcucuaccugggcgugauggugcaggccgacagcgggugcgucaucaacuggaagggccgggagcugaagugcgggagcggcaucuucgugaccaacgaggugcacaccuggaccgagcaguacaaguuccaggccgacuccccgaagcgccucagcgcggccaucggcaaggccugggaggagggggucugcggcauccgguccgccacccgccuggagaacaucauguggaagcagaucagcaacgagcugaaccacauccuccuggagaacgacaugaaguucacggugguggucggggacguggccggcauccuggcgcaggggaagaagaugauccggccccagcccauggaguacaaguacuccuggaaguccuggggcaaggccaagaucaucggcgccgacgugcagaacaccaccuucaucaucgacgggcccaacaccccggagugccccgacgaccagcgcgccuggaacaucugggaggucgaggacuacggcuucgggaucuucacgaccaacaucuggcucaagcugcgggacuccuacacccaggugugcgaccaccgccugaugagcgcggccaucaaggacuccaaggccgugcacgccgacaugggcuacuggaucgagagcgagaagaacgagaccuggaagcucgcccgggcguccuucaucgaggucaagacgugcaucuggcccaagagccacacccugugguccaacggcgugcuggagagcgagaugaucgugcccaagaucuacgggggcccgaucucccagcacaacuaccgccccggguacuucacccagaccgccggccccuggcaccucgggaagcuggagcuggacuucgaccucugcgagggcacgaccgucgugguggacgagcacugcggcaaccgggggccgagccugcgcaccaccacggucaccggcaagaucauccacgaguggugcugccgguccugcacccugccgccccugcgcuucaagggggaggacggcugcugguacgggauggagauccggcccgugaaggagaaggaggagaaccuggucaagagcauggucagcgccggcuccggcgagguggacagcuucucccuggggcuccugugcaucagcaucaugaucgaggaggugaugcgcucccgguggagccgcaagaugcugaugaccggcacgcucgccgucuucuuccugcugaucauggggcagcucaccuggaacgaccugauccggcugugcaucauggugggcgccaacgcguccgaccgcauggggaugggcaccaccuaccucgcccugauggccacguucaagaugcgcccgauguucgccguggggcuccuguuccggcgccugaccagccgggagguccugcuccugaccaucgggcugucccucguggccagcgucgagcugcccaacucccuggaggagcucggcgacgggcuggcgaugggcaucaugauccugaagcuccugaccgacuuccagagccaccagcugugggccacgcuccugucccugaccuucaucaagaccaccuucagccuccacuacgccuggaagacgauggccauggugcuguccaucgugagccuguucccccucugccuguccaccaccagccagaagaccacguggcugcccguccuccugggcucccuggggugcaagccgcucaccauguuccugaucgcggagaacaagaucuggggccgcaagagcuggccccugaacgaggggaucauggccgugggcaucgugagcauccuccuguccagccugcucaagaacgacgucccccuggccgggccccugaucgccggcggcaugcucaucgccugcuacgugaucuccgggagcuccgcggaccugagccuggagaaggccgccgagguguccugggaggaggaggccgagcacagcggcgccucccacaacauccucgucgaggugcaggacgacgggaccaugaagaucaaggacgaggagcgggacgacacccugaccauccugcucaaggcgacgcugcuggccgugagcggcgucuacccgcucuccauccccgccacccuguucgugugguacuucuggcagaagaagaagcagcgcagcggggugcugugggacacccccagcccgcccgaggucgagcgggccgugcucgacgacggcaucuaccgcaucaugcagcggggccugcuggggcgcagccaggugggcgucgggguguuccaggagaacguguuccacaccauguggcacgucacgcggggcgccgugcugauguaccaggggaagcgccucgagcccuccugggcgagcgugaagaaggaccugaucuccuacggcggcggguggcggcugcagggcagcuggaacaccggggaggagguccaggugaucgccguggagcccggcaagaaccccaagaacguccagaccgcccccgggaccuucaagacguccgagggcgaggugggcgccaucgcccucgacuucaagcccgggaccagcggcagccccaucgugaaccgcgaggggaagaucgucggccuguacggcaacgggguggugaccaccuccggcacguacgucagcgcgaucgcccaggccaaggccucccaggaggggccccugccggagaucgaggacgagguguuccggaagcgcaaccucaccaucauggaccugcaccccggcagcgggaagacccggcgcuaccugcccgcgaucgugcgggaggccaucaagcgcaagcuccggacccugauccuggccccgacgcgcgucguggccuccgagauggccgaggcgcucaagggcaugcccauccgcuaccagaccaccgccgucaagagcgagcacaccggcaaggagaucgucgaccugaugugccacgccacguucaccaugcggcugcucucccccgugcgcgugcccaacuacaacaugaucaucauggacgaggcccacuucaccgacccgagcuccaucgccgcgcggggguacaucagcacccgcgucggcaugggggaggccgccgccaucuucaugacggccacgccgcccggcuccguggaggcguucccccagagcaacgccaucauccaggacgaggagcgggacaucccggagcgcuccuggaacagcggguacgaguggaucaccgacuuccccggcaagaccgugugguucguccccuccaucaagagcggcaacgacaucgccaacugccugcggaagaacgggaagcgcgugauccagcugucccggaagacguucgacaccgaguaccagaagaccaagaacaacgacugggacuacguggucaccacggacaucagcgagaugggcgccaacuuccgcgcggaccgggugaucgacccccgccggugccucaagccggugauccugaaggacgggcccgagcgcgucauccuggccggccccaugcccgugaccgucgccuccgccgcccagcggcgcgggcggaucggccgcaaccacaacaaggagggcgaccaguacaucuacauggggcagccgcucaacaacgacgaggaccacgcgcacuggaccgaggccaagaugcugcuggacaacaucaacacccccgagggcaucauccccgcccucuucgagcccgagcgggagaaguccgccgccaucgacggggaguaccgccugcgcggcgaggcgcggaagacguucguggagcugaugcgccgcggggaccucccgguguggcugagcuacaaggucgccuccgagggcuuccaguacagcgaccgccgguggugcuucgacggcgagcgcaacaaccaggugcuggaggagaacauggacguggagaucuggaccaaggagggggagcggaagaagcuccgcccccgguggcuggacgcccgcaccuacuccgacccccuggcccuccgggaguucaaggaguucgccgcgggccgccggagcgucuccggggaccugauccuggagaucggcaagcucccccagcaccugacccagcgcgcccagaacgcccuggacaaccucgugaugcugcacaacagcgagcagggcgggcgggccuaccgccacgcgauggaggagcugccggacacgaucgagacccucaugcugcuggcccucaucgccgugcugaccggcggggucacccuguucuuccucuccggccgggggcugggcaagaccagcaucggccugcucugcgugauggccuccagcgugcugcuguggauggccuccgucgagccccacuggaucgcggccagcaucauccucgaguucuuccugauggugcugcucauccccgagcccgaccgccagcggacgccgcaggacaaccagcuggccuacguggucaucgggcuccucuucaugauccugaccguggccgccaacgagaugggccugcucgagaccaccaagaaggaccuggggaucggccacguggcggucgagaaccaccaccacgccgccaugcuggacguggaccuccaccccgccuccgccuggacgcuguacgcgguggccaccaccaucaucacccccaugaugcgccacacgaucgagaacaccaccgccaacaucagccugaccgccaucgccaaccaggcggccauccucauggggcuggacaagggcuggccgaucuccaagauggacaucggcgucccccugcucgcccuggggugcuacagccaggugaacccccugacgcucaccgccgcggugcugaugcuggucgcccacuacgccaucaucggccccgggcuccaggccaaggccacccgggaggcgcagaagcgcaccgccgccggcaucaugaagaacccgacgguggacgggaucguggccaucgaccuggaccccgucguguacgacgccaaguucgagaagcagcugggccagaucaugcuccugauccugugcaccucccagauccuccugaugcgcaccaccugggcgcugugcgagagcaucacgcucgccaccggcccccugaccacccugugggaggggucccccggcaaguucuggaacacgaccaucgccgugagcauggccaacaucuuccgggggagcuaccucgccggcgcgggccuggccuucucccugaugaagucccucgggggcgggcgccggggcaccggggcccagggcgagacccugggcgagaaguggaagcgccagcugaaccagcucgggaaguccgaguucaacacguacaagcggagcggcaucauggaggucgaccgcuccgaggccaaggaggggcugaagcggggcgagaccaccaagcacgcggugagccgcgggaccgccaagcugcggugguucguggagcgcaaccucgucaagccggagggcaaggugaucgaccugggcugcgggcggggcgggugguccuacuacugcgccggccugaagaaggugacggaggucaagggguacaccaagggcggccccgggcacgaggagcccauccccauggccaccuacggcuggaaccuggugaagcuccacagcgggaaggacguguucuucaucccgcccgagaagugcgacacccugcugugcgacaucggcgaguccagccccaaccccacgaucgaggaggggcgcacccuccggguccugaagaugguggagccguggcugcgcggcaaccaguucugcaucaagauccucaaccccuacaugcccuccguggucgagacccuggagcagaugcagcggaagcacggcgggaugcuggugcgcaacccccucagccggaacuccacccacgagauguacugggugagcugcggcaccgggaacaucgucuccgccgugaacaugacgagccgcaugcugcugaaccgguucaccauggcgcaccgcaagccgaccuacgagcgcgacguggaccucggcgccggcacccggcacgucgccguggagcccgagguggccaaccuggacaucaucgggcagcgcaucgagaacaucaagcacgagcacaaguccacguggcacuacgacgaggacaaccccuacaagaccugggccuaccacggcagcuacgaggucaagcccuccgggagcgcgagcuccauggugaacggcgucgugaagcugcucaccaagccgugggacgugauccccauggucacccagaucgccaugacggacaccacccccuucgggcagcagcggguguucaaggagaagguggacacccgcacgcccaaggccaagcggggcaccgcccagaucauggaggucaccgccaaguggcuguggggcuuccugagccgcaacaagaagccgcggaucugcacccgcgaggaguucacgcggaaggugcgcuccaacgcggccaucggggccguguucgucgacgagaaccaguggaacagcgccaaggaggcgguggaggacgagcgguucugggaccucgugcaccgcgagcgggagcugcacaagcagggcaagugcgcgaccugcgucuacaacaugauggggaagcgcgagaagaagcugggcgaguucgggaaggccaagggcucccgggccaucugguacauguggcucggcgcccgcuuccuggaguucgaggcgcugggguucaugaacgaggaccacugguucagccgggagaacucccucagcggcguggagggggagggccugcacaagcugggguacauccuccgcgacaucuccaagauccccggcggcaacauguacgccgacgacaccgccgggugggacacccggaucacggaggacgaccugcagaacgaggccaagaucaccgacaucauggagcccgagcacgcccugcucgccaagagcaucuucaagcugaccuaccagaacaaggugguccgcgugcagcggccggccaagaacggcaccgugauggacgucaucucccgccgcgaccagcgggggagcggccaggugggcacguacgggcugaacaccuucaccaacauggaggcccagcucauccgccagauggaguccgagggcaucuucagccccuccgagcuggagacccccaaccuggccgggcgggugcucgacuggcuggagaagcacggcgucgagcgccugaagcggauggccaucagcggggacgacugcguggugaagcccaucgacgaccgcuucgcgacggcccucaccgcccugaacgacaugggcaagguccggaaggacaucccgcagugggagcccuccaagggcuggaacgacuggcagcagguccccuucugcagccaccacuuccaccagcugaucaugaaggacgggcgcgagaucgugguccccugccggaaccaggacgagcucgugggccgcgcccgggugagccagggggccggcuggucccugcgcgagaccgcgugccugggcaagagcuacgcccagauguggcagcucauguacuuccaccggcgcgaccugcggcuggccgccaacgcgaucugcuccgccgucccgguggacugggugcccaccagccgcacgaccugguccauccacgcccaccaccaguggaugaccaccgaggacaugcucagcgucuggaaccggguguggaucgaggagaaccccuggauggaggacaagacgcacaucuccagcuggggcgacgugcccuaccugggcaagcgcgaggaccaguggugcgggucccugaucggccucaccgcccgggccaccugggcgaccaacauccaggucgccaucaaccaggugcgccgccugaucgggaacgagaacuaccuggacuacaugaccagcaugaagcgguucaagaacgaguccgacccggagggcgcccucugguga

SEQ ID NO: 8408 - RNA, 9879 nt, Artificial Sequence
  derived and/or modified CDS sequence (opt1) from DENV-1__FJ410236__SS-prME
agcgugaccaugcugcucaugcuggugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgagaccgagcccgacgacguggacugcuggugcaacgccacggacaccugggugaccuacgggaccugcagccagacgggcgagcaccggcgggacaagcgguccguggcccucgcgccccacgucggccuggggcuggagacccgcaccgagaccuggaugagcuccgagggcgccuggaagcagauccagcggguggagacgugggcccuccggcaccccggguucaccgugaucgcccuguuccuggcccacgcgaucggcaccagcaucacccagaaggggaucaucuucauccuccugaugcuggucacgcccuccauggccaugcggugcgugggcaucggcagccgcgacuucguggaggggcucuccggcgccaccugggucgacguggugcuggagcacgggagcugcgucaccaccauggccaaggacaagcccacgcuggacaucgagcuccugaagaccgaggugaccaaccccgccgugcugcggaagcucugcaucgaggcgaagaucuccaacaccacgaccgacagccgcugcccgacccagggcgaggccacccuggucgaggagcaggacgccaacuucgugugccggcgcacguucguggaccggggcugggggaacggcugcgggcuguucggcaaggggucccucaucacgugcgccaaguucaagugcgucaccaagcuggagggcaagaucgugcaguacgagaaccugaaguacagcgugaucgucaccgugcacacgggcgaccagcaccaggucgggaacgaguccaccgagcacggcaccaccgccaccaucacgccccaggcgcccaccaccgagauccagcucaccgacuacggggcccugacgcuggacugcagcccccgcaccggccucgacuucaacgagauggugcugcugaccaugaaggagaaguccuggcucgugcacaagcagugguuccuggaccugccccuccccuggaccagcggggccagcacgucccaggagaccuggaaccggcaggaccugcuggucaccuucaagaccgcccacgccaagaagcaggagguggugguccucggcagccaggagggcgcgaugcacacggcccugaccggggccaccgagauccagaccuccggcacgaccaccaucuucgccgggcaccugaagugccgccucaagauggacaagcugacccugaagggcaugagcuacgugaugugcacgggguccuucaagcucgagaaggagguggccgagacccagcacggcaccguccuggugcagaucaaguacgagggcaccgacgcgcccugcaagauccccuucagcacgcaggacgagaagggggugacccagaacggccggcugaucaccgccaacccgaucgucaccgacaaggagaagcccgugaacaucgaggccgagccgcccuucggggaguccuacaucgugaucggcgccggcgagaaggcgaugaagcugagcugguucaagaagggguccagcaucggcaagauguucgaggccacggcccgcggggcccggcgcauggccauccucggcgacaccgcgugggacuucggguccaucggcggcgucuucaccagcguggggaagcuggugcaccagaucuucggcaccgccuacgggguccuguucuccggcgugagcuggacgaugaagaucgggaucggcgugcuccugaccuggcugggccucaacucccgcagcaccucccugagcaugaccugcaucgccgucgggcuggugacgcucuaccugggcgugaugguccaggccgacuccgggugcgugaucaacuggaagggccgggagcugaagugcgggagcggcaucuucgugaccaacgagguccacaccuggaccgagcaguacaaguuccaggccgacagcccgaagcgccucuccgcggccaucggcaaggccugggaggagggggugugcggcauccggagcgccacccgccuggagaacaucauguggaagcagaucuccaacgagcugaaccacauccuccuggagaacgacaugaaguucacgguggucgugggggacguggccggcauccuggcgcaggggaagaagaugauccggccccagcccauggaguacaaguacagcuggaaguccuggggcaaggccaagaucaucggcgccgacguccagaacaccaccuucaucaucgacgggcccaacaccccggagugccccgacgaccagcgcgccuggaacaucugggagguggaggacuacggcuucgggaucuucacgaccaacaucuggcucaagcugcgggacagcuacacccaggugugcgaccaccgccugauguccgcggccaucaaggacagcaaggccguccacgccgacaugggcuacuggaucgaguccgagaagaacgagaccuggaagcucgcccgggcgagcuucaucgaggugaagacgugcaucuggcccaagucccacacccuguggagcaacggcgugcuggaguccgagaugaucauccccaagaucuacgggggcccgaucagccagcacaacuaccgccccggguacuucacccagaccgccggccccuggcaccucgggaagcuggagcuggacuucgaccucugcgagggcacgaccgucgugguggacgagcacugcggcaaccgggggccgucccugcgcaccaccacggucaccggcaagaucauccacgaguggugcugccggagcugcacccugccgccccugcgcuuccgcggggaggacggcugcugguacgggauggagauccgccccgugaaggagaaggaggagaaccuggugaaguccauggucagcgccggcagcggcgagguggacuccuucagccuggggcuccugugcaucuccaucaugaucgaggaggugaugcggagccgcuggucccggaagaugcugaugaccggcacgcucgccgucuucuuccugcugaucauggggcagcucaccuggaacgaccugauccgccugugcaucauggugggcgccaacgcgagcgaccgcauggggaugggcaccaccuaccucgcccugauggccacguucaagaugcggccgauguucgccgugggccuccuguuccgccggcugaccucccgcgagguccugcuccugaccaucgggcugagccucguggccuccgucgagcugcccaacagccuggaggagcucggcgacgggcuggcgaugggcaucaugauccugaagcuccugaccgacuuccagucccaccagcugugggccacgcuccugagccugaccuucaucaagaccaccuucucccuccacuacgccuggaagacgauggccauggugcugagcaucgugucccuguucccccucugccugagcaccaccucccagaagaccacguggcugcccguccuccugggcagccuggggugcaagccgcucaccauguuccugaucgcggagaacaagaucuggggccggcgcuccuggccccugaacgaggggaucauggccgugggcaucgugagcauccuccugagcucccugcucaagaacgacgucccccuggccgggccccugaucgccggcggcaugcucaucgccugcuacgugaucagcggguccagcgcggaccugucccuggagaaggccgccgaggugagcugggaggaggaggccgagcacuccggcgccagccacaacauccucgucgaggugcaggacgacgggaccaugaagaucaaggacgaggagcgggacgacacccugaccauccugcucaaggcgacgcugcuggccguguccggcgucuacccgcucagcauccccgccacccuguucgugugguacuucuggcagaagaagaagcagcgcuccggggugcugugggacacccccagcccgcccgaggucgagcgggccgugcucgacgacggcaucuaccgcaucaugcagcggggccugcuggggcgcucccaggugggcgucgggguguuccaggagaacguguuccacaccauguggcacgucacgcggggcgccgugcugauguaccaggggaagcgccucgagcccagcugggcguccgugaagaaggaccugaucagcuacggcggcggguggcggcugcagggcuccuggaacaccggggaggagguccaggugaucgccguggagcccggcaagaaccccaagaacguccagaccgcccccgggaccuucaagacgcccgagggcgaggugggcgccaucgcccucgacuucaagcccgggaccagcggcucccccaucgugaaccgcgaggggaagaucgucggccuguacggcaacgggguggugaccaccagcggcacguacgucagcgcgaucgcccaggccaaggccucccaggaggggccgcugcccgagaucgaggacgagguguuccggaagcgcaaccucaccaucauggaccugcaccccggcagcgggaagacccggcgcuaccugccggcgaucgugcgggaggccaucaagcgcaagcuccgcacccugauccuggcccccacgcgggucguggccuccgagauggccgaggcgcucaagggcaugcccauccgcuaccagaccaccgccgucaagagcgagcacaccggcaaggagaucgucgaccugaugugccacgccacguucaccaugcggcugcucucccccgugcgcgugccgaacuacaacaugaucaucauggacgaggcccacuucaccgaccccagcuccaucgccgcgcggggguacaucagcacccgcgucggcaugggggaggccgccgccaucuucaugacggccacgccgcccggcuccguggaggcguucccgcagagcaacgccgugauccaggacgaggagcgggacauccccgagcgcuccuggaacagcggguacgaguggaucaccgacuuccccggcaagaccgucugguucgugcccuccaucaagagcggcaacgacaucgccaacugccugcggaagaacgggaagcgcgugauccagcugucccggaagacguucgacaccgaguaccagaagaccaagaacaacgacugggacuacgucgugaccacggacaucagcgagaugggcgccaacuuccgcgcggaccgggugaucgacccgcgccggugccucaagcccgucauccugaaggacgggcccgagcgcgugauccuggccggccccaugccggucaccguggccuccgccgcccagcggcgcgggcggaucggccgcaaccacaacaaggagggcgaccaguacaucuacauggggcagccccucaacaacgacgaggaccacgcgcacuggaccgaggccaagaugcugcuggacaacaucaacacccccgagggcaucauccccgcccucuucgagccggagcgcgagaaguccgccgccaucgacggggaguaccggcugcgcggcgaggcgcggaagacguucguggagcugaugcgccgcggggaccuccccgucuggcuguccuacaagguggccagcgagggcuuccaguacagcgaccgccgguggugcuucgacggcgagcgcaacaaccaggugcuggaggagaacauggacgucgagaucuggaccaaggagggggagcggaagaagcuccgcccccgguggcuggacgcccgcaccuacuccgacccccuggcccuccgggaguucaaggaguucgccgcgggccgccggagcguguccggggaccugauccuggagaucggcaagcucccgcagcaccugacccagcgcgcccagaacgcccuggacaaccucgugaugcugcacaacagcgagcagggcgggcgggccuaccgccacgcgauggaggagcugcccgacacgaucgagacccucaugcugcuggcccucaucgccguccugaccggcggggugacccuguucuuccucuccggccgggggcugggcaagaccagcaucggccugcucugcgugauggccuccagcguccugcuguggauggccuccguggagccccacuggaucgcggccagcaucauccucgaguucuuccugauggugcugcucauccccgagccggaccgccagcggacgccccaggacaaccagcuggccuacgucgugaucgggcuccucuucaugauccugaccguggccgccaacgagaugggccugcucgagaccaccaagaaggaccuggggaucggccacgucgcgguggagaaccaccaccacgccgccaugcuggacguggaccuccaccccgccuccgccuggacgcuguacgcggucgccaccaccaucaucaccccgaugaugcgccacacgaucgagaacaccaccgccaacaucagccugaccgccaucgccaaccaggcggccauccucauggggcuggacaagggcuggcccaucuccaagauggacaucggcgugccccugcucgcccuggggugcuacagccaggugaacccccugacgcucaccgccgcgguccugaugcugguggcccacuacgccaucaucggcccggggcuccaggccaaggccacccgcgaggcgcagaagcggaccgccgccggcaucaugaagaaccccacgguggacgggaucgucgccaucgaccuggaccccgugguguacgacgccaaguucgagaagcagcugggccagaucaugcuccugauccugugcaccucccagauccuccugaugcgcaccaccugggcgcugugcgagagcaucacgcucgccaccggcccccugaccacccugugggagggguccccgggcaaguucuggaacacgaccaucgccgucagcauggccaacaucuuccggggguccuaccucgccggcgcgggccuggccuucagccugaugaagucccucgggggcgggcgccggggcaccggggcccagggcgagacccugggcgagaaguggaagcgccagcugaaccagcucuccaagagcgaguucaacacguacaagcgguccgggaucauggagguggaccgcagcgaggccaaggagggccugaagcgcggggagaccaccaagcacgcggugucccgcggcaccgccaagcugcggugguucgucgagcgcaaccucgugaagcccgaggggaaggugaucgaccugggcugcggccgcggcggguggagcuacuacugcgccgggcugaagaaggucacggaggugaagggguacaccaagggcggccccggccacgaggagcccaucccgauggccaccuacggguggaaccuggugaagcuccacuccggcaaggacgucuucuucaucccgcccgagaagugcgacacccugcugugcgacaucggggagagcucccccaacccgacgaucgaggagggccgcacccuccgggugcugaagaugguggagcccuggcugcgcgggaaccaguucugcaucaagauccucaaccccuacaugcccagcgucguggagacccuggagcagaugcagcggaagcacggcggcaugcuggugcgcaacccgcucucccggaacagcacccacgagauguacugggucuccugcgggaccggcaacaucgugagcgccgugaacaugacgucccgcaugcugcugaaccgcuucaccauggcgcaccggaagcccaccuacgagcgcgacgucgaccucggggccggcacccggcacguggccguggagcccgaggucgccaaccuggacaucaucggccagcgcaucgagaacaucaagcacgagcacaagagcacguggcacuacgacgaggacaaccccuacaagaccugggccuaccacggguccuacgaggugaagccgagcggcuccgcgagcagcauggucaacgggguggugaagcugcucaccaagcccugggacgucauccccauggugacccagaucgccaugacggacaccacccccuucggccagcagcggguguucaaggagaaggucgacacccgcacgccgaaggccaagcgggggaccgcccagaucauggaggugaccgccaaguggcuguggggcuuccugucccgcaacaagaagccccggaucugcacccgcgaggaguucacgcggaaggugcgcagcaacgcggccaucggcgccgucuucguggacgagaaccaguggaacuccgccaaggaggcgguggaggacgagcgguucugggaccucguccaccgcgagcgggagcugcacaagcaggggaagugcgcgaccugcguguacaacaugaugggcaagcgcgagaagaagcugggggaguucggcaaggccaaggggagccgggccaucugguacauguggcucggcgcccgcuuccuggaguucgaggcgcugggcuucaugaacgaggaccacugguucucccgggagaacagccucuccgggguggagggcgaggggcugcacaagcugggcuacauccuccgcgacaucagcaagauccccgggggcaacauguacgccgacgacaccgccggcugggacacccggaucacggaggacgaccugcagaacgaggcccgcaucaccgacaucauggagccggagcacgcccugcucgcgaaguccaucuucaagcugaccuaccagaacaaggucgugcgcgugcagcggcccgccaagaacgggaccgucauggacgugaucagccgccgggaccagcgcggcuccggccagguggggacguacggccugaacaccuucaccaacauggaggcccagcucauccggcagauggagagcgaggggaucuucucccccagcgagcuggagacccccaaccuggccgagcgcguccucgacuggcuggagaaguacggcgugaagcggcugaagcgcauggccaucuccggggacgacugcguggucaagccgaucgacgaccgguucgcgacggcccucaccgcccugaacgacaugggcaaggugcgcaaggacaucccccagugggagcccagcaagggguggaacgacuggcagcagguccccuucugcucccaccacuuccaccagcugaucaugaaggacggccgggagaucgucgugccgugccgcaaccaggacgagcucgugggccgggcccgcgucagccagggggccggcuggagccugcgggagaccgcgugccuggggaaguccuacgcccagauguggcagcucauguacuuccaccgccgggaccugcgccuggccgccaacgcgaucugcagcgccgugcccguggacuggauccccaccucccggacgaccuggagcauccacgcccaccaccaguggaugaccaccgaggacaugcucuccgucuggaaccgcguguggaucgaggagaaccccuggauggaggacaagacgcacaucagcuccuggggcgacgugccguaccuggggaagcgcgaggaccaguggugcggcagccugaucggccucaccgcccgggccaccugggcgaccaacauccaggucgccaucaaccaggugcgccggcugaucgggaacgagaacuaccuggacuacaugaccuccaugaagcgcuucaagaacgagagcgaccccgagggcgcccucugguga

SEQ ID NO: 8409 - RNA, 9879 nt, Artificial Sequence
  derived and/or modified CDS sequence (opt1) from DENV-1__FJ410238__SS-prME
agcgugaccaugcugcugaugcugaugcccaccgcccuggccuuccaccucacgacccggggcggggagccccacaugaucgugagcaagcaggagcggggcaagagccugcuguucaagaccagcgcgggggugaacaugugcacccucaucgccauggaccugggcgaguucugcgaggacacgaugaccuacaagugcccccggaucaccgaggccgagcccgacgacguggacugcuggugcaacgccaccgacacgugggugaccuacgggaccugcagccagaccggcgagcaccggcgggacaagcgguccguggcccuggcgccccacgugggccucgggcuggagacgcgcaccgagaccuggaugagcuccgagggcgccuggaagcagauccagcggguggagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugcccgacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaagaucguccaguacgagaaccugaaguacagcgugaucgugaccguccacaccggcgaccagcaccagguggggaacgaguccacggagcacggcaccaccgcgaccaucacgccccaggcccccagcacggagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccagcggggccuccaccagccaggagaccuggaaccggcaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcauguccuacgucaugugcaccgggagcuucaagcuggagaaggagguggcggagacccagcacggcacggugcucguccagaucaaguacgagggcaccgacgcccccugcaagauccccuucuccacccaggacgagaagggggugacccagaacggccggcugaucacggccaacccgaucgugaccgacaaggagaagcccgucaacaucgaggccgagccgcccuucggggagagcuacaucgugaucggcgcgggcgagaaggcccugaagcuguccugguucaagaaggggagcuccaucggcaagauguucgaggccaccgcccgcggggcccggcgcauggcgauccucggcgacaccgccugggacuucgggagcaucggcggcguguucacguccgucgggaagcuggugcaccagaucuucggcaccgccuacggggugcuguucagcggcgucuccuggaccaugaagaucgggaucggcgugcuccugaccuggcugggccucaacagccgcuccacgagccuguccaugaccugcaucgccguggggcuggucacccucuaccugggcgugauggugcaggccgacagcgggugcgucaucaacuggaagggccgggagcugaagugcgggagcggcaucuucgugaccaacgaggugcacacguggaccgagcaguacaaguuccaggcggacuccccgaagcgccucagcgccgccaucggcaaggccugggaggagggggucugcggcauccgguccgccacccgccuggagaacaucauguggaagcagaucagcaacgagcugaaccacauccuccuggagaacgacaugaagcugaccgugguggucggggacguggcgggcauccucgcccaggggaagaagaugauccggccccagcccauggaguacaaguacuccuggaaguccuggggcaaggccaagaucaucggcgccgacgugcagaacaccacguucaucaucgacgggcccaacaccccggagugccccgacgaccagcgcgcguggaacaucugggaggucgaggacuacggcuucgggaucuucaccaccaacaucuggcugaagcugcgggacuccuacacccaggugugcgaccaccgccucaugagcgccgccaucaaggacuccaaggccgugcacgccgacaugggcuacuggaucgagagcgagaagaacgagaccuggaagcuggcgcgggccuccuucaucgaggucaagaccugcaucuggcccaagagccacacccugugguccaacggcgugcucgagagcgagaugaucauccccaagaucuacgggggcccgaucucccagcacaacuaccgccccggguacuucacgcagaccgccggccccuggcaccuggggaagcuggagcucgacuucgaccugugcgagggcaccaccguggucguggacgagcacugcggcaaccgggggccgagccugcgcacgaccaccgugaccggcaagaucauccacgaguggugcugccgguccugcacgcugccgccccuccgcuucaagggggaggacggcugcugguacgggauggagauccggcccgucaaggagaaggaggagaaccuggucaagagcauggugagcgccggcuccggcgaggucgacagcuucucccucgggcugcugugcaucagcaucaugaucgaggaggugaugcgcucccgguggagccgcaagaugcucaugaccggcacccuggccguguucuuccugcucaucauggggcagcugaccuggaacgaccugauccggcucugcaucauggucggcgcgaacacguccgaccgcauggggaugggcaccaccuaccuggcccugauggccaccuucaagaugcgcccgauguucgccgugggccuccuguuccggcgccugacgagccgggaggugcuccugcugaccaucgggcucucccuggucgccagcgcggagcugcccaacucccucgaggagcugggcgacgggcuggccaugggcaucaugauccucaagcugcugaccgacuuccagagccaccagcucugggccacccugcugucccucacguucauccgcaccaccuucagccugcacuacgccuggaagaccauggcgauggugcuguccaucgucagccucuucccccugugccuguccacgaccagccagaagaccaccuggcuccccgugcugcugggcucccucgggugcaagccgcugacgauguuccugaucgccgagaacaagaucuggggccgcaagagcuggccccucaacgaggggaucauggccgugggcaucgucagcauccugcuguccagccuccugaagaacgacgugccccuggccgggccccucaucgccggcggcaugcugaucgcgugcuacgugaucuccgggagcuccgccgaccugagccucgagaaggccgccgaggucuccugggaggaggaggccgagcacagcggcgcgucccacaacauccugguggaggugcaggacgacgggaccaugaagaucaaggacgaggagcgcgacgacacccugaccauccuccugaaggccacccugcucgccgucagcggcguguacccgcuguccauccccgccacgcuguucgugugguacuucuggcagaagaagaagcagcggagcgggguccucugggacacccccagcccgcccgagguggagcgcgccgugcuggacgacggcaucuaccggaucaugcagcgcggccugcuggggcggagccaggucggcguggggguguuccaggagaacgucuuccacaccauguggcacgugacccgcggcgcggugcucauguaccaggggaagcggcuggagcccuccugggccagcgucaagaaggaccugaucuccuacggcggcggguggcgccuccagggcagcuggaacacgggggaggagguccaggugaucgccgucgagcccggcaagaaccccaagaacgugcagaccgcccccgggaccuucaagaccuccgagggcgaggugggcgccaucgcgcuggacuucaagcccgggacgagcggcagccccaucgucaaccgggaggggaagaucgugggccuguacggcaacgggguggucaccaccuccggcaccuacgugagcgccaucgcccaggccaaggcgucccaggaggggccccucccggagaucgaggacgagguguuccgcaagcggaaccugacgaucauggaccugcaccccggcagcgggaagacccgccgguaccuccccgccaucguccgcgaggccaucaagcggcgccugcgcacccugauccucgccccgacccgggugguggccuccgagauggcggaggcccugaagggcaugcccauccgcuaccagacgaccgccgucaagagcgagcacaccggcaaggagaucguggaccugaugugccacgccaccuucacgaugcggcuccugucccccgugcgcguccccaacuacaacaugaucaucauggacgaggcccacuucaccgacccgagcuccaucgcggcccggggguacaucagcacccgcgugggcaugggggaggccgccgccaucuucaugaccgcgacgccgcccggcuccguggaggccuucccccagagcaacgccgucauccaggacgaggagcgggacaucccggagcgcuccuggaacagcggguacgaguggaucaccgacuuccccggcaagaccgugugguucgugcccuccaucaagagcggcaacgacaucgccaacugccugcggaagaacgggaagcgcgucauccagcucucccggaagaccuucgacacggaguaccagaagaccaagaacaacgacugggacuacguggugaccaccgacaucagcgagaugggcgcgaacuuccgcgccgaccgggucaucgacccccgccggugccugaagccggugauccugaaggacgggcccgagcgcgugauccucgccggccccaugcccgucacgguggccuccgccgcgcagcggcgcgggcggaucggccgcaaccacaacaaggagggcgaccaguacaucuacauggggcagccgcugaacaacgacgaggaccacgcccacuggaccgaggccaagaugcugcucgacaacaucaacacccccgagggcaucauccccgcccuguucgagcccgagcgcgagaaguccgccgcgaucgacggggaguaccggcugcgcggcgaggcccggaagaccuucgucgagcucaugcgccgcggggaccugccgguguggcugagcuacaagguggccuccgagggcuuccaguacagcgaccgccgguggugcuucgacggcgagcgcaacaaccagguccucgaggagaacauggacguggagaucuggacgaaggagggggagcggaagaagcugcgcccccgguggcuggacgcccgcaccuacuccgacccccucgcccugcgggaguucaaggaguucgcggccggccgccggagcguguccggggaccugauccucgagaucggcaagcugccccagcaccugacccagcgcgcccagaacgcccucgacaaccuggucaugcugcacaacagcgagcagggcgggcggguguaccgccacgcgauggaggagcucccggacaccaucgagacgcugaugcugcucgcccugaucgccgugcugaccggcggggucacccucuucuuccuguccggccgggggcugggcaagaccagcaucggccuccugugcgugauggccuccagcgugcugcucuggauggccuccgucgagccccacuggaucgcggccagcaucauccuggaguucuuccugauggugcuccugauccccgagcccgaccgccagcggaccccgcaggacaaccagcuggccuacguggucaucgggcuccuguucaugauccugacgguggccgccaacgagaugggccuccuggagaccaccaagaaggaccuggggaucggccacguggcggucgagaaccaccaccacgccgccaugcucgacguggaccugcaccccgccuccgccuggacccuguacgcgguggccacgaccaucaucacccccaugaugcgccacaccaucgagaacacgaccgccaacaucagccucaccgccaucgccaaccaggcggccauccugauggggcuggacaagggcuggccgaucuccaagauggacaucggcgucccccuccuggcccuggggugcuacagccaggugaacccccucacccugacggccgcggugcugaugcucgucgcccacuacgccaucaucggccccgggcugcaggccaaggccacccgcgaggcgcagaagcggaccgccgccggcaucaugaagaacccgaccguggacgggaucguggccaucgaccuggaccccgucguguacgacgccaaguucgagaagcagcucggccagaucaugcugcugauccucugcacgucccagauccugcugaugcgcaccaccugggcgcucugcgagagcaucacccuggccacgggcccccugaccacccucugggaggggucccccggcaaguucuggaacaccacgaucgccgugagcauggccaacaucuuccgggggagcuaccuggccggcgcgggccuggccuucucccucaugaagucccucgggggcgggcgccgggggaccggggcccagggcgagacccugggcgagaaguggaagcgccagcucaaccagcuguccaagagcgaguucaacaccuacaagcgguccgggaucauggaggucgaccgcagcgaggccaaggagggccugaagcgcggggagacgaccaagcacgcggugucccgcggcaccgccaagcuccggugguucguggagcgcaaccuggucaagccggaggggaaggugaucgaccugggcugcggccgcggcggguggagcuacuacugcgccgggcugaagaaggugaccgaggucaagggguacacgaagggcgggcccggccacgaggagcccauccccauggccaccuacggguggaaccucgugaagcugcacuccggcaaggacguguucuucaucccgcccgagaagugcgacacccugcucugcgacaucggggagagcucccccaaccccaccaucgaggagggccgcacgcugcggguccugaagaugguggagccguggcuccgcgggaaccaguucugcaucaagauccugaaccccuacaugcccagcguggucgagacccuggagcagaugcagcggaagcacggcggcaugcucgugcgcaacccccugucccggaacagcacccacgagauguacuggguguccugcgggaccggcaacaucgucagcgccgugaacaugaccucccgcaugcugcucaaccgcuucacgauggcgcaccggaagccgaccuacgagcgcgacguggaccugggggccggcacccggcacgucgccguggagcccgagguggccaaccuggacaucaucggccagcgcaucgagaacaucaagcacgagcacaagagcaccuggcacuacgacgaggacaaccccuacaagacgugggccuaccacggguccuacgaggucaagcccagcggcagcgcguccagcauggugaacggggucgugaagcuccugaccaagccgugggacgugauccccauggucacccagaucgccaugaccgacacgacccccuucggccagcagcggguguucaaggagaagguggacacccgcacccccaaggccaagcgggggacggcccagaucauggaggucaccgccaaguggcuguggggcuuccucucccgcaacaagaagccgcggaucugcacccgcgaggaguucacccggaaggugcgcagcaacgcggccaucggcgccguguucgucgacgagaaccaguggaacuccgccaaggaggcgguggaggacgagcgguucugggaccuggugcaccgcgagcgggagcugcacaagcaggggaagugcgccacgugcgucuacaacaugaugggcaagcgcgagaagaagcucggggaguucggcaaggccaaggggagccgggccaucugguacauguggcugggcgcccgcuuccuggaguucgaggcgcucggcuucaugaacgaggaccacugguucucccgggagaacagccuguccgggguggagggcgaggggcugcacaagcucggcuacauccugcgcgacaucagcaagauccccgggggcaacauguacgccgacgacaccgccggcugggacacccggaucaccgaggacgaccugcagaacgaggccaagaucacggacaucauggagcccgagcacgcccuccuggcgaaguccaucuucaagcugaccuaccagaacaaggugguccgcgugcagcgcccggccaagaacgggaccgugauggacgucaucagccggcgcgaccagcggggcuccggccaggugggcaccuacggccucaacacguucaccaacauggaggcccagcugauccgccagauggagagcgaggggaucuucucccccagcgagcuggagacccccaaccucgccggccgggugcuggacuggcuggagaagcacggggucgagcgccucaagcggauggccaucuccggcgacgacugcguggugaagcccaucgacgaccgcuucgcgaccgcccugacggcccugaacgacauggggaagguccggaaggacaucccgcagugggagcccagcaagggcuggaacgacuggcagcagguccccuucugcagccaccacuuccaccagcucaucaugaaggacggccgcgagaucgugguccccugccggaaccaggacgagcugguggggcgcgcccgggugucccagggcgccggguggagccugcgcgagaccgcgugccucggcaaguccuacgcccagauguggcagcugauguacuuccaccggcgcgaccugcggcucgccgccaacgcgaucugcagcgccgucccgguggacugggugcccaccucccgcaccacguggagcauccacgcccaccaccaguggaugaccaccgaggacaugcuguccgucuggaaccggguguggaucgaggagaaccccuggauggaggacaagacccacgugagcuccuggggcgacguccccuaccugggcaagcgcgaggaccaguggugcggcagccucaucgggcugacggcccgcgccaccugggcgaccaacauccagguggccaucaaccaggugcggcgccugcucggcaacgagaacuaccuggacuacaugaccuccaugaagcgguucaagaacgagagcgacccggagggggcccugugguga

SEQ ID NO: 8410 - RNA, 9879 nt, Artificial Sequence
  derived and/or modified CDS sequence (opt1) from DENV-1__FJ410239__SS-prME
agcgugaccaugcugcugaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgagaccgagcccgacgacguggacugcuggugcaacgccacggacaccugggugaccuacgggaccugcagccagacgggcgagcaccggcgggacaagcgguccguggcccucgcgccccacgugggccuggggcuggagacccgcaccgagaccuggaugagcuccgagggcgccuggaagcagauccagcgggucgagacgugggcccuccggcaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagcuggccgagacccagcacggcaccgugcuggugcagaucaaguacgagggcaccgacgcgcccugcaagauccccuucagcacgcaggacgagaagggggucacccagaacggccggcugaucaccgccaacccgaucgugaccgacaaggagaagcccgugaacaucgaggccgagccgcccuucggggaguccuacaucgucaucggcgccggcgagaaggcgcucaagcugagcugguucaagaagggguccagcaucggcaagauguucgaggccacggcccgcggggcccggcgcauggccauccugggcgacaccgcgugggacuucggguccaucggcggcguguucaccagcgccgggaagcucgugcaccagaucuucggcaccgccuacgggguccuguucuccggcgugagcuggacgaugaagaucgggaucggcgugcugcucaccuggcugggccugaacucccgcagcaccucccucagcaugaccugcaucgccgucgggcuggugacgcuguaccucggcgugaugguccaggccgacuccgggugcgugaucaacuggaagggccgggagcugaagugcgggagcggcaucuucgugaccaacgagguccacaccuggaccgagcaguacaaguuccaggcggacagcccgaagcgccuguccgccgccaucggcaaggccugggaggagggggugugcggcauccggagcgccacccgccucgagaacaucauguggaagcagaucuccaacgagcugaaccacauccugcucgagaacgacaugaaguucacgguggucgugggggacguggcgggcauccuggcccaggggaagaagaugauccggccccagcccauggaguacaaguacagcuggaaguccuggggcaaggccaagaucaucggcgccgacguccagaacaccaccuucaucaucgacgggcccaacaccccggagugccccgacgaccagcgcgcguggaacaucugggagguggaggacuacggcuucgggaucuucacgaccaacaucuggcugaagcuccgggacagcuacacccaggugugcgaccaccgccugauguccgccgccaucaaggacagcaaggccguccacgccgacaugggcuacuggaucgaguccgagaagaacgagaccuggaagcuggcgcgggccagcuucaucgaggugaagacgugcaucuggcccaagucccacacccucuggagcaacggcgugcuggaguccgagaugaucauccccaagaucuacgggggcccgaucagccagcacaacuaccgccccggguacuucacccagaccgccggccccuggcaccuggggaagcucgagcuggacuucgaccugugcgagggcacgaccgucgugguggacgagcacugcggcaaccgggggccgucccuccgcaccaccacggucaccggcaagaucauccacgaguggugcugccggagcugcacccugccgccccugcgcuuccgcggggaggacggcugcugguacgggauggagauccgccccgugaaggagaaggaggagaaccucgugaaguccauggucagcgccggcagcggcgagguggacuccuucagccuggggcugcucugcaucuccaucaugaucgaggaggugaugcggagccgcuggucccggaagaugcugaugaccggcacgcuggccgucuucuuccuccugaucauggggcagcugaccuggaacgaccucauccgccugugcaucauggugggcgcgaacgccagcgaccgcauggggaugggcaccaccuaccuggcccucauggccacguucaagaugcggccgauguucgccgugggccugcuguuccgccggcucaccucccgcgagguccugcugcucaccaucgggcugagccugguggcguccguggagcuccccaacagccuggaggagcugggcgacgggcucgccaugggcaucaugauccugaagcugcucaccgacuuccagucccaccagcugugggccacgcugcucagccugaccuucaucaagaccaccuucucccugcacuacgccuggaagacgauggcgaugguccucagcaucgugucccuguucccccugugccucagcaccaccucccagaagaccacguggcugcccgucuuccugggcagccucgggugcaagccgcugaccauguuccugaucgccgagaacaagaucuggggccggcgcuccuggccccucaacgaggggaucauggccgugggcaucgugagcauccugcugagcucccuccugaagaacgacgucccccuggccgggccccucaucgccggcggcaugcugaucgcgugcuacgugaucagcggguccagcgccgaccugucccucgagaaggccgccgaggugagcugggaggaggaggccgagcacuccggcgcgagccacaacauccuggucgaggugcaggacgacgggaccaugaagaucaaggacgaggagcgggacgacacccugaccauccuccugaaggccacgcugcucgccguguccggcgucuacccgcugagcauccccgccacccuguucgugugguacuucuggcagaagaagaagcagcgcuccggggugcucugggacacccccagcccgcccgaggucgagcgggccgugcuggacgacggcaucuaccgcaucaugcagcggggccugcuggggcgcucccaggugggcgucgggguguuccaggagaacguguuccacaccauguggcacgucacgcggggcgcggugcucauguaccaggggaagcgccuggagcccagcugggccuccgugaagaaggaccugaucagcuacggcggcggguggcggcuccagggcuccuggaacaccggggaggagguccaggugaucgccguggagcccggcaagaaccccaagaacguccagaccgcccccgggaccuucaagacgcccgagggcgaggugggcgccaucgcgcuggacuucaagcccgggaccagcggcucccccaucgugaaccgcgaggggaagaucgucggccuguacggcaacgggguggugaccaccagcggcacguacgucagcgccaucgcccaggccaaggcgucccaggaggggccgcuccccgagaucgaggacgagguguuccggaagcgcaaccugaccaucauggaccugcaccccggcagcgggaagacccggcgcuaccucccggccaucgugcgggaggccaucaagcgcaagcugcgcacccugauccucgcccccacgcgggucguggccuccgagauggcggaggcccugaagggcaugcccauccgcuaccagaccaccgccgucaagagcgagcacaccggcaaggagaucgucgaccugaugugccacgccacguucaccaugcggcuccugucccccgugcgcgugccgaacuacaacaugaucaucauggacgaggcccacuucaccgaccccagcuccaucgcggcccggggguacaucagcacccgcgucggcaugggggaggccgccgccaucuucaugacggcgacgccgcccggcuccguggaggccuucccgcagagcaacgccgugauccaggacgaggagcgggacauccccgagcgcuccuggaacagcggguacgaguggaucaccgacuuccccggcaagaccgucugguucgugcccuccaucaagagcggcaacgacaucgccaacugccugcggaagaacgggaagcgcgugauccagcucucccggaagacguucgacaccgaguaccagaagaccaagaacaacgacugggacuacgucgugaccacggacaucagcgagaugggcgcgaacuuccgcgccgaccgggugaucgacccgcgccggugccugaagcccgucauccugaaggacgggcccgagcgcgugauccucgccggccccaugccggugaccgucgccuccgccgcgcagcggcgcgggcggaucggccgcaaccacaacaaggagggcgaccaguacaucuacauggggcagccccugaacaacgacgaggaccacgcccacuggaccgaggccaagaugcugcucgacaacaucaacacccccgagggcaucauccccgcccuguucgagccggagcgcgagaaguccgccgcgaucgacggggaguaccggcugcgcggcgaggcccggaagacguucguggagcucaugcgccgcggggaccugcccgucuggcuguccuacaagguggccagcgagggcuuccaguacagcgaccgccgguggugcuucgacggcgagcgcaacaaccaggugcucgaggagaacauggacgucgagaucuggaccaaggagggggagcggaagaagcugcgcccccgguggcuggacgcccgcaccuacuccgacccccucgcccugcgggaguucaaggaguucgcggccggccgccggagcguguccggggaccugauccucgagaucggcaagcugccgcagcaccugacccagcgcgcccagaacgcccucgacaaccuggugaugcugcacaacagcgagcagggcgggcgggcguaccgccacgccauggaggagcuccccgacacgaucgagacccugaugcugcucgcccugaucgccguccugaccggcggggugacccucuucuuccuguccggccgggggcugggcaagaccagcaucggccuccugugcgugauggccuccagcguccugcucuggauggcguccguggagccccacuggaucgccgccagcaucauccuggaguucuuccugauggugcuccugauccccgagccggaccgccagcggacgccccaggacaaccagcuggccuacgucgugaucgggcuccuguucaugauccugaccguggccgcgaacgagaugggccuccuggagaccaccaagaaggaccuggggaucggccacgucgccguggagaaccaccaccacgccgccaugcucgacguggaccugcaccccgccuccgcguggacgcuguacgccgucgccaccaccaucaucaccccgaugaugcgccacacgaucgagaacaccaccgccaacaucagccucaccgccaucgcgaaccaggccgccauccugauggggcuggacaagggcuggcccaucuccaagauggacaucggcgugccccuccuggcccuggggugcuacagccaggugaacccccucacgcugaccgcggccguccugaugcucguggcccacuacgccaucaucggcccggggcugcaggccaaggcgacccgcgaggcccagaagcggaccgccgccggcaucaugaagaaccccacgguggacgggaucgucgccaucgaccuggaccccgugguguacgacgcgaaguucgagaagcagcucggccagaucaugcugcugauccucugcaccucccagauccugcugaugcgcaccaccugggcccucugcgagagcaucacgcuggccaccggcccccugaccacccucugggagggguccccgggcaaguucuggaacacgaccaucgccgucagcauggccaacaucuuccggggguccuaccuggcgggcgccggccuggccuucagccucaugaagucccucgggggcgggcgccgggggaccggggcccagggcgagacccugggcgagaaguggaagcgccagcucaaccagcuguccaagagcgaguucaacacguacaagcgguccgggaucauggagguggaccgcagcgaggcgaaggagggccugaagcgcggggagaccaccaagcacgccgugucccgcggcaccgccaagcuccggugguucgucgagcgcaaccuggugaagcccgaggggaaggugaucgaccugggcugcggccgcgggggcuggagcuacuacugcgccgggcugaagaaggucacggaggugaagggcuacaccaagggcggccccggccacgaggagcccaucccgauggccaccuacggguggaaccucgugaagcugcacuccggcaaggacgucuucuucaucccgcccgagaagugcgacacccugcucugcgacaucggggagagcucccccaacccgacgaucgaggagggccgcacccugcgggugcugaagaugguggagcccuggcuccgcgggaaccaguucugcaucaagauccugaaccccuacaugcccagcgucguggagacccuggagcagaugcagcggaagcacggcggcaugcucgugcgcaacccgcugucccggaacagcacccacgagauguacugggucuccugcgggaccggcaacaucgugagcgcggugaacaugacgucccgcaugcugcucaaccgcuucaccauggcccaccggaagcccaccuacgagcgcgacgucgaccugggggccggcacccggcacguggccguggagcccgaggucgccaaccuggacaucaucggccagcgcaucgagaacaucaagcacgagcacaagagcacguggcacuacgacgaggacaaccccuacaagaccugggcguaccacggguccuacgaggugaagccgagcggcuccgccagcagcauggugaacggggucgugaagcuccugaccaagcccugggacgucauccccauggugacccagaucgccaugacggacaccacccccuucggccagcagcggguguucaaggagaaggucgacacccgcacgccgaaggccaagcgggggaccgcccagaucauggaggugaccgcgaaguggcuguggggcuuccucucccgcaacaagaagccccggaucugcacccgcgaggaguucacgcggaaggugcgcagcaacgccgccaucggcgccgucuucguggacgagaaccaguggaacuccgcgaaggaggccguggaggacgagcgguucugggaccugguccaccgcgagcgggagcugcacaagcaggggaagugcgcgaccugcguguacaacaugaugggcaagcgcgagaagaagcucggggaguucggcaaggccaaggggagccgggccaucugguacauguggcugggcgcgcgcuuccuggaguucgaggcccucggcuucaugaacgaggaccacugguucucccgggagaacagccuguccgggguggagggcgaggggcugcacaagcucggcuacauccugcgcgacaucagcaagauccccgggggcaacauguacgccgacgacaccgccggcugggacacccggaucacggaggacgaccugcagaacgaggcccgcaucaccgacaucauggagccggagcacgcgcuccuggccaaguccaucuucaagcugaccuaccagaacaaggucgugcgcgugcagcggcccgccaagaacgggaccgucauggacgugaucagccgccgggaccagcgcggcuccggccagguggggacguacggccucaacaccuucaccaacauggaggcccagcugauccggcagauggagagcgaggggaucuucucccccagcgagcuggagacccccaaccucgccgagcgcguccuggacuggcuggagaaguacggcguggagcggcucaagcgcauggcgaucuccggggacgacugcguggucaagccgaucgacgaccgguucgccacggcccugaccgcccugaacgacaugggcaaggugcgcaaggacaucccccagugggagcccagcaagggguggaacgacuggcagcagguccccuucugcucccaccacuuccaccagcucaucaugaaggacggccgggagaucgucgugccgugccgcaaccaggacgagcuggugggccgggcccgcgucagccagggggcgggcuggagccugcgggagaccgccugccucgggaaguccuacgcccagauguggcagcugauguacuuccaccgccgggaccugcgccucgccgcgaacgccaucugcagcgccgugcccguggacuggauccccaccucccggacgaccuggagcauccacgcccaccaccaguggaugaccaccgaggacaugcuguccgucuggaaccgcguguggaucgaggagaaccccuggauggaggacaagacgcacaucagcuccuggggcgacgugccguaccuggggaagcgcgaggaccaguggugcggcagccucaucggccugaccgcccgggcgaccugggccaccaacauccaggucgccaucaaccaggugcgccggcugaucgggaacgagaacuaccucgacuacaugaccuccaugaagcgcuucaagaacgagagcgaccccgagggcgcccugugguga

SEQ ID NO: 8411 - RNA, 9879 nt, Artificial Sequence
  derived and/or modified CDS sequence (opt1) from DENV-1__FJ410240__SS-prME
agcgugaccaugcugcucaugcugaugcccaccgcccuggccuuccaccucacgacccggggcggggagccccacaugaucgugagcaagcaggagcggggcaagagccugcuguucaagaccagcgcgggggugaacaugugcacccucaucgccauggaccugggcgaguucugcgaggacacgaugaccuacaagugcccccgcaucaccgaggccgagcccgacgacguggacugcuggugcaacgccaccgacacgugggucaccuacgggaccugcagccagaccggcgagcaccggcgggacaagcgguccguggcccuggcgccccacgugggccucgggcuggagacgcgcaccgagaccuggaugagcuccgagggcgccuggaagcagauccagcgggucgagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugcccgacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaagaccguccaguacgagaaccugaaguacagcgugaucgugaccgcgcacacgggcgaccagcaccaggucgggaacgaguccaccgagcacggcaccaccgccaccaucacgccccaggcccccagcaccgagauccagcugaccgacuacggggcccucacccuggacugcagcccccggacgggccuggacuucaacgagauggugcuccugaccaugaaggagaaguccuggcugguccacaagcagugguuccucgaccugccgcugcccuggaccagcggggccuccaccagccaggagacguggaaccggaaggaccuccuggugaccuucaagaccgcgcacgccaagaagcaggagguggucgugcugggcucccaggagggcgccaugcacaccgcccucacgggggccaccgagauccagaccagcggcaccacgaccaucuucgcggggcaccugaagugccgccugaagauggacaagcucacccugaagggcauguccuacgugaugugcaccgggagcuucaagcuggagaaggaggucgccgagacgcagcacggcaccgugcucgugcagaucaaguacgagggcaccgacgcccccugcaagauccccuucuccacccaggacgagaagggggucacgcagaacggccggcugaucaccgccaacccgaucgugaccgacaaggagaagcccgugaacaucgaggcggagccgcccuucggggagagcuacaucgucaucggcgccggcgagaaggcccugaagcuguccugguucaagaaggggagcuccaucggcaagauguucgaggccaccgcccgcggggcgcggcgcauggccauccucggcgacacggccugggacuucgggagcaucggcggcguguucaccuccguggggaagcugguccaccagaucuucggcaccgccuacggggugcuguucagcggcguguccuggaccaugaagaucgggaucggcguccuccugacguggcugggccucaacagccgcuccaccagccuguccaugaccugcaucgccguggggcuggugacccucuaccugggcgucauggugcaggcggacagcgggugcgugaucaacuggaagggccgggagcugaagugcgggagcggcaucuucgucacgaacgaggugcacaccuggaccgagcaguacaaguuccaggccgacuccccgaagcgccucagcgccgccaucggcaaggccugggaggagggggugugcggcauccgguccgcgacccgccuggagaacaucauguggaagcagaucagcaacgagcugaaccacauccuccuggagaacgacaugaaguucaccgucguggugggggacgucgccggcauccuggcccaggggaagaagaugauccggccccagcccauggaguacaaguacuccuggaaguccuggggcaaggccaagaucaucggcgcggacgugcagaacacgaccuucaucaucgacgggcccaacaccccggagugccccgacgaccagcgcgccuggaacaucugggagguggaggacuacggcuucgggaucuucaccacgaacaucuggcucaagcugcgggacuccuacacccaggucugcgaccaccgccugaugagcgccgccaucaaggacuccaaggccgugcacgcggacaugggcuacuggaucgagagcgagaagaacgagaccuggaagcucgcccgggccuccuucaucgaggugaagaccugcaucuggcccaagagccacacgcugugguccaacggcguccuggagagcgagaugaucauccccaagaucuacgggggcccgaucucccagcacaacuaccgccccggguacuucacccagaccgccggccccuggcaccucgggaagcuggagcuggacuucgaccucugcgagggcaccacggugguggucgacgagcacugcggcaaccgggggccgagccugcgcaccaccaccgugacgggcaagaucauccacgaguggugcugccgguccugcacccugccgccccugcgcuucaagggggaggacggcugcugguacgggauggagauccggcccgugaaggagaaggaggagaaccuggucaagagcauggugagcgccggcuccggcgagguggacagcuucucccuggggcuccugugcaucagcaucaugaucgaggaggucaugcgcucccgguggagccgcaagaugcugaugaccggcacccucgcgguguucuuccugcugaucauggggcagcucacguggaacgaccugauccggcugugcaucauggugggcgccaacgccuccgaccgcauggggaugggcaccaccuaccucgcccugauggccaccuucaagaugcgcccgauguucgcggucggccuccuguuccggcgccugacgagccgggaggugcugcuccugaccaucgggcugucccucguggccagcgucgagcugcccaacucccuggaggagcucggcgacgggcuggccaugggcaucaugauccugaagcuccugaccgacuuccagagccaccagcugugggccacccuccugucccugacguucaucaagaccaccuucagccuccacuacgcguggaagaccauggccauggugcuguccaucgucagccuguucccccucugccuguccacgaccagccagaagaccaccuggcugcccgugcuccugggcucccuggggugcaagccgcucacgauguuccugaucgccgagaacaagaucuggggccgcaagagcuggccccugaacgaggggaucauggccgugggcaucgucagcauccuccuguccagccugcucaagaacgacgugccccuggccgggccccugaucgcgggcggcaugcucaucgccugcuacgugaucuccgggagcuccgccgaccugagccuggagaaggccgccgaggucuccugggaggaggaggcggagcacagcggcgccucccacaacauccucguggaggugcaggacgacgggaccaugaagaucaaggacgaggagcgggacgacacccugaccauccugcucaaggccacccugcuggccgucagcggcguguacccgcucuccauccccgccacgcuguucgugugguacuucuggcagaagaagaagcagcgcagcgggguccugugggacacccccagcccgcccgagguggagcgggcggugcucgacgacggcaucuaccgcaucaugcagcggggccugcuggggcgcagccaggucggcguggggguguuccaggagaacgucuuccacaccauguggcacgugacccggggcgccgugcugauguaccaggggaagcgccucgagcccuccugggccagcgucaagaaggaccugaucuccuacggcggcggguggcggcugcagggcagcuggaacacgggggaggagguccaggugaucgccgucgagcccggcaagaaccccaagaacgugcagaccgcccccgggaccuucaagaccuccgagggcgaggugggcgcgaucgcccucgacuucaagcccgggacgagcggcagccccaucgucaaccgcgaggggaagaucgugggccuguacggcaacgggguggucaccaccuccggcaccuacgugagcgccaucgcccaggcgaaggccucccaggaggggccccugccggagaucgaggacgagguguuccggaagcgcaaccucacgaucauggaccugcaccccggcagcgggaagacccggcgcuaccugcccgccaucguccgggaggccaucaagcgcaagcuccggacccugauccuggccccgacccgcgugguggcguccgagauggccgaggcccucaagggcaugcccauccgcuaccagacgaccgccgucaagagcgagcacaccggcaaggagaucguggaccugaugugccacgccaccuucacgaugcggcugcucucccccgugcgcguccccaacuacaacaugaucaucauggacgaggcgcacuucaccgacccgagcuccaucgccgcccggggguacaucagcacccgcgugggcaugggggaggccgccgcgaucuucaugaccgccacgccgcccggcuccguggaggccuucccccagagcaacgccgucauccaggacgaggagcgggacaucccggagcgcuccuggaacagcggguacgaguggaucaccgacuuccccggcaagaccgugugguucgugcccuccaucaagagcggcaacgacaucgcgaacugccugcggaagaacgggaagcgcgucauccagcugucccggaagaccuucgacacggaguaccagaagaccaagaacaacgacugggacuacguggugaccaccgacaucagcgagaugggcgccaacuuccgcgccgaccgggucaucgacccccgccggugccucaagccggugauccugaaggacgggcccgagcgcgugauccuggccggccccaugcccgucacgguggccuccgcggcccagcggcgcgggcggaucggccgcaaccacaacaaggagggcgaccaguacaucuacauggggcagccgcucaacaacgacgaggaccacgcccacuggaccgaggccaagaugcugcuggacaacaucaacacccccgagggcaucauccccgcccucuucgagcccgagcgggagaaguccgcggccaucgacggggaguaccgccugcgcggcgaggcccggaagaccuucgucgagcugaugcgccgcggggaccucccgguguggcugagcuacaagguggccuccgagggcuuccaguacagcgaccgccgguggugcuucgacggcgagcgcaacaaccagguccuggaggagaacauggacguggagaucuggacgaaggagggggagcggaagaagcuccgcccccgguggcuggacgcccgcaccuacuccgacccccuggcgcuccgggaguucaaggaguucgccgccggccgccggagcguguccggggaccugauccuggagaucggcaagcucccccagcaccugacccagcgcgcccagaacgcgcuggacaaccucgucaugcugcacaacagcgagcagggcgggcgggccuaccgccacgccauggaggagcugccggacaccaucgagacgcucaugcugcuggcccucaucgccgugcugaccggcggggugacccuguucuuccucuccggccgggggcugggcaagaccagcaucggccugcucugcgucauggcguccagcgugcugcuguggauggccuccguggagccccacuggaucgccgccagcaucauccucgaguucuuccugaugguccugcucauccccgagcccgaccgccagcggaccccgcaggacaaccagcuggccuacguggugaucgggcuccucuucaugauccugacggucgcggccaacgagaugggccugcucgagaccaccaagaaggaccuggggaucggccacguggccguggagaaccaccaccacgccgccaugcuggacgucgaccuccaccccgcguccgccuggacccuguacgccguggccacgaccaucaucacccccaugaugcgccacaccaucgagaacacgaccgccaacaucagccugaccgcgaucgccaaccaggccgccauccucauggggcuggacaagggcuggccgaucuccaagauggacaucggcgugccccugcucgcgcuggggugcuacagccaggucaacccccugacccucacggccgccgugcugaugcugguggcccacuacgccaucaucggccccgggcuccaggcgaaggccacccgggaggcccagaagcgcaccgccgccggcaucaugaagaacccgaccgucgacgggaucguggcgaucgaccuggaccccguggucuacgacgccaaguucgagaagcagcugggccagaucaugcuccugauccugugcacgucccagauccuccugaugcgcaccaccugggcccugugcgagagcaucacccucgccacgggcccccugaccacccugugggaggggucccccggcaaguucuggaacaccacgaucgccgugagcauggcgaacaucuuccgggggagcuaccucgccggcgccggccuggccuucucccugaugaagucccucgggggcgggcgccggggcaccggggcgcagggcgagacccugggcgagaaguggaagcgccagcugaaccagcucuccaagagcgaguucaacaccuacaagcgguccgggaucauggagguggaccgcagcgaggccaaggagggccugaagcgcggggagacgaccaagcacgccgucucccgcggcaccgccaagcugcggugguucguggagcgcaaccucgugaagccggaggggaaggucaucgaccugggcugcggccgcggcggguggagcuacuacugcgccgggcugaagaaggugaccgaggugaagggguacacgaagggcgggcccggccacgaggagcccauccccauggcgaccuacggguggaaccuggucaagcuccacuccggcaaggacguguucuucaucccgcccgagaagugcgacacccugcugugcgacaucggggagagcucccccaaccccaccaucgaggagggccgcacgcuccgggugcugaagauggucgagccguggcugcgcgggaaccaguucugcaucaagauccucaaccccuacaugcccagcgugguggagacccuggagcagaugcagcggaagcacggcggcaugcugguccgcaacccccucucccggaacagcacccacgagauguacuggguguccugcgggaccggcaacaucgugagcgccgucaacaugaccucccgcaugcugcugaaccgguucacgauggcccaccgcaagccgaccuacgagcgcgacguggaccucggggccggcacccggcacguggccgucgagcccgagguggcgaaccuggacaucaucggccagcgcaucgagaacaucaagcacgagcacaagagcaccuggcacuacgacgaggacaaccccuacaagacgugggccuaccacggguccuacgaggugaagcccagcggcagcgccuccagcauggucaacgggguggucaagcugcucaccaagccgugggacgugauccccauggugacccagaucgccaugaccgacacgacccccuucggccagcagcgggucuucaaggagaagguggacacccgcacccccaaggccaagcgggggacggcgcagaucauggaggugaccgccaaguggcuguggggcuuccugucccgcaacaagaagccgcggaucugcacccgcgaggaguucacccggaagguccgcagcaacgccgccaucggcgcgguguucguggacgagaaccaguggaacuccgccaaggaggccgucgaggacgagcgguucugggaccucgugcaccgcgagcgggagcugcacaagcaggggaagugcgccacgugcguguacaacaugaugggcaagcgcgagaagaagcugggggaguucggcaaggccaaggggagccgggcgaucugguacauguggcucggcgcccgcuuccuggaguucgaggcccugggcuucaugaacgaggaccacugguucucccgggagaacagccucuccggggucgagggcgaggggcugcacaagcugggcuacauccuccgcgacaucagcaagauccccgggggcaacauguacgccgacgacaccgccggcugggacacccggaucaccgaggacgaccugcagaacgaggcgaagaucacggacaucauggagcccgagcacgcccugcucgccaaguccaucuucaagcugaccuaccagaacaagguggugcgcguccagcggccggccaagaacgggaccgugauggacgugaucagccgccgcgaccagcggggcuccgggcaggucggcaccuacggccugaacacguucaccaacauggaggcccagcucauccgccagauggagagcgaggggaucuucucccccagcgagcuggagacccccaaccuggcgggccgggugcucgacuggcuggagaagcacgggguggagcgccugaagcggauggccaucuccggcgacgacugcgucgugaagcccaucgacgaccgcuucgccaccgcccucacggcccugaacgacauggggaaggugcggaaggacaucccgcagugggagcccagcaagggcuggaacgacuggcagcagguccccuucugcagccaccacuuccaccagcugaucaugaaggacggccgcgagaucguggugcccugccggaaccaggacgagcucgucgggcgcgcgcgggugucccagggcgccggguggagccugcgcgagaccgccugccugggcaaguccuacgcccagauguggcagcucauguacuuccaccggcgcgaccugcggcuggcggccaacgccaucugcagcgccgugccggucgacugggugcccaccucccgcaccacguggagcauccacgcccaccaccaguggaugaccaccgaggacaugcucuccguguggaaccgggucuggaucgaggagaaccccuggauggaggacaagacccacaucagcuccuggggcgacgugcccuaccugggcaagcgcgaggaccaguggugcggcagccugaucgggcucacggcgcgggccaccugggccaccaacauccagguggccaucaaccagguccgccgccugaucggcaacgagaacuaccuggacuacaugaccuccaugaagcgguucaagaacgagagcgacccggagggggcccucugguga

SEQ ID NO: 8412 - RNA, 9879 nt, Artificial Sequence
  derived and/or modified CDS sequence (opt1) from DENV-1__FJ410242__SS-prME
agcgugaccaugcugcucaugcugaugcccaccgcccuggccuuccaccucaccacccggggcggggagccgcacaugaucgugagcaagcaggagcggggcaagagccugcuguucaagaccagcgcgggggugaacaugugcacccucaucgccauggaccugggcgaguucugcgaggacaccaugaccuacaagugcccccgcaucaccgaggccgagcccgacgacguggacugcuggugcaacgccaccgacacgugggucaccuacgggaccugcagccagaccggcgagcaccggcgggacaagcggagcguggcccuggcgccccacgugggccucgggcuggagacgcgcaccgagaccuggaugagcuccgagggcgccuggaagcagauccagcgggucgagaccugggcccugcgccacccgggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugcccgacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaagaucguccaguacgagaaccugaaguacagcgugaucgugaccguccacaccggcgaccagcaccagguggggaacgaguccacggagcacggcaccaccgcgaccaucacgccccaggcccccagcacggagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccagcggggccuccaccagccaggagaccuggaaccggaaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcauguccuacgucaugugcaccgggagcuucaagcuggagaaggagguggcggagacccagcacggcacggugcucguccagaucaaguacgagggcaccgacgcccccugcaagauccccuucuccacccaggacgagaagggggugacccagaacggccggcugaucacggccaacccgaucgugaccgacaaggagaagcccgucaacaucgaggccgagccgcccuucggggagagcuacaucgugaucggcgcgggcgagaaggcccugaagcuguccugguucaagaaggggagcuccaucggcaagauguucgaggccaccgcccgcggggcccggcgcauggcgauccucggcgacaccgccugggacuucgggagcaucggcggcguguucacguccgucgggaagcuggugcaccagaucuucggcaccgccuacggggugcuguucagcggcgucuccuggaccaugaagaucgggaucggcgugcuccugaccuggcugggccucaacagccgcuccacgagccuguccaugaccugcaucgccguggggcuggucacccucuaccugggcgugauggugcaggccgacagcgggugcgucaucaacuggaagggccgggagcugaagugcgggagcggcaucuucgugaccaacgaggugcacacguggaccgagcaguacaaguuccaggcggacuccccgaagcgccucagcgccgccaucggcaaggccugggaggagggggucugcggcauccgguccaccacccgccuggagaacaucauguggaagcagaucagcaacgagcugaaccacauccuccuggagaacgacaugaaguucaccgugguggucggggacguggccggcauccuggcgcaggggaagaagaugauccggccccagcccauggaguacaaguacuccuggaaguccuggggcaaggccaagaucaucggcgccgacgugcagaacacgaccuucaucaucgacgggcccaacaccccggagugcuccgacgaccagcgcgccuggaacaucugggaggucgaggacuacggcuucgggaucuucaccacgaacaucuggcucaagcugcgggacagcuacacccaggugugcgaccaccgccugauguccgcggccaucaaggacagcaaggccgugcacgccgacaugggcuacuggaucgaguccgagaagaacgagaccuggaagcucgcccgggcgagcuucaucgaggucaagaccugcaucuggcccaagucccacacgcuguggagcaacggcgugcuggaguccgagaugaucauccccaagaucuacgggggccccaucagccagcacaacuaccgcccgggguacuucacccagaccgccggccccuggcaccucgggaagcuggagcuggacuucgaccucugcgagggcaccacgguggucguggacgagcacugcggcaaccgggggcccucccugcgcaccaccaccgugacgggcaagaucauccacgaguggugcugccggagcugcacccugccgccccuccgcuucaagggggaggacggcugcugguacgggauggagauccggcccgucaaggagaaggaggagaaccuggucaagagcaugguguccgccggcagcggcgaggucgacuccuucagccuggggcuccugugcaucuccaucaugaucgaggaggugaugcgcagccgguggucccgcaagaugcugaugaccggcacccucgccguguucuuccugcugaucauggggcagcucacguggaacgaccugauccggcugugcaucauggucggcgccaacgcgagcgaccgcauggggaugggcaccaccuaccucgcccugauggccaccuucaagaugcgccccauguucgccgugggccuccuguuccggcgccugacgucccgggaggugcugcuccugaccaucgggcugagccucgucgccuccguggagcugccgaacagccuggaggagcucggcgacgggcuggcgaugggcaucaugauccugaagcuccugaccgacuuccagucccaccagcugugggccacccuccugagccugacguucaucaagaccaccuucucccuccacuacgccuggaagaccauggccaugguccugagcaucgugucccuguucccccucugccugagcacgaccucccagaagaccaccuggcugcccgugcuccugggcagccuggggugcaagccccucacgauguuccugaucgcggagaacaagaucuggggccgcaagagcuggccgcugaacgaggggaucauggccgucggcaucguguccauccuccugagcucccugcucaagaacgacgugccccuggccgggccccugaucgccggcggcaugcucaucgccugcuacgucaucagcggguccagcgcggaccugucccuggagaaggccgccgaggugagcugggaggaggaggccgagcacuccggcgccagccacaacauccucguggagguccaggacgacgggaccaugaagaucaaggacgaggagcgggacgacacccugaccauccugcucaaggcgacccugcuggccguguccggcguguacccccucagcaucccggccacgcuguucgucugguacuucuggcagaagaagaagcagcgcuccggggugcugugggacacccccuccccgcccgagguggagcgggccguccucgacgacggcaucuaccgcaucaugcagcggggccugcuggggcgcucccaggugggcgugggggucuuccaggagaacguguuccacaccauguggcacgugacccggggcgccguccugauguaccaggggaagcgccucgagccgagcugggcguccgugaagaaggaccugaucagcuacggcggcggguggcggcugcagggcuccuggaacacgggggaggaggugcaggucaucgccguggagcccggcaagaaccccaagaacgugcagaccgcccccgggaccuucaagaccagcgagggcgaggucggcgccaucgcccucgacuucaagccggggacgagcggcucccccaucgugaaccgcgaggggaagaucgugggccuguacggcaacggggucgugaccaccagcggcaccuacguguccgcgaucgcccaggccaaggccagccaggaggggccccugcccgagaucgaggacgaggucuuccggaagcgcaaccucacgaucauggaccugcacccgggcuccgggaagacccggcgcuaccugcccgcgaucgugcgggaggccaucaagcgcaagcuccggacccugauccuggcccccacccgcguggucgccagcgagauggccgaggcgcucaagggcaugccgauccgcuaccagacgaccgccgugaaguccgagcacaccggcaaggagaucguggaccugaugugccacgccaccuucacgaugcggcugcucagccccguccgcgugcccaacuacaacaugaucaucauggacgaggcccacuucaccgaccccuccagcaucgccgcgcggggguacaucuccacccgcgugggcaugggggaggccgccgccaucuucaugaccgccacgccgcccggcagcgucgaggcguucccccaguccaacgccgugauccaggacgaggagcgggacauccccgagcgcagcuggaacuccggguacgaguggaucaccgacuucccgggcaagaccgugugguucguccccagcaucaaguccggcaacgacaucgccaacugccugcggaagaacgggaagcgcgugauccagcugagccggaagaccuucgacacggaguaccagaagaccaagaacaacgacugggacuacguggucaccaccgacaucuccgagaugggcgccaacuuccgcgcggaccgggugaucgacccccgccggugccucaagcccgugauccugaaggacgggccggagcgcgucauccuggccggccccaugcccgugacggucgccagcgccgcccagcggcgcgggcggaucggccgcaaccacaacaaggagggcgaccaguacaucuacauggggcagccccucaacaacgacgaggaccacgcgcacuggaccgaggccaagaugcugcuggacaacaucaacaccccggagggcaucauccccgcccucuucgagcccgagcgggagaaguccgccgccaucgacggggaguaccgccugcgcggcgaggcgcggaagaccuucguggagcugaugcgccgcggggaccuccccguguggcuguccuacaaggucgccagcgagggcuuccaguacuccgaccgccgguggugcuucgacggcgagcgcaacaaccaggugcuggaggagaacauggacguggagaucuggacgaaggagggggagcggaagaagcuccgcccgcgguggcuggacgcccgcaccuacagcgacccccuggcccuccgggaguucaaggaguucgccgcgggccgccgguccgucagcggggaccugauccuggagaucggcaagcucccccagcaccugacccagcgcgcccagaacgcccuggacaaccucgugaugcugcacaacuccgagcagggcgggcgggccuaccgccacgcgauggaggagcugcccgacaccaucgagacgcucaugcugcuggcccucaucgccgugcugaccggcggggucacccuguucuuccucagcggccgggggcugggcaagaccuccaucggccugcucugcgugauggccagcuccgugcugcuguggauggccagcgucgagccgcacuggaucgcggccuccaucauccucgaguucuuccugauggugcugcucauccccgagcccgaccgccagcggacgccccaggacaaccagcuggccuacguggucaucgggcuccuguucaugauccugacgguggccgccaacgagaugggccugcucgagaccaccaagaaggaccuggggaucggccacguggcggccgagaaccaccaccacgccgccaugcuggacgucgaccuccacccggccagcgcguggacccuguacgccguggccacgaccaucaucacccccaugaugcgccacaccaucgagaacacgaccgccaacaucucccugaccgccaucgcgaaccaggccgccauccucauggggcuggacaagggcuggcccaucagcaagauggacaucggcgugccgcugcucgcccuggggugcuacucccaggucaacccccugacccucacggcggccgugcugaugcugguggcccacuacgccaucaucggccccgggcuccaggccaaggcgacccgggaggcccagaagcgcaccgccgccggcaucaugaagaaccccaccgucgacgggaucguggccaucgaccuggacccgguggucuacgacgcgaaguucgagaagcagcugggccagaucaugcuccugauccugugcacgagccagauccuccugaugcgcaccaccugggcccugugcgaguccaucacccucgccacgggcccccugaccacccugugggaggggagccccggcaaguucuggaacaccacgaucgccgugagcauggccaacaucuuccggggguccuaccucgcgggcgccggccuggccuucagccugaugaagucccucgggggcgggcgccggggcaccggggcccagggcgagacccugggcgagaaguggaagcgccagcugaaccagcucagcaaguccgaguucaacaccuacaagcggagcgggaucauggagguggaccgcuccgaggcgaaggagggccugaagcgcggggagacgaccaagcacgccgucagccgcggcaccgccaagcugcggugguucguggagcgcaaccucgugaagcccgaggggaaggucaucgaccugggcugcggccgcggcgggugguccuacuacugcgccgggcugaagaaggugaccgaggugaagggguacacgaagggcgggccgggccacgaggagcccauccccauggccaccuacggguggaaccuggucaagcuccacagcggcaaggacguguucuucaucccgcccgagaagugcgacacccugcugugcgacaucggggaguccagccccaaccccaccaucgaggagggccgcacgcuccgggugcugaagauggucgagcccuggcugcgcgggaaccaguucugcaucaagauccucaaccccuacaugcccuccgugguggagacccuggagcagaugcagcggaagcacggcggcaugcugguccgcaacccccucagccggaacuccacccacgagauguacugggugagcugcgggaccggcaacaucguguccgcggucaacaugaccagccgcaugcugcugaaccgguucacgauggcccaccgcaagcccaccuacgagcgcgacguggaccucggggccggcacccggcacguggccgucgagccggagguggccaaccuggacaucaucggccagcgcaucgagaacaucaagcacgagcacaaguccaccuggcacuacgacgaggacaaccccuacaagacgugggcguaccacgggagcuacgaggugaagcccagcggcuccgccagcuccauggucaacgggguggucaagcugcucaccaagcccugggacgugaucccgauggugacccagaucgccaugaccgacacgacccccuucggccagcagcgggucuucaaggagaagguggacacccgcacccccaaggccaagcgggggacggcccagaucauggaggugaccgcgaaguggcuguggggcuuccugagccgcaacaagaagccccggaucugcacccgcgaggaguucacccggaagguccgcuccaacgccgccaucggcgccguguucguggacgagaaccaguggaacagcgcgaaggaggccgucgaggacgagcgguucugggaccucgugcaccgcgagcgggagcugcacaagcaggggaagugcgccacgugcguguacaacaugaugggcaagcgcgagaagaagcugggggaguucggcaaggccaaggggucccgggccaucugguacauguggcucggcgcgcgcuuccuggaguucgaggcccugggcuucaugaacgaggaccacugguucagccgggagaacucccucagcggggucgagggcgaggggcugcacaagcugggcuacauccuccgcgacaucuccaagauccccgggggcaacauguacgccgacgacaccgccggcugggacacccggaucaccgaggacgaccugcagaacgaggccaagaucacggacaucauggagcccgagcacgcgcugcucgccaagagcaucuucaagcugaccuaccagaacaagguggugcgcguccagcggcccgccaagaacgggaccgugauggacgugaucucccgccgcgaccagcggggcagcgggcaggucggcaccuacggccugaacacguucaccaacauggaggcccagcucauccgccagauggaguccgaggggaucuucagcccguccgagcuggagacccccaaccuggccggccgggugcucgacuggcuggagaagcacgggguggagcgccugaagcggauggcgaucagcggcgacgacugcgucgugaagcccaucgacgaccgcuucgccaccgcccucacggcccugaacgacauggggaaggugcggaaggacaucccccagugggagccgagcaagggcuggaacgacuggcagcagguccccuucugcucccaccacuuccaccagcugaucaugaaggacggccgcgagaucguggugcccugccggaaccaggacgagcucgucgggcgcgcccgggugagccagggcgcgggguggucccugcgcgagaccgccugccugggcaagagcuacgcccagauguggcagcucauguacuuccaccggcgcgaccugcggcuggccgcgaacgccaucugcuccgccgugcccgucgacugggugccgaccagccgcaccacgugguccauccacgcccaccaccaguggaugaccaccgaggacaugcucagcguguggaaccgggucuggaucgaggagaaccccuggauggaggacaagacccacaucuccagcuggggcgacgugcccuaccugggcaagcgcgaggaccaguggugcggcucccugaucgggcucacggcccgggcgaccugggccaccaacauccagguggccaucaaccagguccgccgccugaucggcaacgagaacuaccuggacuacaugaccagcaugaagcgguucaagaacgaguccgaccccgagggggcccucugguga

SEQ ID NO: 8413 - RNA, 9879 nt, Artificial Sequence
  derived and/or modified CDS sequence (opt1) from DENV-1__FJ410243__SS-prME
uccgugaccaugcugcucaugcugaugcccaccgcccuggccuuccaccucaccacccgcggcggggagccccacaugaucgucuccaagcaggagcggggcaagagccugcuguucaagaccuccgcgggggugaacaugugcacccucaucgccauggaccugggcgaguucugcgaggacacgaugaccuacaagugcccccgcaucaccgaggccgagcccgacgacguggacugcuggugcaacgccaccgacacgugggucaccuacgggaccugcagccagaccggcgagcaccggcgcgacaagcgguccguggcccuggcgccccacgugggccucgggcuggagacgcgcaccgagaccuggaugagcuccgagggcgccuggaagcagauccagcgggucgagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugccccacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaagaccguccaguacgagaaccugaaguacagcgugaucgugaccguccacacgggcgaccagcaccagguggggaacgaguccaccgagcacggcaccaccgcgaccaucacgccccaggcccccagcaccgagauccagcugaccgacuacggggcccucacccuggacugcagcccccggacgggccuggacuucaacgagaugguccuccugaccaugaaggagaaggccuggcuggugcacaagcagugguuccucgaccugccgcugcccuggaccagcggggccagcaccucccaggagacguggaaccggaaggaccuccuggugaccuucaagaccgcgcacgccaagaagcaggaggucguggugcugggcagccaggagggcgccaugcacaccgcccucacgggggccaccgagauccagaccuccggcaccacgaccaucuucgcggggcaccugaagugccgccugaagauggacaagcucacccugcggggcaugagcuacgucaugugcaccggguccuucaagcuggagaaggagguggccgagacgcagcacggcaccgugcucguccagaucaaguacgagggcaccgacgcccccugcaagauccccuucagcacccaggacgagaagggggugacgcagaacggccgccugaucaccgccaaccccaucgugaccgacaaggagaagcccgucaacaucgaggcggagccgcccuucggggaguccuacaucgugaucggcgccggcgagaaggcccugaagcugagcugguucaagaagggguccagcaucggcaagauguucgaggccaccgcccgcggggcgcgccgcauggccauccucggcgacacggccugggacuucggguccaucggcggcguguucaccagcgucgggaagcuggugcaccagaucuucggcaccgccuacggggugcuguucuccggcgucagcuggaccaugaagaucgggaucggcgugcuccugacguggcugggccucaacucccggagcaccucccugagcaugaccugcaucgccguggggcuggucacccucuaccugggcgugauggugcaggcggacuccgggugcgucaucaacuggaagggccgcgagcugaagugcgggagcggcaucuucgugacgaacgaggugcacaccuggaccgagcaguacaaguuccaggccgacagcccgaagcggcucuccgccgccaucggcaaggccugggaggagggggucugcggcauccgcagcgcgacccggcuggagaacaucauguggaagcagaucuccaacgagcugaaccacauccuccuggagaacgacaugaaguucaccgugguggucggggacguggccggcauccuggcccaggggaagaagaugauccgcccccagcccauggaguacaaguacagcuggaaguccuggggcaaggccaagaucaucggcgcggacgugcagaacgccacguucaucaucgacgggcccaacaccccggagugccccgacgaccagcgggccuggaacaucugggaggucgaggacuacggcuucgggaucuucaccaccaacaucuggcucaagcugcgcgacagcuacacccaggugugcgaccaccggcugauguccgccgccaucaaggacagcaaggcggugcacgccgacaugggcuacuggaucgaguccgagaagaacgagaccuggaagcucgcccgcgccagcuucaucgaggucaagaccugcaucuggcccaagucccacacccuguggagcaacggcgugcuggaguccgagaugaucauccccaagaucuacgggggcccgaucagccagcacaacuaccggcccggguacuucacgcagaccgccggccccuggcaccucgggaagcuggagcuggacuucgaccucugcgagggcaccaccguggucguggacgagcacugcggcaaccgcgggccgucccugcggacgaccaccgugaccggcaagaucauccacgaguggugcugccgcagcugcacgcugccgccccugcgguucaagggggaggacggcugcugguacgggauggagauccgccccgucaaggagaaggaggagaaccuggugaaguccauggugagcgcgggcagcggcgaggucgacuccuucagccuggggcuccugugcaucuccaucaugaucgaggaggugaugcggagccgcuggucccggaagaugcugaugaccggcacccucgccguguucuuccugcugaucauggggcagcucaccuggaacgaccugauccgccugugcaucauggucggcgccaacgccagcgaccgcauggggaugggcacgaccuaccucgcccugauggcgaccuucaagaugcggccgauguucgccguggggcuccuguuccgccggcugaccucccgcgaggugcugcuccugacgaucgggcugagccucgucgccuccguggagcugcccaacagccuggaggagcucggcgacgggcuggccaugggcaucaugauccugaagcuccugaccgacuuccagucccaccagcugugggcgacccuccugagccugaccuucaucaagacgaccuucucccuccacuacgccuggaagaccauggccaugguccugagcaucgugucccuguucccccucugccugagcaccacgucccagaagaccaccuggcugcccgugcuccugggcagccuggggugcaagccgcucaccauguuccugaucgccgagaacaagaucuggggccggaaguccuggccccugaacgaggggaucauggccgucggcaucgugagcauccuccugagcucccugcucaagaacgacgugccccuggcggggccccugaucgccggcggcaugcucaucgccugcuacgucaucagcggguccagcgccgaccugucccuggagaaggccgcggaggugagcugggaggaggaggccgagcacuccggcgccagccacaacauccucguggagguccaggacgacgggccgaugaagaucaaggacgaggagcgcgacgacaugcugacgauccugcucaaggccacccugcuggccguguccggcguguacccccucagcauccccgcgacccuguucgucugguacuucuggcagaagaagaagcagcgguccggggugcugugggacacccccagcccgcccgagguggagcgcgccguccucgacgacggcaucuaccggaucaugcagcgcggccugcuggggcggucccaggugggcgugggggucuuccaggagaacguguuccacaccauguggcacgugacgcgcggcgccguccugauguaccaggggaagcggcucgagcccagcugggccuccgugaagaaggaccugaucagcuacggcggcggguggcgccugcagggcuccuggaacaccggggaggaggugcaggucaucgccguggagcccggcaagaacccgaagaacgugcagaccgcgcccgggaccuucaagacgagcgagggcgaggucggcgccaucgcccucgacuucaagcccgggaccuccggcagccccaucgugaaccgggaggggaagaucgugggccuguacggcaacggggucgugaccaccagcggcacguacguguccgccaucgcgcaggccaaggccagccaggaggggccgcugcccgagaucgaggacgaggucuuccgcaagcggaaccucaccaucauggaccugcaccccggcuccgggaagacccgccgguaccugccggccaucgugcgcgaggccaucaagcggaagcuccgcacccugauccuggcgcccacgcgcguggucgccagcgagauggccgaggcccucaagggcaugcccauccgguaccagaccaccgccgugaaguccgagcacaccggcaaggagaucguggaccugaugugccacgcgacguucaccaugcgccugcucagccccguccgggugccgaacuacaacaugaucaucauggacgaggcccacuucaccgaccccuccagcaucgccgcccgcggguacaucuccacccgggugggcaugggggaggccgcggccaucuucaugacggccacgccgcccggcagcauggaggccuucccgcaguccaacgcggucauccaggacgaggagcgcgacauccccgagcggagcuggaacuccggguacgaguggaucaccgacuuccccggcaagaccgugugguucgugcccagcaucaaguccggcaacgacaucgccaacugccugcgcaagaacgggaagcgggucauccagcugagccgcaagacguucgacaccgaguaccagaagaccaagaacaacgacugggacuacguggugaccacggacaucuccgagaugggcgccaacuuccgggccgaccgcgucaucgacccgcggcgcugccucaagcccgugauccugaaggacgggcccgagcgggugauccuggccggccccaugccggucaccguggcgagcgccgcccagcgccgggggcgcaucggccggaaccacaacaaggagggcgaccaguacaucuacauggggcagccccucaacaacgacgaggaccacgcccacuggaccgaggccaagaugcugcuggacaacaucaacacccccgagggcaucauccccgcccucuucgagccggagcgcgagaaguccgccgccaucgacggggaguaccgccugcggggcgaggcccgcaagacguucgucgagcugaugcggcgcggggaccuccccguguggcugagcuacaagguggccagcgagggcuuccaguacuccgaccggcgcuggugcuucgacggcgagcggaacaaccagguccuggaggagaacauggacguggagaucuggaccaaggagggggagcgcaagaagcuccggccccgcuggcuggacgcgcggaccuacagcgacccccuggcccuccgcgaguucaaggaguucgccgccggccggcgcuccgugagcggggaccugauccuggagaucggcaagcucccgcagcaccugacccagcgggcgcagaacgcccuggacaaccucgucauccugcacaacuccgagcagggcgggcgcgccuaccggcacgccauggaggagcugcccgacacgaucgagacccucaugcugcuggcccucaucgcggugcugaccggcggggugacccuguucuuccucagcggccgcgggcugggcaagacguccaucggccugcucugcgucauggccagcuccgugcugcuguggauggccagcguggagccccacuggaucgccgccuccaucauccucgaguucuuccugaugguccugcucauccccgagccggaccggcagcgcacgccccaggacaaccagcuggcguacguggugaucgggcuccucuucaugauccugaccgucgccgccaacgagaugggccugcucgagaccaccaagaaggaccuggggaucggccacguggccguggagaaccaccaccacgccgcgaugcuggacgucgaccuccaccccgccagcgccuggacgcuguacgccguggccaccaccaucaucaccccgaugaugcggcacacgaucgagaacaccaccgcgaacaucucccugaccgccaucgccaaccaggccgcgauccucauggggcuggacaagggcuggcccaucagcaagauggacaucggcgugccccugcucgcccuggggugcuacucccaggucaacccccugacgcucaccgccgccgugcugaugcugguggcccacuacgcgaucaucggcccggggcuccaggccaaggccacccgcgaggcccagaagcgcaccgccgcgggcaucaugaagaaccccacggucgacgggaucguggccaucgaccuggaccccguggucuacgacaccaaguucgagaagcagcugggccagaucaugcuccugauccugugcaccagccagauccuccugaugcggaccacgugggcccugugcgaguccaucacccucgccaccggcccccugaccacgcugugggaggggagcccgggcaaguucuggaacaccaccaucgccguguccauggcgaacaucuuccgcgggagcuaccucgccggcgccggccuggccuucagccugaugaagucccucgggggcgggcggcgcggcaccggggcgcagggcgagacgcugggcgagaaguggaagcggcagcugaaccagcucagcaaguccgaguucaacaccuacaagcgcagcgggaucauggagguggaccgguccgaggccaaggagggccugaagcgcggggagaccaccaagcacgccgucagccggggcacggccaagcugcgcugguucguggagcggaaccucgugaagcccgaggggaaggucaucgaccugggcugcggccgcgggggcugguccuacuacugcgccgggcugaagaaggugaccgaggugaagggcuacaccaagggcgggcccggccacgaggagcccaucccgauggcgaccuacggguggaaccuggucaagcuccacagcggcaaggacguguucuucaucccgcccgagaagugcgacacgcugcugugcgacaucggggaguccagccccaacccgaccaucgaggagggccggacccuccgcgugcugaagauggucgagcccuggcugcgggggaaccaguucugcaucaagauccucaaccccuacaugcccuccgugguggagacccuggagcagaugcagcgcaagcacggcggcaugcugguccggaacccgcucagccgcaacuccacgcacgagauguacugggugagcugcgggaccggcaacaucguguccgccgucaacaugaccagccggaugcugcugaaccgcuucaccauggcccaccgcaagcccaccuacgagcgggacguggaccucggggccggcacgcgccacguggccgucgagcccgagguggcgaaccuggacaucaucggccagcggaucgagaacaucaagcacgagcacaaguccaccuggcacuacgacgaggacaaccccuacaagaccugggccuaccacgggagcuacgaggugaagccguccggcagcgccagcuccauggucaacgggguggucaagcugcucaccaagcccugggacgugauccccauggugacgcagaucgccaugaccgacaccacccccuucggccagcagcgcgucuucaaggagaagguggacacgcggaccccgaaggccaagcgcgggaccgcgcagaucauggaggugaccgccaaguggcuguggggcuuccugagccggaacaagaagccccgcaucugcacgcgggaggaguucacccgcaagguccgguccaacgccgccaucggcgcgguguucguggacgagaaccaguggaacagcgccaaggaggccgucgaggacgagcgcuucugggaccucgugcaccgggagcgcgagcugcacaagcaggggaagugcgcgaccugcguguacaacaugaugggcaagcgggagaagaagcugggggaguucggcaaggccaaggggucccgcgcgaucugguacauguggcucggcgcccgguuccuggaguucgaggcccugggcuucaugaacgaggaccacugguucagccgcgagaacucccucagcggggucgagggcgaggggcugcacaagcugggcuacauccuccgggacaucuccaagauccccgggggcaacauguacgccgacgacaccgccggcugggacacgcgcaucaccgaggacgaccugcagaacgaggcgaagaucaccgacaucauggagccggagcacgcccugcucgccaagagcaucuucaagcugaccuaccagaacaagguggugcggguccagcgccccgccaagaacgggacggugauggacgugaucucccgccgggaccagcgcggcagcgggcaggucggcaccuacggccugaacaccuucaccaacauggaggcccagcucauccggcagauggaguccgaggggaucuucagccccuccgagcuggagacgcccaaccuggcgggccgcgugcucgacuggcuggagaagcacgggguggagcggcugaagcgcauggccaucagcggcgacgacugcgucgugaagccgaucgacgaccgguucgccaccgcccucaccgcccugaacgacauggggaaggugcgcaaggacaucccccagugggagcccuccaagggcuggaacgacuggcagcagguccccuucugcagccaccacuuccaccagcugaucaugaaggacggccgggagaucguggugccgugccgcaaccaggacgagcucgucgggcgggcgcgcgugagccagggcgccggguggucccugcgggagaccgccugccugggcaagagcuacgcccagauguggcagcucauguacuuccaccgccgggaccugcgccuggcggccaacgccaucugcuccgccgugcccgucgacugggugcccacgagccggaccaccugguccauccacgcccaccaccaguggaugaccacggaggacaugcucagcguguggaaccgcgucuggaucgaggagaaccccuggauggaggacaagacccacaucuccagcuggggcgacgugccguaccugggcaagcgggaggaccaguggugcggcucccugaucgggcucaccgcgcgcgccaccugggccacgaacauccagguggccaucaaccagguccgccggcugaucggcaacgagaacuaccuggacuacaugaccagcaugaagcgcuucaagaacgagaucgaccccgagggggcccucugguga

SEQ ID NO: 8414 - RNA, 9879 nt, Artificial Sequence
  derived and/or modified CDS sequence (opt1) from DENV-1__FJ410244__SS-prME
agcgugaccaugcugcucaugcugaugcccaccgcccuggccuuccaccucacgacccggggcggggagccccacaugaucgugagcaagcaggagcggggcaagagccugcuguucaagaccagcgcgggggugaacaugugcacccucaucgccauggaccugggcgaguucugcgaggacacgaugaccuacaagugcccccgcaucaccgaggccgagcccgacgacguggacugcuggugcaacgccaccgacacgugggugaccuacgggaccugcagccagaccggcgagcaccggcgggacaagcgguccguggcccuggcgccccacgugggccucgggcuggagacgcgcaccgagaccuggaugagcuccgagggcgccuggaagcagauccagcggguggagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugcccgacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaagaccguccaguacgagaaccugaaguacagcgugaucgugaccguccacacgggcgaccagcaccagguggggaacgaguccaccgagcacggcaccaccgcgaccaucacgccccaggcccccagcaccgagauccagcugaccgacuacggggcccucacccuggacugcagcccccggacgggccuggacuucaacgagaugguccuccugaccaugaaggagaaguccuggcuggugcacaagcagugguuccucgaccugccgcugcccuggaccagcggggccuccaccagccaggagacguggaaccggaaggaccuccuggugaccuucaagaccgcccacgcgaagaagcaggaggucguggugcugggcucccaggagggcgccaugcacaccgcccucacgggggccaccgagauccagaccagcggcaccacgaccaucuucgccgggcaccugaagugccgccugaagaugaacaagcucacccugaagggcauguccuacgucaugugcaccgggagcuucaagcuggagaaggagguggcggagacgcagcacggcaccgugcucguccagaucaaguacgagggcaccgacgcccccugcaagauccccuucuccacccaggacgagaagggggugacgcagaacggccggcugaucaccgccaacccgaucgugaccgacaaggagaagcccgucaacaucgaggccgagccgcccuucggggagagcuacaucgugaucggcgcgggcgagaaggcccugaagcuguccugguucaagaaggggagcuccaucggcaagauguucgaggccaccgcccgcggggcccggcgcauggcgauccucggcgacacggccugggacuucgggagcaucggcggcguguucaccuccgucgggaagcuggugcaccagaucuucggcaccgccuacggggugcuguucagcggcgucuccuggaccaugaagaucgggaucggcgugcuccugacguggcugggccucaacagccgcuccaccagccuguccaugaccugcaucgccguggggcuggucacccucuaccugggcgugauggugcaggccgacagcgggugcgucaucaacuggaagggccgggagcugaagugcgggagcggcaucuucgugacgaacgaggugcacaccuggaccgagcaguacaaguuccaggcggacuccccgaagcgccucagcgccgccaucggcaaggccugggaggagggggucugcggcauccgguccgccacccgccuggagaacaucauguggaagcagaucagcaacgagcugaaccacauccuccuggagaacgacaugaaguucaccgugguggucggggacguggcgggcauccuggcccaggggaagaagaugauccggccccagcccauggaguacaaguacuccuggaaguccuggggcaaggccaagaucaucggcgccgacgugcagaacacgaccuucaucaucgacgggcccaacaccccggagugccccgacgaccagcgcgcguggaacaucugggaggucgaggacuacggcuucgggaucuucaccacgaacaucuggcucaaccugcgggacuccuacacccaggugugcgaccaccgccugaugagcgccgccaucaaggacuccaaggccgugcacgccgacaugggcuacuggaucgagagcgagaagaacgagaccuggaagcucgcgcgggccuccuucaucgaggucaagaccugcaucuggcccaagagccacacgcugugguccaacggcgugcuggagagcgagaugaucauccccaagaucuacgggggcccgaucucccagcacaacuaccgccccggguacuucacccagaccgccggccccuggcaccucgggaagcuggagcuggacuucgaccucugcgagggcaccacgguggucguggacgagcacugcggcaaccgggggccgagccugcgcaccaccaccgugacgggcaagaucauccacgaguggugcugccgguccugcacccugccgccccugcgcuucaagggggaggacggcugcugguacgggauggagauccggcccgucaaggagaaggaggagaaccuggucaagagcauggugagcgccggcuccggcgaggucgacagcuucucccuggggcuccugugcaucagcaucaugaucgaggaggugaugcgcucccgguggagccgcaagaugcugaugaccggcacccucgccguguucuuccugcugaucauggggcagcucacguggaacgaccugauccggcugugcaucauggucggcgcgaacgccuccgaccgcauggggaugggcaccaccuaccucgcccugauggccaccuucaagaugcgcccgauguucgccgugggccuccuguuccggcgccugacgagccgggaggugcugcuccugaccaucgggcugucccucgucgcgagcguggagcugcccaacucccuggaggagcucggcgacgggcuggccaugggcaucaugauccugaagcuccugaccgacuuccagagccaccagcugugggccacccuccugucccugacguucaucaagaccaccuucagccuccacuacgccuggaagaccauggcgaugguccuguccaucgugagccuguucccccucugccuguccacgaccagccagaagaccaccuggcugcccgugcuccugggcucccuggggugcaagccgcucacgauguuccugaucgccgagaacaagaucuggggccgcaagagcuggccccugaacgaggggaucauggccgucggcaucgugagcauccuccuguccagccugcucaagaacgacgugccccuggccgggccccugaucgccggcggcaugcucaucgcgugcuacgucaucuccgggagcuccgccgaccugagccuggagaaggccgccgagguguccugggaggaggaggccgagcacagcggcgcgucccacaacauccucguggagguccaggacgacgggaccaugaagaucaaggacgaggagcgggacgacacccugaccauccugcucaaggccacccugcuggccgugagcggcguguacccgcucuccauccccgccacgcuguucgucugguacuucuggcagaagaagaagcagcgcagcggggugcugugggacacccccagcccgcccgagguggagcgggccguccucgacgacggcaucuaccgcaucaugcagcggggccugcuggggcgcagccaggugggcgugggggucuuccaggagaacguguuccacaccauguggcacgugacccggggcgcgguccugauguaccaggggaagcgccucgagcccuccugggccagcgugaagaaggaccugaucuccuacggcggcggguggcggcugcagggcagcuggaacacgggggaggaggugcaggucaucgccguggagcccggcaagaaccccaagaacgugcagaccgcccccgggaccuucaagaccuccgagggcgaggucggcgccaucgcgcucgacuucaagcccgggacgagcggcagccccaucgugaaccgcgaggggaagaucgugggccuguacggcaacggggucgugaccaccuccggcaccuacgugagcgccaucgcccaggccaaggcgucccaggaggggccccugccggagaucgaggacgaggucuuccggaagcgcaaccucacgaucauggaccugcaccccggcagcgggaagacccggcgcuaccugcccgccaucgugcgggaggccaucaagcgcaagcuccggacccugauccuggccccgacccgcguggucgccuccgagauggcggaggcccucaagggcaugcccauccgcuaccagacgaccgccgucaagagcgagcacaccggcaaggagaucguggaccugaugugccacgccaccuucacgaugcggcugcucucccccguccgcgugcccaacuacaacaugaucaucauggacgaggcccacuucaccgacccgagcuccaucgcggcccggggguacaucagcacccgcgugggcaugggggaggccgccgccaucuucaugaccgcgacgccgcccggcuccgucgaggccuucccccagagcaacgccaucauccaggacgaggagcgggacaucccggagcgcuccuggaacagcggguacgaguggaucaccgacuuccccggcaagaccgugugguucgugcccuccaucaagagcggcaacgacaucgccaacugccugcggaagaacgggaagcgcgucauccagcugucccggaagaccuucgacacggaguaccagaagaccaagaacaacgacugggacuacguggugaccaccgacaucagcgagaugggcgcgaacuuccgcgccgaccgggucaucgacccccgccggugccucaagccggugauccugaaggacgggcccgagcgcgugauccuggccggccccaugcccgucacgguggccuccgccgcgcagcggcgcgggcggaucggccgcaaccacaacaaggagggcgaccaguacaucuacauggggcagccgcucaacaacgacgaggaccacgcccacuggaccgaggccaagaugcugcuggacaacaucaacacccccgagggcaucauccccgcccucuucgagcccgagcgggagaaguccgccgcgaucgacggggaguaccgccugcgcggcgaggcccggaagaccuucgucgagcugaugcgccgcggggaccucccgguguggcugagcuacaagguggccuccgagggcuuccaguacagcgaccgccgguggugcuucgacggcgagcgcaacaaccagguccuggaggagaacauggacguggagaucuggacgaaggagggggagcggaagaagcuccgcccccgguggcuggacgcccgcaccuacuccgacccccuggcccuccgggaguucaaggaguucgcggccggccgccggagcguguccggggaccugauccuggagaucggcaagcucccccagcaccugacccagcgcgcccagaacgcccuggacaaccucgucaugcugcacaacagcgagcagggcgggcgggcguaccgccacgccauggaggagcugccggacaccaucgagacgcucaugcugcuggcccucaucgccgugcugaccggcggggugacccuguucuuccucuccggccgggggcugggcaagaccagcaucggccugcucugcgucauggccuccagcgugcugcuguggauggcguccguggagccccacuggaucgccgccagcaucauccucgaguucuuccugaugguccugcucauccccgagcccgaccgccagcggaccccgcaggacaaccagcuggccuacguggugaucgggcuccucuucaugauccugacggucgccgcgaacgagaugggccugcucgagaccaccaagaaggaccuggggaucggccacguggccguggagaaccaccaccacgccgccaugcuggacgucgaccuccaccccgccuccgcguggacccuguacgccguggccacgaccaucaucacccccaugaugcgccacaccaucgagaacacgaccgccaacaucagccugaccgccaucgcgaaccaggccgccauccucauggggcuggacaagggcuggccgaucuccaagauggacaucggcgugccccugcucgcccuggggugcuacagccaggucaacccccugacccucacggcggccgugcugaugcugguggcccacuacgccaucaucggccccgggcuccaggccaaggcgacccgggaggcccagaagcgcaccgccgccggcaucaugaagaacccgaccgucgacgggaucguggccaucgaccuggaccccguggucuacgacgcgaaguucgagaagcagcugggccagaucaugcuccugauccugugcacgucccagauccuccugaugcgcaccaccugggcccugugcgagagcaucacccucgccacgggcccccugaccacccugugggaggggucccccggcaaguucuggaacaccacgaucgccgugagcauggccaacaucuuccgggggagcuaccucgcgggcgccggccuggccuucucccugaugaagucccucgggggcgggcgccggggcaccggggcccagggcgagacccugggcgagaaguggaagcgccagcugaaccagcucuccaagagcgaguucaacaccuacaagcgguccgggaucauggagguggaccgcagcgaggcgaaggagggccugaagcgcggggagacgaccaagcacgccgucucccgcggcaccgccaagcugcggugguucguggagcgcaaccucgugaagccggaggggaaggucaucgaccugggcugcggccgcggcggguggagcuacuacugcgccgggcugaagaaggugaccgaggugaagggguacacgaagggcgggcccggccacgaggagcccauccccauggccaccuacggguggaaccuggucaagcuccacuccggcaaggacguguucuucaucccgcccgagaagugcgacacccugcugugcgacaucggggagagcucccccaaccccaccaucgaggagggccgcacgcuccgggugcugaagauggucgagccguggcugcgcgggaaccaguucugcaucaagauccucaaccccuacaugcccagcgugguggagacccuggagcagaugcagcggaagcacggcggcaugcugguccgcaacccccucucccggaacagcacccacgagauguacuggguguccugcgggaccggcaacaucgugagcgcggucaacaugaccucccgcaugcugcugaaccgguucacgauggcccaccgcaagccgaccuacgagcgcgacguggaccucggggccggcacccggcacguggccgucgagcccgaggugcccaaccuggacaucaucggccagcgcaucgagaacaucaagcacgagcacaagagcaccuggcacuacgacgaggacaaccccuacaagacgugggccuaccacggguccuacgaggugaagccgagcggcagcgcguccagcauggucaacgggguggucaagcugcucaccaagcccugggacgugauccccauggugacccagaucgccaugaccgacacgacccccuucggccagcagcgggucuucaaggagaagguggacacccgcaccccgaaggccaagcgggggacggcccagaucauggaggugaccgccaaguggcuguggggcuuccugucccgcaacaagaagccccggaucugcacccgcgaggaguucacccggaagguccgcagcaacgcggccaucggcgccguguucguggacgagaaccaguggaacuccgccaaggaggcggucgaggacgagcgguucugggaccucgugcaccgcgagcgggagcugcacaagcaggggaagugcgccacgugcguguacaacaugaugggcaagcgcgagaagaagcugggggaguucggcaaggccaaggggagccgggccaucugguacauguggcucggcgcccgcuuccuggaguucgaggcgcugggcuucaugaacgaggaccacugguucucccgggagaacagccucuccggggucgagggcgaggggcugcacaagcugggcuacauccuccgcgacaucagcaagauccccgggggcaacauguacgccgacgacaccgccggcugggacacccggaucaccgaggacgaccugcagaacgaggccaagaucacggacaucauggagccggagcacgcccugcucgcgaaguccaucuucaagcugaccuaccagaacaagguggugcgcguccagcggcccgccaagaacgggaccgugauggacgugaucagccgccgcgaccagcggggcuccgggcaggucggcaccuacggccugaacacguucaccaacauggaggcccagcucauccgccagauggagagcgaggggaucuucucccccagcgagcuggagacccccaaccuggccggccgggugcucgacuggcuggagaagcacgggguggagcgccugaagcggauggccaucuccggcgacgacugcgucgugaagccgaucgacgaccgcuucgcgaccgcccucacggcccugaacgacauggggaaggugcggaaggacgucccccagugggagcccagcaagggcuggaacgacuggcagcagguccccuucugcagccaccacuuccaccagcugaucaugaaggacggccgcgagaucguggucccgugccggaaccaggacgagcucguggggcgcgcccgggugucccagggcgccggguggagccugcgcgagaccgcgugccugggcaaguccuacgcccagauguggcagcucauguacuuccaccggcgcgaccugcggcuggccgccaacgcgaucugcagcgccguccccguggacugggugcccaccucccgcaccacguggagcauccacgcccaccaccaguggaugaccaccgaggacaugcucuccgucuggaaccggguguggaucgaggagaaccccuggauggaggacaagacccacaucagcuccuggggcgacgugccguaccugggcaagcgcgaggaccaguggugcggcagccugaucgggcucacggcccgggccaccugggcgaccaacauccaggucgccaucaaccaggugcgccgccugaucggcaacgagaacuaccuggacuacaugaccuccaugaagcgguucaagaacgagagcgaccccgagggggcccucugguga

SEQ ID NO: 8415 - RNA, 9879 nt, Artificial Sequence
  derived and/or modified CDS sequence (opt1) from DENV-1__FJ410245__SS-prME
agcgugaccaugcugcucaugcugaugcccaccgcccuggccuuccaccucaccacccgcggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccgcaucaccgagaccgagcccgacgacguggacugcuggugcaacgccaccgacaccugggugaccuacgggaccugcagccagacgggcgagcaccggcgcgacaagcgguccguggcccucgcgccccacgugggccuggggcuggagacccgcaccgagaccuggaugagcuccgagggcgccuggaagcagauccagcgggucgagacgugggcccuccgccaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagguggccgagacccagcacggcaccgugcugguccagaucaaguacgagggcaccgacgcgcccugcaagauccccuucagcacgcaggacgagaagggggugacccagaacggccggcugaucaccgccaacccgaucgugaccgacaaggagaagcccgucaacaucgaggccgagccgcccuucggggaguccuacaucgugaucggcgccggcgagaaggcgcugaagcucagcugguucaagaagggguccagcaucggcaagauguucgaggccacggcccgcggggcccggcgcauggccauccugggcgacaccgcgugggacuucggguccaucggcggcguguucaccagcgucgggaagcuggugcaccagaucuucggcaccgccuacggggugcuguucuccggcgucagcuggacgaugaagaucgggaucggcgugcugcugaccuggcucggccugaacucccgcagcaccucccugagcaugaccugcaucgccguggggcucgucacgcuguaccugggcgugauggugcaggccgacuccgggugcgucaucaacuggaagggccgggagcucaagugcgggagcggcaucuucgugaccaacgaggugcacaccuggaccgagcaguacaaguuccaggccgacagcccgaagcgccuguccgcggccaucggcaaggccugggaggagggggucugcggcauccggagcgccacccgccuggagaacaucauguggaagcagaucuccaacgagcucaaccacauccugcuggagaacgacaugaaguucacggugguggucggggacguggccggcauccucgcgcaggggaagaagaugauccggccccagcccauggaguacaaguacagcuggaaguccuggggcaaggccaagaucaucggcgccgacgugcagaacaccaccuucaucaucgacgggcccaacaccccggagugccccgacgaccagcgcgccuggaacaucugggaggucgaggacuacggcuucgggaucuucacgaccaacaucuggcugaagcugcgggacagcuacacccaggugugcgaccaccgccucauguccgcggccaucaaggacagcaaggccgugcacgccgacaugggcuacuggaucgaguccgagaagaacgagaccuggaagcuggcccgggcgagcuucaucgaggucaagacgugcaucuggcccaagucccacacccuguggagcaacggcgugcucgaguccgagaugaucauccccaagaucuacgggggcccgaucagccagcacaacuaccgccccggguacuucacccaggccgccggccccuggcaccuggggaagcuggagcucgacuucgaccugugcgagggcaccacgguggucguggacgagcacugcggcaaccgggggccgucccugcgcaccaccaccgugacgggcaagaucauccacgaguggugcugccggagcugcacccugccgccccuccgcuucaagggggaggacggcugcugguacgggauggagauccggcccgucaaggagaaggaggagaaccuggugaaguccauggugagcgccggcagcggcgaggucgacuccuucagccucgggcugcugugcaucuccaucaugaucgaggaggugaugcgcagccgguggucccgccggaugcucaugaccggcacccuggccguguucuuccugcucaucauggggcagcugacguggaacgaccugauccgccucugcaucauggucggcgcgaacgccagcgaccgcauggggaugggcaccaccuaccuggcccugauggccaccuucaagaugcggccgauguucgccgugggccuccuguuccgccggcugacgucccgcgaggugcuccugcugaccaucgggcucagccuggucgcguccguggagcugcccaacagccucgaggagcugggcgacgggcuggccaugggcaucaugauccucaagcugcugaccgacuuccagucccaccagcucugggccacccugcugagccucacguucaucaagaccaccuucucccugcacuacgccuggaagaccauggcgaugguccugagcaucgugucccucuucccccugugccugagcacgaccucccagaagaccaccuggcuccccgugcugcugggcagccucgggugcaagccgcugacgauguuccugaucgccgagaacaagaucuggggccggcgcuccuggccccucaacgaggggaucauggccgucggcaucgugagcauccugcugagcucccuccugaagaacgacgugccccuggccgggccccucaucgccggcggcaugcugaucgcgugcuacgucaucagcggguccagcgccgaccugucccucgagaaggccgccgaggugagcugggaggaggaggccgagcacuccggcgcgagccacaacauccugguggagguccaggacgacgggaccaugaagaucaaggacgaggagcgggacgacacccugaccauccuccugaaggccacccugcucgccguguccggcguguacccgcugagcauccccgccacgcuguucgucugguacuucuggcagaagaagaagcagcgcuccggggugcucugggacacccccagcccgcccgagguggagcgggccguccuggacgacggcaucuaccgcaucaugcagcggggccugcuggggcgcucccaggugggcgugggggucuuccaggagaacguguuccacaccauguggcacgugacccggggcgcgguccucauguaccaggggaagcgccuggagcccagcugggccuccgugaagaaggaccugaucagcuacggcggcggguggcggcuccagggcuccuggaacaucggggaggaggugcaggucaucgccguggagcccggcaagaaccccaagaacgugcagacggcccccgggaccuucaagacccccgagggcgaggucggcgccaucgcgcuggacuucaagcccgggaccagcggcucccccaucgugaaccgcgaggggaagaucgugggccuguacggcaacggggucgugacgaccagcggcaccuacgugagcgccaucgcccaggccaaggcgucccaggaggggccgcuccccgagaucgaggacgaggucuuccggaagcgcaaccugaccaucauggaccugcaccccggcagcgggaagacgcggcgcuaccucccggccaucgugcgggaggccaucaagaagaagcugcgcacccugauccucgcccccacccgcguggucgccuccgagauggcggaggcccugaagggcaugcccauccgguaccagaccacggccgucaagagcgagcacaccggcaaggagaucguggaccugaugugccacgccaccuucaccaugcgccuccugucccccguccgggugccgaacuacaacaugaucaucauggacgaggcccacuucacggaccccagcuccaucgcggcccgcggguacaucagcacccgggugggcaugggggaggccgccgccaucuucaugaccgcgacgccgcccggcuccgucgaggccuucccgcagagcaacgccgugauccaggacgaggagcgcgacauccccgagcgguccuggaacagcggguacgaguggaucacggacuuccccggcaagaccgugugguucguccccuccaucaagagcggcaacgacaucgccaacugccugcgcaagaacgggaagcgggugauccagcucucccgcaagaccuucgacaccgaguaccagaagacgaagaacaacgacugggacuacguggucaccaccgacaucagcgagaugggcgcgaacuuccgggccgaccgcgugaucgacccgcggcgcugccugaagcccgugauccugaaggacgggcccgagcgggucauccucgccggccccaugccggugaccgucgccuccgccgcgcagcgccgggggcgcaucggccggaaccacaacaaggagggcgaccaguacaucuacauggggcagccccugaacaacgacgaggaccacgcccacuggacggaggccaagaugcugcucgacaacaucaacacccccgagggcaucauccccgcccuguucgagccggagcgcgagaaguccgccgcgaucgacggggaguaccgccugcggggcgaggcccgcaagaccuucguggagcucaugcggcgcggggaccugcccguguggcuguccuacaaggucgccagcgagggcuuccaguacagcgaccggcgcuggugcuucgacggcgagcggaacaaccaggugcucgaggagaacauggacguggagaucuggaccaaggagggggagcgcaagaagcugcggccccgcuggcuggacgcccggacguacuccgacccccucgcccugcgcgaguucaaggaguucgcggccggccggcgcagcgucuccggggaccugauccucgagaucggcaagcugccgcagcaccugacccagcgggcccagaacgcccucgacaaccuggugaugcugcacaacagcgagcagggcgggcgcgcguaccggcacgccauggaggagcuccccgacaccaucgagacccugaugcugcucgcccugaucgccgugcugacgggcggggucacccucuucuuccuguccggccgcgggcugggcaagaccagcaucggccuccugugcgugauggccuccagcgugcugcucuggauggcguccgucgagccccacuggaucgccgccagcaucauccuggaguucuuccugauggugcuccugauccccgagccggaccggcagcgcacgccccaggacaaccagcuggccuacguggucaucgggcuccuguucaugauccugaccguggccgcgaacgagaugggccuccuggagacgaccaagaaggaccuggggaucggccacguggccgucgagaaccaccaccacgccgccaugcucgacguggaccugcaccccgccuccgcguggacccuguacgccguggccaccacgaucaucaccccgaugaugcggcacaccaucgagaacaccacggccaacaucagccucaccgccaucgcgaaccaggccgccauccugauggggcuggacaagggcuggcccaucuccaagauggacaucggcgucccccuccuggcccuggggugcuacagccaggugaacccccucacccugaccgcggccgugcugaugcucgucgcccacuacgccaucaucggcccggggcugcaggccaaggcgacgcgcgaggcccagaagcgcaccgccgccggcaucaugaagaaccccaccguggacgggaucguggccaucgaccuggaccccgucguguacgacgcgaaguucgagaagcagcucggccagaucaugcugcugauccucugcaccucccagauccugcugaugcggacgaccugggcccucugcgagagcaucacccuggccaccggcccccugacgacccucugggagggguccccgggcaaguucuggaacaccaccaucgccgugagcauggccaacaucuuccgcggguccuaccuggcgggcgccggccuggccuucagccucaugaagucccucgggggcgggcggcgcgggacgggggcccagggcgagacccugggcgagaaguggaagcggcagcucaaccagcuguccaagagcgaguucaacaccuacaagcgcuccgggaucauggaggucgaccggagcgaggcgaaggagggccugaagcgcggggagaccacgaagcacgccgugucccggggcaccgccaagcuccgcugguucguggagcggaaccuggucaagcccgaggggaaggugaucgaccugggcugcggccgcgggggcuggagcuacuacugcgccgggcugaagaaggugaccgaggucaagggcuacaccaagggcgggcccggccacgaggagcccaucccgauggccacguacggguggaaccucgugaagcugcacuccggcaaggacguguucuucaucccgcccgagaagugcgacacccugcucugcgacaucggggagagcucccccaacccgaccaucgaggagggccggacccugcgcguccugaagaugguggagcccuggcuccgggggaaccaguucugcaucaagauccugaaccccuacaugcccagcguggucgagacgcuggagcagaugcagcgcaagcacggcggcaugcucgugcggaacccgcugucccgcaacagcacccacgagauguacuggguguccugcgggaccggcaacaucgucagcgcggugaacaugaccucccggaugcugcucaaccgcuucaccauggcccaccgcaagcccacguacgagcgggacguggaccugggggccggcacccgccacgucgccguggagcccgagguggccaaccuggacaucaucggccagcggaucgagaacaucaagcacgagcacaagagcaccuggcacuacgacgaggacaaccccuacaagaccugggcguaccacggguccuacgaggucaagccgagcggcuccgccagcagcauggugaacggggucgugaagcuccugacgaagcccugggacgugauccccauggucacccagaucgccaugaccgacaccacgcccuucggccagcagcgcguguucaaggagaagguggacacccggaccccgaaggccaagcgcgggaccgcccagaucauggaggucacggcgaaguggcuguggggcuuccucucccggaacaagaagccccgcaucugcacccgggaggaguucacccgcaaggugcggagcaacgccgccaucggcgccguguucgucgacgagaaccaguggaacuccgcgaaggaggccguggaggacgagcgcuucugggaccuggugcaccgggagcgcgagcugcacaagcaggggaagugcgcgaccugcgucuacaacaugaugggcaagcgggagaagaagcucggggaguucggcaaggccaaggggagccgcgccaucugguacauguggcugggcgcgcgguuccuggaguucgaggcccucggcuucaugaacgaggaccacugguucucccgcgagaacagccuguccgggguggagggcgaggggcugcacaagcucggcuacauccugcgggacaucagcaagauccccgggggcaacauguacgccgacgacacggccggcugggacacccgcaucaccgaggacgaccugcagaacgaggcccggaucaccgacaucauggagccggagcacgcgcuccuggccaaguccaucuucaagcugacguaccagaacaaggugguccgcgugcagcgccccgccaagaacgggaccgugauggacgucaucagccggcgcgaccagcggggcuccggccaggugggcaccuacggccucaacaccuucacgaacauggaggcccagcugauccgccagauggagagcgaggggaucuucucccccagcgagcuggagacccccaaccucgccgagcgggugcuggacuggcuggagaaguacggcgucgagcgccucaagcggauggcgaucuccggggacgacugcguggugaagccgaucgacgaccgcuucgccaccgcccugaccgcccugaacgacaugggcaagguccggaaggacaucccccagugggagcccagcaagggguggaacgacuggcagcagguccccuucugcucccaccacuuccaccagcucaucaugaaggacggccgcgagaucguggucccgugccggaaccaggacgagcuggugggccgcgcccgggugagccagggggcgggcuggagccugcgcgagacggccugccucgggaaguccuacgcccagauguggcagcugauguacuuccaccggcgcgaccugcggcucgccgcgaacgccaucugcagcgccguccccguggacuggauccccaccucccgcaccaccuggagcauccacgcccaccaccaguggaugacgaccgaggacaugcuguccguguggaaccgggucuggaucgaggagaaccccuggauggaggacaagacccacaucagcuccuggggcgacgugccguaccuggggaagcgcgaggaccaguggugcggcagccucaucggccugaccgcccgcgcgacgugggccaccaacauccagguggccaucaaccagguccggcgccugaucgggaacgagaacuaccucgacuacaugaccuccaugaagcgguucaagaacgagagcgaccccgagggcgcccugugguga

SEQ ID NO: 8416 - RNA, 9879 nt, Artificial Sequence
  derived and/or modified CDS sequence (opt1) from DENV-1__FJ410246__SS-prME
agcgugaccaugcugcucaugcugaugcccaccgcccuggccuuccaccucacgacccgcggcggggagccccacaugaucgugagcaagcaggagcggggcaagagccugcuguucaagaccagcgcgggggugaacaugugcacccucaucgccauggaccugggggaguucugcgaggacacgaugaccuacaagugcccccgcaucaccgaggccgagcccgacgacguggacugcuggugcaacgccaccgacacgugggugaccuacgggaccugcagccagaccggggagcaccggcgcgacaagcgguccguggcccuggcgccccacgugggccucgggcuggagacgcgcaccgagaccuggaugagcuccgagggcgccuggaagcagauccagcggguggagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugcccgacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaagaucguccaguacgagaaccugaaguacagcgugaucgugaccguccacaccggcgaccagcaccagguggggaacgaguccacggagcacggcaccaccgcgaccaucacgccccaggcccccagcacggagauccagcugaccgacuacggggcccucacccuggacugcagcccccgcaccggccuggacuucaacgagaugguccuccugacgaugaaggagaaguccuggcuggugcacaagcagugguuccucgaccugccgcugcccuggaccagcggggccuccaccagccaggagaccuggaaccggcaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcauguccuacgucaugugcaccgggagcuucaagcuggagaaggagguggcggagacccagcacggcacggugcucguccagaucaaguacgagggcaccgacgcccccugcaagauccccuucuccacccaggacgagaagggggugacccagaacggccggcugaucacggccaacccgaucgugaccgacaaggacaagcccgucaacaucgaggccgagccgcccuucggggagagcuacaucgugaucggcgcgggcgagaaggcccugaagcuguccugguucaagaaggggagcuccaucggcaagauguucgaggccaccgcccgcggggcccggcgcauggcgauccucggcgacaccgccugggacuucgggagcaucggcggcguguucacguccgucgggaagcuggugcaccagaucuucggcaccgccuacggggugcuguucagcggcgucuccuggaccaugaagaucgggaucggcgugcuccugaccuggcugggccucaacagccgcuccacgagccuguccaugaccugcaucgccguggggcuggucacccucuaccugggcgugauggugcaggccgacagcgggugcgucaucaacuggaagggccgggagcugaagugcgggagcggcaucuucgugaccaacgaggugcacacguggaccgagcaguacaaguuccaggcggacuccccgaagcgccucagcgccgccaucggcaaggccugggaggagggggucugcggcauccgguccgccacccgccuggagaacaucauguggaagcagaucagcaacgagcugaaccacauccuccuggagaacgacaugaaguucaccgugguggucggggacguggcgggcauccuggcccaggggaagaagaugauccggccccagcccauggaguacaaguacuccuggaaguccuggggcaaggccaagaucaucggcgccgacgugcagaacaccacguucaucaucgacgggcccaacaccccggagugccccgacgaccagcgcgcguggaacaucugggaggucgaggacuacggcuucgggaucuucaccaccaacaucuggcucaagcugcgggacuccuacacccaggugugcgaccaccgccugaugagcgccgccaucaaggacuccaaggccgugcacgccgacaugggcuacuggaucgagagcgagaagaacgagaccuggaagcucgcgcgggccuccuucaucgaggucaagaccugcaucuggcccaagagccacacccugugguccaacggcgugcuggagagcgagaugaucauccccaagaucuacgggggcccgaucucccagcacaacuaccgccccggguacuucacgcagaccgccggccccuggcaccucgggaagcuggagcuggacuucgaccucugcgagggcaccaccguggucguggacgagcacugcggcaaccgggggccgagccugcgcacgaccaccgugaccggcaagaucauccacgaguggugcugccgguccugcacgcugccgccccugcgcuucaagggggaggacggcugcugguacgggauggagauccggcccgucaaggagaaggaggagaaccuggucaagagcauggugagcgccggcuccggcgaggucgacagcuucucccuggggcuccugugcaucagcaucaugaccgaggaggugaugcgcucccgguggagccgcaagaugcugaugaccggcacccucgccguguucuuccugcugaucauggggcagcucacguggaacgaccugauccggcugugcaucauggucggcgcgaacgccuccgaccgcauggggaugggcaccaccuaccucgcccugauggccaccuucaagaugcgcccgauguucgccgugggccuccuguuccggcgccugacgagccgggaggugcugcuccugaccaucgggcugucccucgucgcgagcguggagcugcccaacucccuggaggagcucggcgacgggcuggccaugggcaucaugauccugaagcuccugaccgacuuccagagccaccagcugugggccacccuccugucccugacguucaucaagaccaccuucagccuccacuacgccuggaagaccauggcgaugguccuguccaucgugagccuguucccccucugccuguccacgaccagccagaagaccaccuggcugcccgugcuccugggcucccuggggugcaagccgcucacgauguuccugaucgccgagaacaagaucuggggccgcaagagcuggccccugaacgaggggaucauggccgucggcaucgugagcauccuccuguccagccugcucaagaacgacgugccccuggccgggccccugaucgccggcggcaugcucaucgcgugcuacgucaucuccgggagcuccgccgaccugagccuggagaaggccgccgagguguccugggaggaggaggccgagcacagcggcgcgucccacaacauccucguggagguccaggacgacgggaccaugaagaucaaggacgaggagcgggacgacacccugaccauccugcucaaggccacccugcuggccgugagcggcguguacccgcucuccauccccgccacgcuguucgucugguacuucuggcagaagaagaagcagcgcagcggggugcugugggacacccccagcccgcccgagguggagcgggccguccucgacgacggcaucuaccgcaucaugcagcggggccugcuggggcgcagccaggugggcgugggggucuuccaggagaacguguuccacaccauguggcacgugacccggggcgcgguccugauguaccaggggaagcgccucgagcccuccugggccagcgugaagaaggaccugaucuccuacggcggcggguggcggcugcagggcagcuggaacacgggggaggaggugcaggucaucgccguggagcccggcaagaaccccaagaacgugcagaccgcccccgggaccuucaagaccuccgagggcgaggucggcgccaucgcgcucgacuucaagcccgggacgagcggcagccccaucgugaaccgcgaggggaagaucgugggccuguacggcaacggggucgugaccaccuccggcaccuacgugagcgccaucgcccaggccaaggcgucccaggaggggccccugccggagaucgaggacgaggucuuccggaagcgcaaccucacgaucauggaccugcaccccggcagcgggaagacccggcgcuaccugcccgccaucgugcacgaggccaucaagcggaagcuccgcacccugauccuggccccgacccggguggucgccuccgagauggcggaggcccucaagggcaugcccauccgcuaccagacgaccgccgucaagagcgagcacaccggcaaggagaucguggaccugaugugccacgccaccuucacgaugcgccugcucucccccguccgggugcccaacuacaacaugaucaucauggacgaggcccacuucaccgacccgagcuccaucgcggcccgcggguacaucagcacccgggugggcaugggggaggccgccgccaucuucaugaccgcgacgccgcccggcuccgucgaggccuucccccagagcaacgccgugauccaggacgaggagcgcgacaucccggagcgguccuggaacagcggguacgaguggaucaccgacuuccccggcaagaccgugugguucguccccuccaucaagagcggcaacgacaucgccaacugccugcgcaagaacgggaagcgggugauccagcugucccgcaagaccuucgacacggaguaccagaagaccaagaacaacgacugggacuacguggucaccaccgacaucagcgagaugggcgcgaacuuccgggccgaccgcgugaucgacccccggcgcugccucaagccggugauccugaaggacgggcccgagcgggucauccuggccggccccaugcccgugacggucgccuccgccgcgcagcgccgggggcgcaucggccggaaccacaacaaggagggcgaccaguacguguacauggggcagccgcucaacaacgacgaggaccacgcccacuggaccgaggccaagaugcugcuggacaacaucaacacccccgagggcaucauccccgcccucuucgagcccgagcgcgagaaguccgccgcgaucgacggggaguaccggcugcgcggcgaggcccgcaagaccuucguggagcugaugcggcgcggggaccucccggucuggcugagcuacaagguggccuccgagggcuuccaguacagcgaccggcgcuggugcuucgacggcgagcggaacaaccaggugcuggaggagaacauggacgucgagaucuggacgaaggagggggagcgcaagaagcuccggccccgcuggcuggacgcccggaccuacuccgacccccuggcccuccgcgaguucaaggaguucgcggccggccggcgcagcguguccggggaccugauccuggagaucggcaagcucccccagcaccugacccagcgggcccagaacgcccuggacaaccucgugaugcugcacaacagcgagcagggcgggcgcgcguaccggcacgccauggaggagcugccggacaccaucgagacgcucaugcugcuggcccucaucgccguccugaccggcggggugacccuguucuuccucuccggccgcgggcugggcaagaccagcaucggccugcucugcgugauggccuccagcguccugcuguggauggcguccguggagccccacuggaucgccgccagcaucauccucgaguucuuccugauggugcugcucauccccgagcccgaccggcagcgcaccccgcaggacaaccagcuggccuacgucgugaucgggcuccucuucaugauccugacgguggccgcgaacgagaugggccugcucgagaccaccaagaaggaccuggggaucggccacgucgccguggagaaccaccaccacgccgccaugcuggacguggaccuccaccccgccuccgcguggacccuguacgccgucgccacgaccaucaucacccccaugaugcggcacaccaucgagaacacgaccgccaacaucagccugaccgccaucgcgaaccaggccgccauccucauggggcuggacaagggcuggccgaucuccaagauggacaucggcgugccccugcucgcccuggggugcuacagccaggugaacccccugacccucacggcggccguccugaugcugguggcccacuacgccaucaucggccccgggcuccaggccaaggcgacccgcgaggcccagaagcggaccgccgccggcaucaugaagaacccgaccguggacgggaucgucgccaucgaccuggaccccgugguguacgacgcgaaguucgagaagcagcugggccagaucaugcuccugauccugugcacgucccagauccuccugaugcgcaccaccugggcccugugcgagagcaucacccucgccacgggcccccugaccacccugugggaggggucccccggcaaguucuggaacaccacgaucgccgucagcauggccaacaucuuccgcgggagcuaccucgcgggcgccggccuggccuucucccugaugaagucccucgggggcgggcggcgcggcaccggggcccagggcgagacccugggcgagaaguggaagcggcagcugaaccagcucuccaagagcgaguucaacaccuacaagcgcuccgggaucauggagguggaccggagcgaggcgaaggagggccugaagcgcggggagacgaccaagcacgccgugucccggggcaccgccaagcugcgcugguucgucgagcggaaccucgugaagccggaggggaaggugaucgaccugggcugcggccgcgggggcuggagcuacuacugcgccgggcugaagaaggucaccgaggugaagggcuacacgaagggcgggcccggccacgaggagcccauccccauggccaccuacggguggaaccuggugaagcuccacuccggcaaggacgucuucuucaucccgcccgagaagugcgacacccugcugugcgacaucggggagagcucccccaaccccaccaucgaggagggccggacgcuccgcgugcugaagaugguggagccguggcugcgggggaaccaguucugcaucaagauccucaaccccuacaugcccagcgucguggagacccuggagcagaugcagcgcaagcacggcggcaugcuggugcggaacccccucucccgcaacagcacccacgagauguacugggucuccugcgggaccggcaacaucgugagcgcggugaacaugaccucccggaugcugcugaaccgcuucacgauggcccaccggaagccgaccuacgagcgcgacgucgaccucggggccggcacccgccacguggccguggagcccgaggucgccaaccuggacaucaucggccagcggaucgagaacaucaagcacgagcacaagagcaccuggcacuacgacgaggacaaccccuacaagacgugggcguaccacggguccuacgaggugaagcccagcggcagcgccuccagcauggucaacgggguggugaagcugcucaccaagccgugggacgucauccccauggugacccagaucgccaugaccgacacgacccccuucggccagcagcgcguguucaaggagaaggucgacacccggacccccaaggccaagcgcgggacggcccagaucauggaggugaccgcgaaguggcuguggggcuuccugucccggaacaagaagccgcgcaucugcacccgggaggaguucacccgcaaggugcggagcaacgccgccaucggcgccgucuucguggacgagaaccaguggaacuccgcgaaggaggccguggaggacgagcgcuucugggaccucguccaccgggagcgcgagcugcacaagcaggggaagugcgccacgugcguguacaacaugaugggcaagcgggagaagaagcugggggaguucggcaaggccaaggggagccgcgccaucugguacauguggcucggcgcgcgguuccuggaguucgaggcccugggcuucaugaacgaggaccacugguucucccgcgagaacagccucuccgggguggagggcgaggggcugcacaagcugggcuacauccuccgggacaucagcaagauccccgggggcaacauguacgccgacgacaccgccggcugggacacccgcaucaccgaggacgaccugcagaacgaggccaagaucacggacaucauggagcccgagcacgcgcugcucgccaaguccaucuucaagcugaccuaccagaacaaggucgugcgggugcagcgcccggccaagaacgggaccgucauggacgugaucagccggcgcgaccagcgcggcuccggccaggugggcaccuacggccugaacacguucaccaacauggaggcccagcucauccggcagauggagagcgaggggaucuucucccccagcgagcuggagacccccaaccuggccggccgcguccucgacuggcuggagcggcacgggguggagcgccugaagcggauggcgaucuccggcgacgacugcguggucaagcccaucgacgaccgcuucgccaccgcccucacggcccugaacgacauggggaaggugcggaaggacaucccgcagugggagcccagcaagggcuggaacgacuggcagcagguccccuucugcagccaccacuuccaccagcugaucaugaaggacggccgcgagaucgucgugcccugccggaaccaggacgagcucguggggcgcgcccgggucucccagggcgcgggguggagccugcgcgagaccgccugccugggcaaguccuacgcccagauguggcagcucauguacuuccaccggcgcgaccugcggcuggccgcgaacgccaucugcagcgccgugccgguggacuggguccccaccucccgcaccacguggagcauccacgcccaccaccaguggaugaccaccgaggacaugcucuccguguggaaccggguguggaucgaggagaaccccuggauggaggacaagacccacaucagcuccuggggcgacguccccuaccugggcaagcgcgaggaccaguggugcggcagccugaucgggcucacggcccgggcgaccugggccaccaacauccagguggccaucaaccaggugcgccgccugaucggcaacgagaacuaccuggacuacaugaccuccaugaagcgguucaagaacgagagcgacccggagggggcccucugguga

SEQ ID NO: 8417 - RNA, 9879 nt, Artificial Sequence
  derived and/or modified CDS sequence (opt1) from DENV-1__FJ410247__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccgcaucaccgagaccgagcccgacgacguggacugcuggugcaacgccaccgacaccugggugaccuacgggaccugcagccagacgggcgagcaccggcgcgacaagcgguccguggcccucgcgccccacgugggccuggggcuggagacccgcaccgagaccuggaugagcuccgagggcgcguggaagcagauccagcgggucgagacgugggcccuccgccaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccauccugcggaagcucugcaucgaggcgaagaucuccaacaccacgaccgacagccgcugcccgacccagggcgaggccacccugguggaggagcaggacgccaacuucgugugccggcgcacguucgucgaccggggcugggggaacggcugcgggcuguucggcaaggggucccucaucacgugcgccaaguucaagugcgugaccaagcuggagggcaagaucgugcaguacgagaaccugaaguacagcgucaucgugaccgugcacacgggcgaccagcaccaggucgggaacgaguccaccgagcacggcaccaccgccaccaucacgccccaggcgcccaccaccgagauccagcucaccgacuacggggcccugacgcuggacugcagcccccgcaccggccucgacuucaacgagauggugcugcugaccaugaaggagaaguccuggcucguccacaagcagugguuccuggaccugccccuccccuggaccagcggggccagcacgucccaggagaccuggaaccggcaggaccugcuggugaccuucaagaccgcccacgccaagaagcaggagguggucgugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgugaugugcacgggguccuucaagcucgagaaggaggucgccgagacccagcacggcaccgugcuggugcagaucaaguacgagggcaccgacgcgcccugcaagauccccuucagcacgcaggacgagaagggggucacccagaacggccggcugaucaccgccaacccgaucgugaccgacaaggagaagcccgugaacaucgaggccgagccgcccuucggggaguccuacaucgucaucggcgccggcgagaaggcgcugaagcucagcugguucaagaagggguccagcaucggcaagauguucgaggccacggcccgcggggcccggcgcauggccauccugggcgacaccgcgugggacuucggguccaucggcggcguguucaccagcguggggaagcugguccaccagaucuucggcaccgccuacgggguccucuucuccggcgugagcuggacgaugaagaucgggaucggcguccugcugaccuggcucggccugaacucccgcagcaccucccugagcaugaccugcaucgccguggggcucgugacgcuguaccugggcgucauggugcaggccgacuccgggugcgugaucaacuggaagggccgggagcucaagugcgggagcggcaucuucgucaccaacgaggugcacaccuggaccgagcaguacaaguuccaggccgacagcccgaagcgccuguccgcggccaucggcaaggccugggaggagggggugugcggcauccggagcgccacccgccuggagaacaucauguggaagcagaucuccaacgagcucaaccacauccugcuggagaacgacaugaaguucacggucguggugggggacgucgccggcauccucgcgcaggggaagaagaugauccggccccagcccauggaguacaaguacagcuggaaguccuggggcaaggccaagaucaucggcgccgacgugcagaacaccaccuucaucaucgacgggcccaacaccccggagugccccgacgaccagcgcgccuggaacaucugggagguggaggacuacggcuucgggaucuucacgaccaacaucuggcugaagcugcgggacagcuacacccaggucugcgaccaccgccucauguccgcggccaucaaggacagcaaggccgugcacgccgacaugggcuacuggaucgaguccgagaagaacgagaccuggaagcuggcccgggcgagcuucaucgaggugaagacgugcaucuggcccaagucccacacccuguggagcaacggcguccucgaguccgagaugaucauccccaagaucuacgggggcccgaucagccagcacaacuaccgccccggguacuucacccagaccgccggccccuggcaccuggggaagcuggagcucgacuucgaccugugcgagggcacgaccgugguggucgacgagcacugcggcaaccgggggccgucccugcgcaccaccacggugaccggcaagaucauccacgaguggugcugccggagcugcacccugccgccccuccgcuuccgcggggaggacggcugcugguacgggauggagauccgccccgugaaggagaaggaggagaaccuggucaaguccauggugagcgccggcagcggcgagguggacuccuucagccucgggcugcugugcaucuccaucaugaucgaggaggucaugcggagccgcuggucccggaagaugcucaugaccggcacgcuggccguguuccugcuccugaucauggggcagcugaccuggaacgaccucauccgccugugcaucauggugggcgccaacgcgagcgaccgcauggggaugggcaccaccuaccuggcccucauggccacguucaagaugcggccgauguucgccgucgggcugcuguuccgccggcucaccucccgcgaggugcugcugcucaccaucgggcugagccugguggccuccgucgagcuccccaacagccuggaggagcugggcgacgggcucgcgaugggcaucaugauccugaagcugcucaccgacuuccagucccaccagcugugggccacgcugcucagccugaccuucaucaagaccaccuucucccugcacuacgccuggaagacgauggccauggugcucagcaucgucucccuguucccccugugccucagcaccaccucccagaagaccacguggcugcccgugcugcucggcagccuggggugcaagccgcugaccauguuccucaucgcggagaaccggaucuggggccgccgguccuggccccugaacgaggggaucauggccgugggcaucgucagcauccugcucagcucccugcugaagaacgacgugccccucgccgggccccugaucgccggcggcaugcugaucgccugcuacgugaucagcggguccagcgcggaccucucccuggagaaggccgccgaggucagcugggaggaggaggccgagcacuccggcgccagccacaacauccugguggaggugcaggacgacgggaccaugaagaucaaggacgaggagcgcgacgacacccucaccauccugcugaaggcgacgcuccuggccgucuccggcguguacccgcugagcauccccgccacccucuucgugugguacuucuggcagaagaagaagcagcgguccgggguccugugggacacccccagcccgcccgagguggagcgcgccgugcuggacgacggcaucuaccggaucaugcagcgcggccugcucgggcggucccaggucggcguggggguguuccaggagaacgucuuccacaccauguggcacgugacgcgcggcgccgugcugauguaccaggggaagcggcuggagcccagcugggcguccgucaagaaggaccucaucagcuacggcggcggguggcgccugcagggcuccuggaacaccggggaggagguccaggugaucgccgucgagcccggcaagaaccccaagaacgugcagaccacccccgggacguucaagacccccgagggcgaggugggcgccaucgcccuggacuucaagcccgggaccagcggcucccccaucgucaaccgggaggggaagaucgugggccucuacggcaacgggguggucaccacgagcggcaccuacgugagcgccaucgcgcaggccaaggccucccaggaggggccgcugcccgagaucgaggacgagguguuccgcaagcggaaccugaccaucauggaccuccaccccggcagcgggaagacccgccgguaccugccggccaucguccgcgaggcgaucaagcgcaagcugcggacgcucauccuggcccccacccgcgugguggccuccgagauggccgaggcccugaagggcaugcccauccgguaccagaccaccgcggucaagagcgagcacacgggcaaggagaucguggaccucaugugccacgccaccuucaccaugcgccugcugucccccgugcgggucccgaacuacaacaugaucaucauggacgaggcccacuucaccgaccccagcuccaucgccgcccgcggguacaucagcacgcgggugggcaugggggaggcggccgccaucuucaugaccgccacgccgcccggcuccguggaggccuucccgcagagcaacgcggucauccaggacgaggagcgcgacauccccgagcgguccuggaacagcggguacgaguggaucaccgacuuccccggcaagacggugugguucgugcccuccaucaagagcggcaacgacaucgccaacugccuccgcaagaacgggaagcgggucauccagcugucccgcaagaccuucgacaccgaguaccagaagaccaagaacaacgacugggacuacguggugacgaccgacaucagcgagaugggcgccaacuuccgggccgaccgcgucaucgacccgcggcgcugccugaagcccgugauccucaaggacgggcccgagcgggugauccuggcgggccccaugccggucaccguggccuccgccgcccagcgccgggggcgcaucggccgcaaccacaacaaggagggcgaccaguacaucuacauggggcagccccugaacaacgacgaggaccacgcccacuggaccgaggcgaagaugcuccuggacaacaucaacacgcccgagggcaucauccccgcccuguucgagccggagcgggagaaguccgccgccaucgacggggaguaccgccuccggggcgaggcccgcaagaccuucgucgagcugaugcggcgcggggaccugcccguguggcucuccuacaagguggcgagcgagggcuuccaguacagcgaccggcgcuggugcuucgacggcgagcggaacaaccagguccuggaggagaacauggacguggagaucuggaccaaggagggggagcgcaagaagcugcggccccgcuggcucgacgcccggaccuacuccgacccccuggcccugcgcgaguucaaggaguucgccgccggccggcgcagcguguccggggaccucauccuggagaucggcaagcugccgcagcaccucacgcagcgggcgcagaacgcccuggacaaccuggucaugcuccacaacagcgagcagggcgggcgcgccuaccggcacgccauggaggagcugcccgacaccaucgagacccugaugcuccuggcgcugaucgccgugcucaccggcggggugacccuguucuuccuguccggccgcgggcucggcaagacgagcaucggccugcugugcgucauggccuccagcgugcuccuguggauggccuccguggagccccacuggaucgccgcgagcaucauccuggaguucuuccucaugguccugcugauccccgagccggaccggcagcgcacgccccaggacaaccagcucgccuacguggugaucgggcugcuguucaugauccucaccgucgccgccaacgagaugggccugcuggagaccacgaagaaggaccucgggaucggccacguggccguggggaaccaccaccacgcggccaugcuggacgucgaccugcaccccgccuccgccuggacccucuacgccguggcgaccaccaucaucacgccgaugaugcgccacaccaucgagaacaccaccgccaacaucagccugacggccaucgccaaccaggccgcgauccugaugggccucgacaagggcuggcccaucuccaagauggacaucggggugccccugcuggcccucggcugcuacagccaggucaacccccugacccugaccgccgccgugcucaugcugguggcgcacuacgccaucaucgggccgggccugcaggccaaggccacccgggaggcccagaagcgcacggcggccgggaucaugaagaaccccaccgucgacggcaucguggccaucgaccucgaccccguggucuacgacgccaaguucgagaagcagcugggccagaucaugcugcucauccugugcaccucccagauccugcucaugcggaccacgugggcccugugcgagagcaucacccuggcgaccgggccccucaccacgcugugggagggcuccccggggaaguucuggaacaccaccaucgccgugagcauggccaacaucuuccgcggcuccuaccuggccggcgccgggcucgcguucagccugaugaagucccugggcgggggccggcgcgggaccggcgcccagggcgagacgcucggggagaaguggaagcggcagcugaaccagcuguccaagagcgaguucaacaccuacaagcgcuccggcaucauggagguggaccggagcgaggccaaggaggggcucaagcgcggcgagaccaccaagcacgccgucucccgggggacggcgaagcugcgcugguucguggagcggaaccuggugaagcccgagggcaaggucaucgaccugggcugcgggcgcggcggguggagcuacuacugcgccggccucaagaaggugaccgaggugaagggguacaccaagggcggccccgggcacgaggagcccaucccgauggccaccuacggcuggaaccuggucaagcugcacuccgggaaggacguguucuucaucccgcccgagaagugcgacacgcuccugugcgacaucggcgagagcucccccaacccgaccaucgaggaggggcggacccugcgcgugcucaagauggucgagcccuggcugcggggcaaccaguucugcaucaagauccugaaccccuacaugcccagcgugguggagacccucgagcagaugcagcgcaagcacggcgggaugcugguccggaacccgcugucccgcaacagcacccacgagauguacuggguguccugcggcacggggaacaucgugagcgccgucaacaugaccucccgcaugcuccugaaccgguucaccauggcccaccgcaagcccaccuacgagcgggacguggaccugggcgcgggcacgcgccacguggccgucgagcccgagguggccaaccucgacaucaucgggcagcggaucgagaacaucaagcacgagcacaagagcaccuggcacuacgacgaggacaaccccuacaagaccugggccuaccacggcuccuacgaggugaagccgagcggguccgccagcagcauggucaacggcguggucaagcugcugaccaagcccugggacgugauccccauggugacgcagaucgcgaugaccgacaccacccccuucgggcagcagcgcgucuucaaggagaagguggacacgcggaccccgaaggccaagcagggcaccgcccagaucauggaggugaccgccaaguggcucuggggcuuccugucccgcaacaagaagccccggaucugcacgcgcgaggaguucacccggaagguccgcagcaacgccgcgaucggggccguguucguggacgagaaccaguggaacuccgccaaggaggccgucgaggacgagcgguucugggaccuggugcaccgcgagcgggagcuccacaagcagggcaagugcgcgaccugcguguacaacaugauggggaagcgcgagaagaagcugggcgaguucgggaaggccaagggcagccgggccaucugguacauguggcugggcgcccgcuuccucgaguucgaggcccugggguucaugaacgaggaccacugguucucccgggagaacagccuguccggcgucgagggggagggccuccacaagcugggguacauccugcgcgacaucagcaagauccccggcggcaacauguacgcggacgacaccgccgggugggacacgcggaucaccgaggacgaccuccagaacgaggcccgcaucaccgacaucauggagccggagcacgcccugcuggccaaguccaucuucaagcucaccuaccagaacaagguggugcgcguccagcggcccgcgaagaacggcacggugauggacgugaucagccgccgggaccagcgcggguccggccaggucggcaccuacgggcugaacaccuucaccaacauggaggcccagcugauccggcagauggagagcgagggcaucuucucccccagcgagcucgagacgcccaaccuggccgagcgcgugcuggacuggcucgagaaguacgggguggagcggcugaagcgcauggccaucuccggcgacgacugcgucgugaagccgaucgacgaccgguucgccaccgcgcugaccgcccucaacgacauggggaaggugcgcaaggacaucccccagugggagcccagcaagggcuggaacgacuggcagcagguccccuucugcucccaccacuuccaccagcugaucaugaaggacggccgggagaucguggugccgugccgcaaccaggacgagcuggucgggcgggcccgcgugagccagggcgccggguggagccuccgggagaccgccugccugggcaaguccuacgcgcagauguggcagcugauguacuuccaccgccgggaccuccgccuggccgccaacgccaucugcagcgcggugcccgucgacuggauccccacgucccggaccaccuggagcauccacgcccaccaccaguggaugaccacggaggacaugcuguccguguggaaccgcguguggaucgaggagaaccccuggauggaggacaagacccacaucagcuccuggggcgacgucccguaccucggcaagcgcgaggaccaguggugcggcagccugaucgggcugaccgcccgggccaccugggccaccaacauccagguggcgaucaaccaggugcgccggcucaucggcaacgagaacuaccuggacuacaugacguccaugaagcgcuucaagaacgagagcgaccccgagggggcccugugguga

SEQ ID NO: 8418 - RNA, 9879 nt, Artificial Sequence
  derived and/or modified CDS sequence (opt1) from DENV-1__FJ410248__SS-prME
agcgugaccaugcugcugaugcugaugcccaccgcccuggccuuccaccucacgacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccgcaucaccgaggccgagcccgacgacguggacugcuggugcaacgccaccgacacgugggugaccuacgggaccugcagccagaccggcgagcaccggcgggacaagcgguccguggcccucgcgccccacgugggccuggggcuggagacgcgcaccgagaccuggaugagcuccgagggcgccuggaagcagauccagcggguggagaccugggcccuccgccaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcggugcugcggaagcucugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacaccggcgaccagcaccagguggggaacgaguccacggagcacggcaccaccgcgaccaucacgccccaggcccccagcacggagauccagcucaccgacuacggggcccugacccuggacugcagcccccggaccggccucgacuucaacgagaugguccugcugacgaugaaggagaaguccuggcucgugcacaagcagugguuccuggaccugccgcuccccuggaccagcggggccuccaccagccaggagaccuggaaccggcaggaccugcuggugacguucaagaccgcccacgcgaagaagcaggaggucguggugcucggcucccaggagggcgccaugcacaccgcccugaccggggccacggagauccagaccagcggcaccaccacgaucuucgccgggcaccugaagugccgccucaagauggacaagcugacccugaagggcauguccuacgucaugugcaccgggagcuucaagcucgagaaggagguggcggagacccagcacggcacggugcugguccagaucaaguacgagggcaccgacgcccccugcaagauccccuucuccacccaggacgagaagggggugacccagaacggccggcugaucacggccaacccgaucgugaccgacaaggagaagcccgucaacaucgaggccgagccgcccuucggggagagcuacaucgugaucggcgcgggcgagaaggcccugaagcucuccugguucaagaaggggagcuccaucggcaagauguucguggccaccgcccgcggggcccggcgcauggcgauccugggcgacaccgccugggacuucgggagcaucggcggcgucuucacguccguggggaagcuggugcaccagaucuucggcaccgccuacgggguccucuucagcggcguguccuggaccaugaagaucgggaucggcgugcugcugaccuggcucggccugaacagccgcuccacgagccuguccaugaccugcaucgccgucgggcucgugacccuguaccugggcgugaugguccaggccgacagcgggugcgugaucaacuggaagggccgggagcucaagugcgggagcggcaucuucgugaccaacgagguccacacguggaccgagcaguacaaguuccaggcggacuccccgaagcgccugagcgccgccaucggcaaggccugggaggagggggugugcggcauccgguccgccacccgccuggagaacaucauguggaagcagaucagcaacgagcucaaccacauccugcuggagaacgacaugaaguucaccguggucgugggggacguggcgggcauccucgcccaggggaagaagaugauccggccccagcccauggaguacaaguacuccuggaaguccuggggcaaggccaagaucaucggcgccgacguccagaacaccacguucaucaucgacgggcccaacaccccggagugccccgacgaccagcgcgcguggaacaucugggagguggaggacuacggcuucgggaucuucaccaccaacaucuggcugaagcugcgggacuccuacacccaggugugcgaccaccgccucaugagcgccgccaucaaggacuccaaggccguccacgccgacaugggcuacuggaucgagagcgagaagaacgagaccuggaagcuggcgcgggccuccuucaucgaggugaagaccugcaucuggcccaagagccacacccugugguccaacggcgugcucgagagcgagaugaucauccccaagaucuacgggggcccgaucucccagcacaacuaccgccccggguacuucacgcagaccgccggccccuggcaccuggggaagcuggagcucgacuucaaccugugcgagggcaccaccgucgugguggacgagcacugcggcaaccgggggccgagccugcgcacgaccaccgucaccggcaagaucauccacgaguggugcugccgguccugcacgcugccgccccuccgcuucaagggggaggacggcugcugguacgggauggagauccggcccgugaaggagaaggaggagaaccuggucaagagcauggucagcgccggcuccggcgagguggacagcuucucccucgggcugcugugcaucagcaucaugaucgaggaggugaugcgcucccgguggagccgcaagaugcucaugaccggcacccuggccgucuucuuccugcucaucauggggcagcugaccuggaacgaccugauccggcucugcaucauggugggcgcgaacgccuccgaccgcauggggaugggcacgaccuaccuggcccugauggccaccuucaagaugcgcccgaugcucgccgugggccugcuguuccggcgccucaccagccgggagguccugcugcucacgaucgggcugucccugguggcgagcgucgagcuccccaacucccuggaggagcugggcgacgggcucgccaugggcaucaugauccugaagcugcucaccgacuuccagagccaccagcugugggccacccugcucucccugaccuucaucaagacgaccuacagccugcacuacgccuggaagaccauggcgauggugcucuccaucgugagccuguucccccugugccucuccaccacgagccagaagaccaccuggcugcccguccugcucggcucccuggggugcaagccgcugaccauguuccucaucgccgagaacaagaucuggggccgcaagagcuggccccugaacgaggggaucauggccgugggcaucgugagcauccugcucuccagccugcugaagaacgacgucccccucgccgggccccugaucgccggcggcaugcugaucgcgugcuacgugaucuccgggagcuccgccgaccucagccuggagaaggccgccgagguguccugggaggaggaggccgagcacagcggcgcgucccacaacauccuggucgaggugcaggacgacgggacgaugaagaucaaggacgaggagcgggacgacacccucaccauccugcugaaggccacccuccuggccgugagcggcgucuacccgcuguccauccccgccacccucuucgugugguacuucuggcagaagaagaagcagcgcagcggggugcugugggacacgcccagcccgcccgaggucgagcgggccgugcuggacgacggcaucuaccgcaucaugcagcggggccugcucgggcgcagccaggugggcgucgggguguuccaggagaacguguuccacaccauguggcacgucacccggggcgcggugcugauguaccaggggaagcgccuggagcccuccugggccagcgugaagaaggaccucaucuccuacggcggcggguggcggcugcagggcagcuggaacaccggggaggagguccaggugaucgccguggagcccggcaagaaccccaagaacguccagacggcccccgggaccuucaagaccuccgagggcgaggugggcgccaucgcgcuggacuucaagcccgggaccagcggcagccccaucgugaaccgcgaggggaagaucgucggccucuacggcaacgggguggugacgaccuccggcaccuacgucagcgccaucgcccaggccaaggcgucccaggaggggccccugccggagaucgagaacgagguguuccggaagcgcaaccugaccaucauggaccuccaccccggcagcgggaagacgcggcgcuaccugcccgccaucgugcgggaggccaucaagcgcaagcugcggacccucauccuggccccgacccgcgucguggccuccgagauggcggaggcccugaagggcaugcccauccgcuaccagaccacggccgucaagagcgagcacaccggcaaggagaucgucgaccucaugugccacgccaccuucaccaugcggcugcugucccccgugcgcgugcccaacuacaacaugaucaucauggacgaggcccacuucacggacccgagcuccaucgcggcccggggguacaucagcacccgcgucggcaugggggaggccgccgccaucuucaugaccgcgacgccgcccggcuccguggaggccuucccccagagcaacgccgugauccaggacgaggagcgggacaucccggagcgcuccuggaacagcggguacgaguggaucacggacuuccccggcaagaccgucugguucgugcccuccaucaagagcggcaacgacaucgccaacugccuccggaagaacgggaagcgcgugauccagcugucccggaagaccuucgacaccgaguaccagaagacgaagaacaacgacugggacuacgucgugaccaccgacaucagcgagaugggcgcgaacuuccgcgccgaccgggugaucgacccccgccggugccugaagccggucauccucaaggacgggcccgagcgcgugauccuggccggccccaugcccgucaccguggccuccgccgcgcagcggcgcgggcggaucggccgcaaccacaacaaggagggcgaccaguacaucuacauggggcagccgcugaacaacgacgaggaccacgcccacuggacggaggccaagaugcuccuggacaacaucaacacccccgagggcaucauccccgcccuguucgagcccgagcgggagaaguccgccgcgaucgacggggaguaccgccuccgcggcgaggcccggaagaccuucguggagcugaugcgccgcggggaccugccggucuggcucagcuacaagguggccuccgagggcuuccaguacagcgaccgccgguggugcuucgacggcgagcgcaacaaccaggugcuggaggagaacauggacgucgagaucuggaccaaggagggggagcggaagaagcugcgcccccgguggcucgacgcccgcacguacuccgacccccuggcccugcgggaguucaaggaguucgcggccggccgccggagcguguccggggaccucauccuggagaucggcaagcugccccagcaccucacccagcgcgcccagaacgcccuggacaaccuggugaugcuccacaacagcgagcagggcgggcgggcguaccgccacgccauggaggagcugccggacaccaucgagacccugaugcuccuggcccugaucgccguccucacgggcggggugacccuguucuuccuguccggccgggggcucggcaagaccagcaucggccugcugugcgugauggccuccagcguccuccuguggauggcguccguggagccccacuggaucgccgccagcaucauccuggaguucuuccucauggugcugcugauccccgagcccgaccgccagcggaccccgcaggacaaccagcucgccuacgucgugaucgggcugcuguucaugauccucaccguggccgcgaacgagaugggccugcuggagacgaccaagaaggaccucgggaucggccacgucgccguggagaaccaccaccacgccgccaugcuggacguggaccugcaccccgccuccgcguggacccucuacgccgucgccaccacgaucaucacccccaugaugcgccacaccaucgagaacaccacggccaacaucagccugaccgccaucgcgaaccaggccgccauccugauggggcucgacaagggcuggccgaucuccaagauggacaucggcgugccccugcuggcccucgggugcuacagccaggugaacccccugacccugaccgcggccguccucaugcugguggcccacuacgccaucaucggccccgggcugcaggccaaggcgacgcgggaggcccagaagcgcaccgccgccggcaucaugaagaacccgaccguggacgggaucgucgccaucgaccucgaccccgugguguacgacgcgaaguucgagaagcagcugggccagaucaugcugcucauccugugcaccucccagauccugcucaugcgcacgaccugggcccugugcgagagcaucacccuggccaccggcccccucacgacccugugggaggggucccccggcaaguucuggaacaccaccaucgccgucagcauggccaacaucuuccgggggagcuaccuggcgggcgccggccucgccuucucccugaugaagucccucgggggcgggcgccgggggacgggggcccagggcgagacccucggcgagaaguggaagcgccagcugaaccagcuguccaagagcgaguucaacaccuacaagcgguccgggaucauggagguggaccgcagcgaggcgaaggagggccucaagcgcggggagaccacgaagcacgccgugucccgcggcaccgccaagcugcggugguucgucgagcgcaaccuggugaagccggaggggaaggugaucgaccugggcugcggccgcggcggguggagcuacuacugcgccgggcucaagaaggucaccgaggugaagggguacaccaagggcgggcccggccacgaggagcccauccccauggccacguacggguggaaccuggugaagcugcacuccggcaaggacgucuucuucaucccgcccgagaagugcgacacccuccugugcgacaucggggagagcucccccaaccccaccaucgaggagggccgcacccugcgggugcucaagaugguggagccguggcugcgcgggaaccaguucugcaucaagauccugaaccccuacaugcccagcgucguggagacgcucgagcagaugcagcggaagcacggcggcaugcuggugcgcaacccccugucccggaacagcacccacgagauguacugggucuccugcgggaccggcaacaucgugagcgcggugaacaugaccucccgcaugcuccugaaccgguucaccauggcccaccgcaagccgacguacgagaaggacgucgaccugggggccggcacccgccacguggccguggagcccgaggucgccaaccucgacaucaucggccagcggaucgagaacaucaagcacgagcacaagagcaccuggcacuacgacgaggacaaccccuacaagaccugggcguaccacggguccuacgaggugaagcccagcggcagcgccuccagcauggucaacgggguggugaagcugcugacgaagccgugggacgucauccccauggugacccagaucgccaugaccgacaccacgcccuucggccagcagcgcguguucaaggagaaggucgacacccggacccccaaggccaagcgcgggaccgcccagaucauggaggugacggcgaaguggcucuggggcuuccugucccggaacaagaagccgcgcaucugcacccgggaggaguucacccgcaaggugcggagcaacgccgccaucggcgccgucuucguggacgagaaccaguggaacuccgcgaaggaggccguggaggacgagcgcuucugggaccugguccaccgggagcgcgagcuccacaagcaggggaagugcgcgaccugcguguacaacaugaugggcaagcgggagaagaagcugggggaguucggcaaggccaaggggagccgcgccaucugguacauguggcugggcgcgcgguuccucgaguucgaggcccugggcuucaugaacgaggaccacugguucucccgcgagaacagccuguccgggguggagggcgaggggcuccacaagcugggcuacauccugcgggacaucagcaagauccccgggggcaacauguacgccgacgacacggccggcugggacacccgcaucaccgaggacgaccuccagaacgaggccaagaucaccgacaucauggagcccgagcacgcgcugcuggccaaguccaucuucaagcucacguaccagaacaaggucgugcgggugcagcgcccggccaagaacgggaccgucauggacgugaucagccggcgcgaccagcgcggcuccggccaggugggcaccuacggccugaacaccuucacgaacauggaggcccagcugauccggcagauggagagcgaggggaucuucucccccagcgagcucgagacccccaaccuggccggccgcguccuggacuggcucgagaagcacgggguggagcggcugaagcgcauggcgaucuccggcgacgacugcguggucaagcccaucgacgaccgguucgccaccgcccugaccgcccucaacgacauggggaaggugcgcaaggacaucccgcagugggagcccagcaagggcuggaacgacuggcagcagguccccuucugcagccaccacuuccaccagcugaucaugaaggacggccgggagaucgucgugcccugccgcaaccaggacgagcugguggggcgggcccgcgucucccagggcgcgggguggagccuccgggagacggccugccugggcaaguccuacgcccagauguggcagcugauguacuuccaccgccgggaccuccgccuggccgcgaacgccaucugcagcgccgugccgguggacuggguccccaccucccggaccaccuggagcauccacgcccaccaccaguggaugacgaccgaggacaugcuguccguguggaaccgcguguggaucgaggagaaccccuggauggaggacaagacccacaucagcuccuggggcgacguccccuaccucggcaagcgggaggaccaguggugcggcagccugaucgggcugaccgcccgcgcgacgugggccaccaacauccagguggccaucaaccaggugcggcgccucaucggcaacgagaacuaccuggacuacaugaccuccaugaagcgcuucaagaacgagagcgacccggagggggcccugugguga

SEQ ID NO: 8419 - RNA, 9879 nt, Artificial Sequence
  derived and/or modified CDS sequence (opt1) from DENV-1__FJ410249__SS-prME
agcgugacgaugcugcucaugcugaugcccacggcccuggccuuccaccucacgacccggggcggggagccccacaugaucgugagcaagcaggagcggggcaagagccugcuguucaagaccagcgcgggggugaacaugugcacccucaucgccauggaccugggcgaguucugcgaggacacgaugaccuacaagugcccccggaucaccgaggccgagcccgacgacguggacugcuggugcaacgccaccgacacgugggugaccuacgggaccugcagccagaccggcgagcggcgccgggacaagcgcuccguggcccuggcgccccacgugggccucgggcuggagacgcggaccgagaccuggaugagcuccgagggcgccuggaagcagauccagcgcgucgagaccugggcccugcggcaccccggguucacggugaucgcccucuuccuggcgcacgccaucggcaccagcaucacccagaaggggaucaucuucauccugcucaugcuggugacccccuccauggccaugcgcugcgucggcgugggcagccgggacuucguggaggggcuguccggcgccacgugggucgacguggugcucgagcacgggagcugcgucaccaccauggccaaggacaagcccacccuggacaucgagcugcucaagacggaggugaccaaccccgcggugcugcgcaagcugugcaucgaggccaagaucuccaacaccaccacggacagccggugcccgacccagggcgaggccacccucgucgaggagcaggacgccaacuucgugugccgccggaccuucguggaccgcggcugggggaacggcugcgggcuguucggcaaggggucccugaucacgugcgccaaguucaagugcgucaccaagcucgagggcaagaccgugcaguacgagaaccugaaguacagcgugaucgucaccgugcacacgggcgaccagcaccaggucgggaacgaguccaccgagcacggcaccaccgcgaccaucacgccccaggcccccagcaccgagauccagcugaccgacuacggggcccucacccuggacugcagcccccggacgggccuggacuucaacgagauggugcuccugaccaugaaggagaaguccuggcuggugcacaagcagugguuccucgaccugccgcugcccuggaccagcggggccuccaccagccaggagacguggaaccgcaaggaccuccuggucaccuucaagaccgcccacgcgaagaagcaggagguggugguccugggcucccaggagggcgccaugcacaccgcccucacgggggccaccgagauccagaccagcggcaccacgaccaucuucgccgggcaccugaagugccggcugaagauggacaagcucacccugaagggcauguccuacgugaugugcaccgggagcuucaagcuggagaaggagguggcggagacgcagcacggcaccguccucgugcagaucaaguacgagggcaccgacgcccccugcaagauccccuucuccacccaggacgagaagggggugacgcagaacggccgccugaucaccgccaacccgaucgucaccgacaaggagaagcccgugaacaucgaggccgagccgcccuucggggagagcuacaucgugaucggcgcgggcgagaaggcccugaagcuguccugguucaagaaggggagcuccaucggcaagauguucgaggccaccgcccgcggggcccgccgcauggcgauccucggcgacacggccugggacuucgggagcaucggcggcgucuucaccuccguggggaagcuggugcaccagaucuucggcgccgccuacgggguccuguucagcggcguguccuggaccaugaagaucgggaucggcgugcuccugaccuggcugggccucaacagccgguccacgagccuguccaugaccugcaucgccgucgggcuggugacccucuaccugggcgugaugguccaggcggacagcgggugcgugaucaacuggaagggccgcgagcugaagugcgggagcggcaucuucgugaccaacgagguccacacguggaccgagcaguacaaguuccaggccgacuccccgaagcggcucagcgccgccaucggcaaggccugggaggagggggugugcggcauccgcuccgcgacccggcuggagaacaucauguggaagcagaucagcaacgagcugaaccacauccuccuggagaacgacaugaaguucaccguggucgugggggacguggccggcauccuggcccaggggaagaagaugauccgcccccagcccauggaguacaaguacuccuggaaguccuggggcaaggccaagaucaucggcgcggacguccagaacaccacguucaucaucgacgggcccaacaccccggagugccccgacgaccagcgggccuggaacaucugggagguggaggacuacggcuucgggaucuucaccaccaacaucuggcucaagcugcgcgacuccuacacccaggugugcgaccaccggcugaugagcgccgccaucaaggacuccaaggccguccacgcggacaugggcuacuggaucgagagcgagaagaacgagaccuggaagcucgcccgcgccuccuucaucgaggugaagaccugcaucuggcccaagagccacacccugugguccaacggcgugcuggagagcgagaugaucauccccaagaucuacgggggcccgaucucccagcacaacuaccggcccggguacuucacgcagaccgccggccccuggcaccucgggaagcuggagcuggacuucgaccucugcgagggcaccaccgucgugguggacgagcacugcggcaaccgcgggccgagccugcggacgaccaccgucaccggcaagaucauccacgaguggugcugccgcuccugcacgcugccgccccugcgguucaagggggaggacggcugcugguacgggauggagauccgccccgugaaggagaaggaggagaaccuggucaagagcauggucagcgccggcuccggcgagguggacagcuucucccuggggcuccugugcaucagcaucaugaucgaggaggugaugcggucccgcuggagccggaagaugcugaugaccggcacccucgcggucuucuucuuccugaucauggggcagcugaccuggaacgaccucauccgccugugcaucauggugggcgccaacgccuccgaccgcauggggaugggcacgaccuaccuggcccucauggccaccuucaagaugcggccgauguucgcgguggggcugcuguuccgccggcucaccagccgcgagguccugcugcucacgaccgggcugucccugguggccagcgucgagcuccccaacucccuggaggagcugggcgacgggcucgccaugggcaucaugauccugaagcugcucaccgacuuccagagccaccagcugugggccacccugcucucccugacguucaucaagaccaccuucagccugcacuacgcguggaagaccauggccauggugcucuccaucgugagccuguucccccugugccucuccacgaccagccagaagaccaccuggcugcccguccugcucggcucccuggggugcaagccgcugacgauguuccucaucgccgagaacaagaucuggggccgcaagagcuggccccugaacgaggggaucauggccgugggcaucgugagcauccugcucuccagccugcugaagaacgacgucccccucgccgggccccugaucgcgggcggcaugcugaucgccugcuacgugaucuccgggagcuccgccgaccucagccuggagaaggccgccgagguguccugggaggaggaggcggagcacagcggcgccucccacaacauccuggucgaggugcaggacgacgggaccaugaagaucaaggacgaggagcgcgacgacacccucaccauccugcugaaggccacccuccuggccgugagcggcgucuacccgcuguccauccccgccacccucuucgugugguacuucuggcagaagaagaagcagcggagcggggugcugugggacacccccagcccgcccgaggucgagcgcgcggugcuggacgacggcaucuaccggaucaugcagcgcggccuccuggggcggagccaggugggcgucgggguguuccaggagaacguguuccacaccauguggcacgucacccgcggcgccgugcugauguaccaggggaagcggcuggagcccuccugggccagcgugaagaaggaccucaucuccuacggcggcggguggcgccugcagggcagcuggaacacgggggaggagguccaggugaucgccguggagcccggcaagaaccccaagaacguccagaccgcccccgggaccuucaagaccuccgagggcgaggugggcgcgaucgcccuggacuucaagcccgggacgagcggcagccccaucgugaaccgggaggggaagaucgucggccucuacggcaacgggguggugaccaccuccggcaccuacgucagcgccaucgcccaggcgaaggccucccaggaggggccccugccggagaucgaggacgagguguuccgcaagcggaaccugacgaucauggaccuccaccccggcagcgggaagacccgccgguaccugcccgccaucgugcgcgaggccaucaagcggaagcugcgcacccucauccuggccccgacccgcgucguggcguccgagauggccgaggcccugaagggcaugcccauccgguaccagacgaccgccgucaagagcgagcacaccggcaaggagaucgucgaccucaugugccacgccaccuucacgaugcgccugcugucccccgugcgggugcccaacuacaacaugaucaucauggacgaggcgcacuucaccgacccgagcuccaucgccgcccgcggguacaucagcacccgggucggcaugggggaggccgccgcgaucuucaugaccgccacgccgcccggcuccguggaggccuucccccagagcaacgccgugauccaggacgaggagcgcgacaucccggagcgguccuggaacagcggguacgaguggaucaccgacuuccccggcaagaccgucugguucgugcccuccaucaagagcggcaacgacaucgcgaacugccuccgcaagaacgggaagcgggugauccagcugucccgcaagaccuucgacacggaguaccagaagaccaagaacaacgacugggacuacgucgugaccaccgacaucagcgagaugggcgccaacuuccgggccgaccgcgugaucgacccccggcgcugccugaagccggucauccucaaggacgggcccgagcgggugauccuggccggccccaugcccgucacgguggccuccgcggcccagcgccgggggcgcaucggccggaaccacaacaaggagggcgaccaguacaucuacauggggcagccgcugaacaacgacgaggaccacgcccacuggaccgaggccaagaugcuccuggacaacaucaacacccccgagggcaucauccccgcccuguucgagcccgagcgcgagaaguccgcggccaucgacggggaguaccgccuccggggcgaggcccgcaagaccuucguggagcugaugcggcgcggggaccugccggucuggcucagcuacaagguggccuccgagggcuuccaguacagcgaccggcgcuggugcuucgacggcgagcggaacaaccaggugcuggaggagaacauggacgucgagaucuggacgaaggagggggagcgcaagaagcugcggccccgcuggcucgacgcccggaccuacuccgacccccuggcgcugcgcgaguucaaggaguucgccgccggccggcgcagcguguccggggaccucauccuggagaucggcaagcugccccagcaccucacccagcgggcccagaacgcgcuggacaaccuggugaugcuccacaacagcgagcagggcgggcgcgccuaccggcacgccauggaggagcugccggacaccaucgagacgcugaugcuccuggcccugaucgccguccucaccggcggggugacccuguucuuccuguccggccgcgggcucggcaagaccagcaucggccugcugugcgugauggcguccagcguccuccuguggauggccuccguggagccccacuggaucgccgccagcaucauccuggaguucuuccucauggugcugcugauccccgagcccgaccggcagcgcaccccgcaggacaaccagcucgccuacgucgugaucgggcugcuguucaugauccucacgguggcggccaacgagaugggccugcuggagaccaccaagaaggaccucgggaucggccacgucgccguggagaaccaccaccacgccgccaugcuggacguggaccugcaccccgcguccgccuggacccucuacgccgucgccacgaccaucaucacccccaugaugcggcacaccaucgagaacacgaccgccaacaucagccugaccgcgaucgccaaccaggccgccauccugauggggcucgacaagggcuggccgaucuccaagauggacaucggcgugccccugcuggcgcucgggugcuacagccaggugaacccccugacccugacggccgccguccucaugcugguggcccacuacgccaucaucggccccgggcugcaggcgaaggccacccgcgaggcccagaagcgcaccgccgccggcaucaugaagaacccgaccguggacgggaucgucgcgaucgaccucgaccccgugguguacgacgccaaguucgagaagcagcugggccagaucaugcugcucauccugugcacgucccagauccugcucaugcggaccaccugggcccugugcgagagcaucacccuggccacgggcccccucaccacccugugggaggggucccccggcaaguucuggaacaccacgaucgccgucagcauggcgaacaucuuccgcgggagcuaccuggccggcgccggccucgccuucucccugaugaagucccucgggggcgggcggcgcgggaccggggcgcagggcgagacccucggcgagaaguggaagcggcagcugaaccagcuguccaagagcgaguucaacaccuacaagcgcuccgggaucauggagguggaccggagcgaggccaaggagggccucaagcgcggggagacgaccaagcacgccgugucccggggcaccgccaagcugcgcugguucgucgagcggaaccuggugaagccggaggggaaggugaucgaccucggcugcggccgcgggggcuggagcuacuacugcgccgggcugaagaaggucaccgaggugaagggcuacacgaagggcgggcccggccacgaggagcccauccccauggcgaccuacggguggaaccuggugaagcugcacuccggcaaggacgucuucuucaucccgcccgagaagugcgacacccuccugugcgacaucggggagagcucccccaaccccaccaucgaggagggccggacgcugcgcgugcucaagaugguggagccguggcugcgggggaaccaguucugcaucaagauccugaaccccuacaugcccagcgucguggagacccucgagcagaugcagcgcaagcacggcggcaugcuggugcggaacccccugucccgcaacagcacccacgagauguacugggucuccugcgggaccggcaacaucgugagcgccgugaacaugaccucccggaugcuccugaaccgcuucacgauggcccaccgcaagccgaccuacgagcgggacgucgaccugggggccggcacccgccacguggccguggagcccgaggucgcgaaccucgacaucaucggccagcggaucgagaacaucaagcacgagcacaagagcaccuggcacuacgacgaggacaaccccuacaagacgugggccuaccacggguccuacgaggugaagcccagcggcagcgccuccagcauggucaacgggguggugaagcugcugaccaagccgugggacgucauccccauggugacccagaucgccaugaccgacacgacccccuucggccagcagcgcguguucaaggagaaggucgacacccggacccccaaggccaagcgcgggacggcgcagaucauggaggugaccgccaaguggcucuggggcuuccugucccggaacaagaagccgcgcaucugcacccgggaggaguucacccgcaaggugcggagcaacgccgccaucggcgcggucuucguggacgagaaccaguggaacuccgccaaggaggccguggaggacgagcgcuucugggaccugguccaccgggagcgcgagcuccacaagcaggggaagugcgccacgugcguguacaacaugaugggcaagcgggagaagaagcugggggaguucggcaaggccaaggggagccgcgcgaucugguacauguggcugggcgcccgguuccucgaguucgaggcccugggcuucaugaacgaggaccacugguucucccgcgagaacagccuguccgggguggagggcgaggggcuccacaagcugggcuacauccugcgggacaucagcaagauccccgggggcaacauguacgccgacgacaccgccggcugggacacccgcaucaccgaggacgaccuccagaacgaggcgaagaucacggacaucauggagcccgagcacgcccugcuggccaaguccaucuucaagcucaccuaccagaacaaggucgugcgggugcagcgcccggccaagaacgggaccgucauggacgugaucagccgccgggaccagcgcggcuccggccaggugggcaccuacggccugaacacguucaccaacauggaggcccagcugauccggcagauggagagcgaggggaucuucucccccagcgagcucgagacccccaaccuggcgggccgcguccuggacuggcucgagaagcacgggguggagcggcugaagcgcauggccaucuccggcgacgacugcguggucaagcccaucgacgaccgguucgccaccgcccugacggcccucaacgacauggggaaggugcgcaaggacgugccgcagugggagcccagcaagggcuggaacgacuggcagcagguccccuucugcagccaccacuuccaccagcugaucaugaaggacggccgggagaucguggugcccugccgcaaccaggacgagcuggucgggcgggcgcgcgugucccagggcgccggguggagccuccgggagaccgccugccugggcaaguccuacgcccagauguggcagcugauguacuuccaccgccgggaccuccgccuggcggccaacgccaucugcagcgccgugccggucgacugggugcccaccucccggaccacguggagcauccacgcccaccaccaguggaugaccaccgaggacaugcuguccguguggaaccgcgucuggaucgaggagaaccccuggauggaggacaagacccacaucagcuccuggggcgacgugcccuaccucggcaagcgggaggaccaguggugcggcagccugaucgggcugacggcgcgcgccaccugggccaccaacauccagguggccaucaaccagguccgccggcucaucggcaacgagaacuaccuggacuacaugaccuccaugaagcgcuucaagaacgagagcgacccggagggggcccugugguga

SEQ ID NO: 8420 - RNA, 9879 nt, Artificial Sequence
  derived and/or modified CDS sequence (opt1) from DENV-1__FJ410251__SS-prME
agcgugaccaugcugcucaugcugaugcccaccgcccuggccuuccaccucaccacccggggcggggagccccacaugaucgugaccaagcaggagcggggcaagagccugcuguucaagaccagcgccggggugaacaugugcacccucaucgccauggaccugggcgagcugugcgaggacaccaugaccuacaagugcccccgcaucaccgaggccgagcccgacgacguggacugcuggugcaacgccaccgacaccugggugaccuacgggaccugcagccagacgggcgagcaccggcgcgacaagcggagcguggcccucgcgccccacgugggccuggggcuggagacccgcaccgagaccuggauguccagcgagggcgccuggaagcagauccagcgggucgagacgugggcccuccgccaccccggguucaccgugaucgcccuguuccuggcgcacgccaucggcaccuccaucacccagaaggggaucaucuucauccuccugaugcuggugacgcccagcauggccaugcggugcgucggcaucggcucccgcgacuucguggaggggcucagcggcgccaccuggguggacgucgugcuggagcacggguccugcgugaccaccauggccaaggacaagcccacgcuggacaucgagcuccugaagaccgaggucaccaaccccgcggugcugcggaagcucugcaucgaggccaagaucagcaacaccacgaccgacucccgcugccccacccagggcgaggccacccugauggaggagcaggacgccaacuucgugugccggcgcacguucgucgaccggggcugggggaacggcugcgggcuguucggcaaggggagccucaucacgugcgccaaguucaagugcgugaccaagcuggagggcaagaucgugcaguacgagaaccugaaguacuccgucaucgugaccgugcacacgggcgaccagcaccaggucgggaacgagagcaccgagcacggcaccaccgcgaccaucacgccccaggcccccaccuccgagauccagcucaccgacuacggggcccugacccuggacugcagcccccgcacgggccucgacuucaacgagauggugcugcugaccaugaaggagaaguccuggcucguccacaagcagugguuccuggaccugccgcuccccuggaccagcggggccagcaccucccaggagacguggaaccggcaggaccugcuggugaccuucaagaccgcccacgcgaagaagcaggagguggucgugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgugaugugcaccggguccuucaagcucgagaaggaggucgcggagacgcagcacggcaccgugcuggugcagaucaaguacgagggcaccgacgcccccugcaagauccccuucagcacccaggacgagaagggggucacgcagaacggccggcugaucaccgccaacccgaucgugaccgacaaggagaagcccgugaacaucgaggccgagccgcccuucggggaguccuacaucgucaucggcgcgggcgggaaggcccugaagcucagcugguucaagaagggcuccagcaucgggaagauguucgaggccaccgcccgcggcgcccggcgcauggcgauccugggggacacggccugggacuucggcuccgugggcgggguguucaccagcgucggcaagcuggugcaccagaucuucgggaccgccuacggcguccuguucuccggggucagcuggaccaugaagaucggcaucggcgugcugcugacguggcucgggcugaacucccgcagcaccucccugagcaugaccugcaucgccgugggccucgucacccuguaccugggggugauggugcaggccgacuccggcugcgucaucaacuggaaggggcgggagcucaagugcggcagcggcaucuucgugacgaacgaggugcacaccuggaccgagcaguacaaguuccaggcggacagcccgaagcgccuguccgccgccaucgggaaggccugggaggagggcgucugcgggauccggagcgccacccgccuggagaacaucauguggaagcagaucuccaacgagcucaaccacauccugcuggagaacgacaugaaguucaccgugguggucggcgacgugguggggauccucgcgcagggcaagaagaugauccggccccagcccauggagcacaaguacagcuggaaguccuggggcaaggccaagaucaucggggccgacguccagaacacgaccuucaucaucgacggccccaacaccccggagugccccgacgaccagcgcgccuggaacaucugggagguggaggacuacggguucggcaucuucaccacgaacaucuggcugaagcugcgggacagcuacacccaggugugcgaccaccgccucauguccgcggccaucaaggacagcaaggccguccacgccgacaugggcuacuggaucgaguccgagaagaacgagaccuggaagcuggcccgggcgagcuucaucgaggugaagaccugcaucuggcccaagucccacacgcuguggagcaacggggugcucgaguccgagaugaucauccccaagaucuacggcgggccgaucagccagcacaacuaccgccccggcuacuucacccagaccgccgggcccuggcaccugggcaagcuggagcucgacuucgaccugugcgagggcaccacggucgugguggacgagcacugcgggaaccggggcccgucccugcgcaccaccaccgucacggggaagaucauccacgaguggugcugccggagcugcacccugccgccccuccgcuucaagggcgaggacgggugcugguacggcauggagauccggcccgugaaggagaaggaggagaaccuggugaaguccauggucagcgccggcagcggggagguggacuccuucagccucggccugcugugcaucuccaucaugaucgaggaggugaugcgcagccgguggucccgcaagaugcucaugaccgggacccuggccgucuuccugcuccugaucaugggccagcugacguggaacgaccucauccggcugugcaucauggugggggccaacgcgagcgaccgcaugggcaugggcaccaccuaccuggcccucauggccaccuucaagaugcgcccgauguucgccguggggcugcuguuccggcgccucacgucccgggagguccugcugcucaccaucgggcugagccugguggccuccgucgagcuccccaacagccuggaggagcugggggacggccucgcgaugggcaucaugauccugaagcugcucaccgacuuccagucccaccagcugugggccacccugcucagccugacguucaucaagaccacccugucccuccacuacgccuggaagaccauggccauggugcugagcaucgugucccuguucccccucugccugagcacgaccucccagaagaccaccuggcugcccguccuccuggggagccugggcugcaagccgcucacgauguuccugaucaccgagaacaagaucugggggcgcaaguccuggccccugaacgagggcaucauggcgguggggguggucagcauccuccugagcucccugcucaagaacgacgugccccuggccggcccccugaucgccggcgggaugcucaucgccugcuacgugaucagcggcuccagcgccgaccugucccuggagaaggcggccgaggucagcugggaggaggaggccgagcacuccggggccagccacaacauccucguggaggugcaggacgacggcaccaugaagaucaaggacgaggagcgggacgacacccugaccauccugcucaaggccacgcugcuggcggucuccgggguguacccgcucagcauccccgccacccuguucgugugguacuucuggcagaagaagaagcagcgcuccggcguccugugggacacccccagcccgcccgagguggagcgggccgugcuggacgacggcaucuaccgcaucaugcagcgggggcuccugggccgcucccaggucggggugggcguguuccaggagaacgucuuccacaccauguggcacgugacgcgcggggccgugcugauguaccagggcaagcgccucgagcccagcugggccuccgucaagaaggaccugaucagcuacggcgggggcuggcggcugcagggguccuggaacaccggcgaggagguccaggugaucgcggucgagcccgggaagaaccccaagaacgugcagaccgcccccggcaccuucaagacgcccgagggcgaggugggggccaucgcccucgacuucaagcccggcaccagcgggucccccaucgucaaccgcgagggcaagaucgugggccuguacgggaacggcguggucaccaccagcgggacguacgugagcgccaucgcgcaggccaaggccucccaggagggcccgcugcccgagaucgaggacgagguguuccggaagcgcaaccucaccaucauggaccugcaccccgggagcggcaagacccggcgcuaccugccggccaucguccgggaggcgaucaagcgcaagcuccggacccugauccuggcccccacgcgcgugguggccuccgagauggccgaggcccucaagggcaugcccauccgcuaccagaccaccgcggucaagagcgagcacaccgggaaggagaucguggaccugaugugccacgccacguucaccaugcggcugcucucccccgugcgcgucccgaacuacaacaugaucaucauggacgaggcccacuucaccgaccccagcuccaucgccgcccggggcuacaucagcacccgcguggggaugggcgaggcggccgccaucuucaugacggccacgccgcccggguccguggaggccuucccgcagagcaacgcggucauccaggacgaggagcgggacauccccgagcgcuccuggaacagcggcuacgaguggaucaccgacuuccccggcaagaccgugugguucgugcccuccaucaagagcgggaacgacaucgccaacugccugcggaagaacggcaagcgcgucauccagcugucccggaagacguucgacaccgaguaccagaagaccaagaacaacgacugggacuacguggugaccacggacaucagcgagaugggggccaacuuccgcgccgaccgggucaucgacccgcgccggugccucaagcccgugauccugaaggacggccccgagcgcgucauccuggcggggcccaugccggugaccguggccuccgccgcccagcggcgcggccggaucggccgcaaccacaacaaggagggggaccaguacaucuacaugggccagccccucaacaacgacgaggaccacgcccacuggaccgaggcgaagaugcugcuggacaacaucaacacccccgaggggaucauccccgcccucuucgagccggagcgggagaaguccgccgccaucgacggcgaguaccgccugcgcggggaggcccggaagacguucgucgagcugaugcgccggggcgaccuccccguguggcuguccuacaagguggcgagcgagggcuuccaguacagcgaccgccgguggugcuucgacggggagcgcaacaaccagguccuggaggagaacauggacguggagaucuggaccaaggagggcgagcggaagaagcuccgcccccgguggcuggacgcccgcaccuacuccgacccccuggcccuccgggaguucaaggaguucgccgccgggcgccggagcguguccggcgaccugauccuggagaucggcaagcucccgcagcaccugacccagcgcgcgcagaacgcccuggacaaccucgucaugcugcacaacagcgagcagggcgggcgggccuaccgccacgccauggaggagcugcccgacacgaucgagacccucaugcugcuggcgcucaucgccgugcugaccgggggcgugacccuguucuuccucuccgggcggggccugggcaagaccagcaucgggcugcucugcgucauggccuccagcgugcugcuguggauggccuccguggagccccacuggaucgccgcgagcaucauccucgaguucuuccugaugguccugcucauccccgagccggaccgccagcggacgccccaggacaaccagcuggccuacguggugaucggccuccucuucaugauccugaccgucgccgccaacgagauggggcugcucgagaccaccaagaaggaccugggcaucgggcacguggccguggagaaccaccaccacgcgacgaugcuggacgucgaccuccaccccgccuccgccuggacccuguacgccguggccaccaccaucaucacgccgaugaugcgccacaccaucgagaacaccaccgcgaacaucagccugacggccaucgccaaccaggccgccauccucaugggccuggacaagggcuggcccaucuccaagauggacaucggggugccccugcucgcgcugggcugcuacagccaggucaacccccugacccucaccgccgccgugcugaugcugguggcccacuacgcgaucaucgggccgggccuccaggccaaggccacccgggaggcccagaagcgcacggccgcggggaucaugaagaaccccaccgucgacggcaucguggccaucgaccuggaccccguggucuacgacgccaaguucgagaagcagcugggccagaucaugcuccugauccugugcaccucccagauccuccugaugcgcaccacgugggcccugugcgagagcaucacccucgccaccgggccccugaccacgcugugggagggcuccccggggaaguucuggaacaccaccaucgcggugagcauggccaacaucuuccggggcuccuaccucgccggcgccgggcuggccuucagccugaugaagucccucggcgggggccgccgggggaccggcgcgcagggcgagacgcugggggagaaguggaagcgccagcugaaccagcucuccaagagcgaguucaacaucuacaagcgguccggcaucauggagguggaccgcagcgaggccaaggaggggcugaagcggggcgagaccacccgccacgccgucucccgggggaccgccaagcugcgcugguucguggagcggaaccuggugaagcccgagggcaaggucaucgaccucggcugcgggcgcggcggguggagcuacuacugcgcgggccugaagaaggugacggaggugaagggguacaccaagggcggccccgggcacgaggagcccaucccgauggccaccuacggcuggaaccuggucaagcuccacuccgggaaggacguguucuucacgccgcccgagaagugcgacacgcugcugugcgacaucggcgagagcucccccaacccgaccaucgaggaggggcggacccuccgcgugcugaagauggucgagcccuggcugcggggcaaccaguucugcaucaagauccucaaccccuacaugcccagcgugguggagacccuggagcagaugcagcgcaagcacggcgggaugcugguccggaacccgcucucccgcaacagcacccacgagauguacuggguguccugcggcacggggaacaucgugagcgccgucaacaugaccucccggaugcugcugaaccgcuucaccauggcccaccgcaagcccaccuacgagcgggacguggaccucggcgccggcacgcgccacguggcggucgagcccgagguggccaaccuggacaucaucgggcagcggaucgagaacaucaagcacgagcacaagagcaccuggcacuacgacgaggacaaccccuacaagaccugggccuaccacggcuccuacgaggucaagccgagcggguccgccagcagcauggugaacggcguggucaagcugcucaccaagcccugggacgugauccccauggugacgcagaucgccaugaccgacaccacccccuucgggcagcagcgcgucuucaaggagaagguggacacgcggaccccgaaggcgaagcgcggcaccgcccagaucauggaggugaccgcccgguggcuguggggcuuccugucccgcaacaagaagccccggaucugcacgcgcgaggaguucacccggaagguccgcagcaacgccgccaucggggcgguguucguggacgagaaccaguggaacuccgccaaggaggccgucgaggacgagcgguucugggaccucgugcagaaggagcgcgagcugcacaagcagggcaagugcgcgaccugcguguacaacaugauggggaagcgggagaagaagcugggcgaguucgggaaggcgaagggcagccgcgccaucugguacauguggcucggcgcccgguuccuggaguucgaggcccugggguucaugaacgaggaccacugguucucccgcgagaacagccucuccggcgucgagggggagggccugcacaagcugggguacauccuccgggacaucagcaagauccccggcggcaacauguacgccgacgacaccgcggggugggacacgcgcaucaccgaggacgaccugcagaacgaggccaagaucaccgacaucauggagccggagcacgcccugcucgccaccuccaucuucaagcugacguaccagaacaagguggugcggguccagcgccccgccaagaacggcaccgugauggacgugaucagccgccgggaccagcgcggguccggccaggucggcaccuacgggcugaacaccuucacgaacauggaggcgcagcucauccggcagauggagagcgagggcaucuuccugcccuccgagcuggagacccccaaccucgccgagcgcgugcuggacuggcuggagaaguacgggguggagcggcucaagcgcauggccaucagcggcgacgacugcgucgugaagccgaucgacgaccgguucgccaccgcccugaccgcgcugaacgacauggggaaggugcgcaaggacaucccccagugggagcccuccaagggcuggaacgacuggcagcagguccccuucugcagccaccacuuccaccagcucaucaugaaggacggccgggagaucguggugccgugccgcaaccaggacgagcuggucgggcgggcccgcgugucccagggcgccggguggagccugcgggagacggccugccucggcaagagcuacgcccagauguggcagcugauguacuuccaccgccgggaccugcgccucgcggccaacgccaucugcuccgccgugcccgucgacugggugcccaccagccggaccaccugguccauccacgcgcaccaccaguggaugacgaccgaggacaugcugagcguguggaaccgcgucuggaucgaggagaaccccuggauggaggacaagacccacguguccagcuggggcgacgugccguaccugggcaagcgggaggaccaguggugcggcucccucaucgggcugaccgcccgcgccaccugggccagcaacauccaggucgccaucaaccaggugcgccggcugaucggcaacgagaacuaccucgacuacaugacguccaugaagcgcuucaagaacgagggggaccccgagggcgcgcugugguga

SEQ ID NO: 8421 - RNA, 9879 nt, Artificial Sequence
  derived and/or modified CDS sequence (opt1) from DENV-1__FJ410252__SS-prME
agcgugaccaugcugcugaugcugaugcccaccgcccuggccuuccaccucacgacccggggcggggagccccacaugaucguguccaagcaggagcggggcaagagccugcuguucaagaccuccgccggggugaacaugugcacccucaucgccauggaccugggcgaguucugcgaggacaccaugaccuacaagugcccccgcaucaccgaggccgagcccgacgacguggacugcuggugcaacgccaccgacacgugggucaccuacgggaccugcagccagaccggcgagcaccggcgggacaagcgguccguggcccuggcgccccacgugggccucgggcuggagacgcgcaccgagaccuggaugagcuccgagggcgccuggaagcagauccagcgggucgagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugcccgacccagggcgaggccacccucguggaggagcaggacgccaacuucgucugccggcgcacccugguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacaccggcgaccagcaccagguggggaacgaguccacggagcacggcaccaccgcgaccaucacgccccaggcccccagcacggagauccagcucaccgacuacggggcccugacccuggacugcagcccccggaccggccucgacuucaacgagaugguccugcugacgaugaaggagaaguccuggcucgugcacaagcagugguuccuggaccugccgcuccccuggaccagcggggccuccaccagccaggagaccuggaaccggcaggaccugcuggugacguucaagaccgcccacgcgaagaagcaggaggucguggugcucggcucccaggagggcgccaugcacaccgcccugaccggggccacggagauccagaccagcggcaccaccacgaucuucgccgggcaccugaagugccgccucaagauggacaagcugacccugaagggcauguccuacgucaugugcaccgggagcuucaagcucgagaaggagguggcggagacccagcacggcacggugcugguccagaucaaguacgagggcaccgacgcccccugcaagauccccuuccugacccaggacgagaagggggugacccagaacggccggcugaucacggccaacccgaucgugaccgacaaggagaagcccgucaacaucgaggccgagccgcccuucggggaguccuacaucgugaucggcgcgggcgagaaggcccucaagcugagcugguucaagaagggguccagcaucggcaagauguucgaggccaccgcccgcggggcccggcgcauggcgauccugggcgacaccgccugggacuucggguccaucggcggcguguucacgagcgucgggaagcucgugcaccagaucuucggcaccgccuacggggugcuguucuccggcgucagcuggaccaugaagaucgggaucggcgugcugcucaccuggcugggccugaacucccgcagcacgucccucagcaugaccugcaucgccguggggcuggucacccuguaccucggcgugauggugcaggccgacuccgggugcgucaucaacuggaagggccgggagcugaagugcgggagcggcaucuucgugaccaacgaggugcacacguggaccgagcaguacaaguuccaggcggacagcccgaagcgccuguccgccgccaucggcaaggccugggaggagggggucugcggcauccggagcgccacccgccucgagaacaucauguggaagcagaucuccaacgagcugaaccacauccugcucgagaacgacaugaaguucaccgugguggucggggacguggcgggcauccuggcccaggggaagaagaugauccggccccagcccauggaguacaaguacagcuggaaguccuggggcaaggccaagaucaucggcgccgacgugcagaacaccacguucaucaucgacgggcccaacaccccggagugccccgacgaccagcgcgcguggaacaucugggaggucgaggacuacggcuucgggaucuucaccaccaacaucuggcugaagcuccgggacagcuacacccaggugugcgacuaccgccugauguccgccgccaucaaggacagcaaggccgugcacgccgacaugggcuacuggaucgaguccgagaagaacgagaccuggaagcuggcgcgggccagcuucaucgaggucaagaccugcaucuggcccaagucccacacccucuggagcaacggcgugcuggaguccgagaugaucauccccaagaucuacgggggcccgaucagccagcacaacuaccgccccggguacuucacgcagaccgccggccccuggcaccuggggaagcucgagcuggacuucgaccugugcgagggcaccaccguggucguggacgagcacugcggcaaccgggggccgucccuccgcacgaccaccgugaccggcaagaucauccacgaguggugcugccggagcugcacgcugccgccccugcgcuucaagggggaggacggcugcugguacgggauggagauccggcccgucaaggagaaggaggagaaccucgugaaguccauggugagcgccggcagcggcgaggucgacuccuucagccuggggcugcucugcaucuccaucaugaucgaggaggugaugcgcagccgguggucccgcaagaugcugaugaccggcacccuggccguguucuuccuccugaucauggggcagcugaccuggaacgaccucauccggcugugcaucauggucggcgcgaacgccagcgaccgcauggggaugggcacgaccuaccuggcccucauggccaccuucaagaugcgcccgauguucgccgugggccugcuguuccggcgccucaccucccgggaggugcugcugcucacgaucgggcugagccuggucgcguccguggagcuccccaacagccuggaggagcugggcgacgggcucgccaugggcaucaugauccugaagcugcucaccgacuuccagucccaccagcugugggccacccugcucagccugaccuucaucaagacgaccuucucccugcacuacgccuggaagaccauggcgaugguccucagcaucgugucccuguucccccugugccucagcaccacgucccagaagaccaccuggcugcccgugcugcucggcagccuggggugcaagccgcugaccauguuccucaucgccgagaacaagaucuggggccgcaaguccuggccccugaacgaggggaucauggccgucggcaucgugagcauccugcucagcucccugcugaagaacgacgugccccucgccgggccccugaucgccggcggcaugcugaucgcgugcuacgucaucagcggguccagcgccgaccucucccuggagaaggccgccgaggugagcugggaggaggaggccgagcacuccggcgcgagccacaacauccugguggagguccaggacgacgggacgaugaagaucaaggacgaggagcgggacgacacccucaccauccugcugaaggccacccuccuggccguguccggcguguacccgcugagcauccccgccacccucuucgucugguacuucuggcagaagaagaagcagcgcuccggggugcugugggacacgcccagcccgcccgagguggagcgggccguccuggacgacggcaucuaccgcaucaugcagcggggccugcucgggcgcucccaggugggcgugggggucuuccaggagaacguguuccacaccauguggcacgugacccggggcgcgguccugauguaccaggggaagcgccuggagcccagcugggccuccgugaagaaggaccucaucagcuacggcggcggguggcggcugcagggcuccuggaacaccggggaggaggugcaggucaucgccguggagcccggcaagaaccccaagaacgugcagacggcccccgggaccuucaagaccagcgagggcgaggucggcgccaucgcgcuggacuucaagcccgggaccuccggcagccccaucgugaaccgcgaggggaagaucgugggccucuacggcaacggggucgugacgaccagcggcaccuacguguccgccaucgcccaggccaaggcgagccaggaggggccccugccggagaucgaggacgaggucuuccggaagcgcaaccugaccaucauggaccuccaccccggcuccgggaagacgcggcgcuaccugcccgccaucgugcgggaggccaucaagcgcaagcugcggacccucauccuggccccgacccgcguggucgccagcgagauggcggaggcccugaagggcaugcccauccgcuaccagaccacggccgugaaguccgagcacaccggcaaggagaucguggaccucaugugccacgccaccuucaccaugcggcugcugagccccguccgcgugcccaacuacaacaugaucaucauggacgaggcccacuucacggacccguccagcaucgcggcccggggguacaucuccacccgcgugggcaugggggaggccgccgccaucuucaugaccgcgacgccgcccggcagcgucgaggccuucccccaguccaacgccgugauccaggacgaggagcgggacaucccggagcgcagcuggaacuccggguacgaguggaucacggacuuccccggcaagaccgugugguucguccccagcaucaaguccggcaacgacaucgccaacugccuccggaagaacgggaagcgcgugauccagcugagccggaagaccuucgacaccgaguaccagaagacgaagaacaacgacugggacuacguggucaccaccgacaucuccgagaugggcgcgaacuuccgcgccgaccgggugaucgacccccgccggugccugaagccggugauccucaaggacgggcccgagcgcgucauccuggccggccccaugcccgugaccgucgccagcgccgcgcagcggcgcgggcggaucggccgcaaccacaacaaggagggcgaccaguacaucuacauggggcagccgcugaacaacgacgaggaccacgcccacuggacggaggccaagaugcuccuggacaacaucaacacccccgagggcaucauccccgcccuguucgagcccgagcgggagaaguccgccgcgaucgacggggaguaccgccuccgcggcgaggcccggaagaccuucguggagcugaugcgccgcggggaccugccgguguggcucagcuacaaggucgccagcgagggcuuccaguacuccgaccgccgguggugcuucgacggcgagcgcaacaaccaggugcuggaggagaacauggacguggagaucuggaccaaggagggggagcggaagaagcugcgcccccgguggcucgacgcccgcacguacagcgacccccuggcccugcgggaguucaaggaguucgcggccggccgccgguccgucagcggggaccucauccuggagaucggcaagcugccccagcaccucacccagcgcgcccagaacgcccuggacaaccuggugaugcuccacaacuccgagcagggcgggcgggcguaccgccacgccauggaggagcugccggacaccaucgagacccugaugcuccuggcccugaucgccgugcucacgggcggggucacccuguucuuccugagcggccgggggcucggcaagaccuccaucggccugcugugcgugauggccagcuccgugcuccuguggauggcgagcgucgagccccacuggaucgccgccuccaucauccuggaguucuuccucauggugcugcugauccccgagcccgaccgccagcggaccccgcaggacaaccagcucgccuacguggucaucgggcugcuguucaugauccucaccguggccgcgaacgagaugggccugcuggagacgaccaagaaggaccucgggaucggccacguggccgucgagaaccaccaccacgccgccaugcuggacguggaccugcaccccgccagcgcguggacccucuacgccguggccaccacgaucaucacccccaugaugcgccacaccaucgagaacaccacggccaacaucucccugaccgccaucgcgaaccaggccgccauccugauggggcucgacaagggcuggccgaucagcaagauggacaucggcgucccccugcuggcccucgggugcuacucccaggugaacccccugacccugaccgcggccgugcucaugcuggucgcccacuacgccaucaucggccccgggcugcaggccaaggcgacgcgggaggcccagaagcgcaccgccgccggcaucaugaagaacccgaccguggacgggaucguggccaucgaccucgaccccgucguguacgacgcgaaguucgagaagcagcugggccagaucaugcugcucauccugugcaccagccagauccugcucaugcgcacgaccugggcccugugcgaguccaucacccuggccaccggcccccucacgacccugugggaggggagccccggcaaguucuggaacaccaccaucgccguguccauggccaacaucuuccgggggagcuaccuggcgggcgccggccucgccuucagccugaugaagucccucgggggcgggcgccgggggacgggggcccagggcgagacccucggcgagaaguggaagcgccagcugaaccagcugagcaaguccgaguucaacaccuacaagcggagcgggaucauggaggucgaccgcuccgaggcgaaggagggccucaagcgcggggagaccacgaagcacgccgugagccgcggcaccgccaagcugcggugguucguggagcgcaaccuggucaagccggaggggaaggugaucgaccugggcugcggccgcggcgggugguccuacuacugcgccgggcucaagaaggugaccgaggucaagggguacaccaagggcgggcccggccacgaggagcccauccccauggccacguacggguggaaccuggugaagcugcacagcggcaaggacguguucuucaucccgcccgagaagugcgacacccuccugugcgacaucggggaguccagccccaaccccaccaucgaggagggccgcacccugcggguccucaagaugguggagccguggcugcgcgggaaccaguucugcaucaagauccugaaccccuacaugcccuccguggucgagacgcucgagcagaugcagcggaagcacggcggcaugcuggugcgcaacccccugagccggaacuccacccacgagauguacugggugagcugcgggaccggcaacaucgucuccgcggugaacaugaccagccgcaugcuccugaaccgguucaccauggcccaccgcaagccgacguacgagcgcgacguggaccugggggccggcacccggcacgucgccguggagcccgagguggccaaccucgacaucaucggccagcgcaucgagaacaucaagcacgagcacaaguccaccuggcacuacgacgaggacaaccccuacaagaccugggcguaccacgggagcuacgaggucaagcccuccggcagcgccagcuccauggugaacggggucgugaagcugcugacgaagccgugggacgugauccccauggucacccagaucgccaugaccgacaccacgcccuucggccagcagcggguguucaaggagaagguggacacccgcacccccaaggccaagcgggggaccgcccagaucauggaggucacggcgaaguggcucuggggcuuccugagccgcaacaagaagccgcggaucugcacccgcgaggaguucacccggaaggugcgcuccaacgccgccaucggcgccguguucgucgacgagaaccaguggaacagcgcgaaggaggccguggaggacgagcgguucugggaccuggugcaccgcgagcgggagcuccacaagcaggggaagugcgcgaccugcgucuacaacaugaugggcaagcgcgagaagaagcugggggaguucggcaaggccaaggggucccgggccaucugguacauguggcugggcgcgcgcuuccucgaguucgaggcccugggcuucaugaacgaggaccacugguucagccgggagaacucccugagcgggguggagggcgaggggcuccacaagcugggcuacauccugcgcgacaucuccaagauccccgggggcaacauguacgccgacgacacggccggcugggacacccggaucaccgaggacgaccuccagaacgaggccaagaucaccgacaucauggagcccgagcacgcgcugcuggccaagagcaucuucaagcucacguaccagaacaaggugguccgcgugcagcggccggccaagaacgggaccgugauggacgucaucucccgccgcgaccagcggggcagcggccaggugggcaccuacggccugaacaccuucacgaacauggaggcccagcugauccgccagauggaguccgaggggaucuucagccccuccgagcucgagacccccaaccuggccggccgggugcuggacuggcucgagaagcacggggucgagcgccugaagcggauggcgaucagcggcgacgacugcguggugaagcccaucgacgaccgcuucgccaccgcccugaccgcccucaacgacauggggaagguccggaaggacaucccgcagugggagcccuccaagggcuggaacgacuggcagcagguccccuucugcagccaccacuuccaccagcugaucaugaaggacggccgcgagaucgugguccccugccggaaccaggacgagcugguggggcgcgcccgggugagccagggcgcgggguggucccuccgcgagacggccugccugggcaagagcuacgcccagauguggcagcugauguacuuccaccggcgcgaccuccggcuggccgcgaacgccaucugcuccgccgucccgguggacugggugcccaccagccgcaccaccugguccauccacgcccaccaccaguggaugacgaccgaggacaugcugagcgucuggaaccggguguggaucgaggagaaccccuggauggaggacaagacccacaucuccagcuggggcgacgugcccuaccucggcaagcgcgaggaccaguggugcggcucccugaucgggcugaccgcccgggcgacgugggccaccaacauccaggucgccaucaaccaggugcgccgccucaucggcaacgagaacuaccuggacuacaugaccagcaugaagcgguucaagaacgaguccgacccggagggggcccugugguga

SEQ ID NO: 8422 - RNA, 9879 nt, Artificial Sequence
  derived and/or modified CDS sequence (opt1) from DENV-1__FJ461331__SS-prME
agcgugaccaugcugcucaugcugaugcccaccgcccuggccuuccaccucaccacccgcggcggggagccccacaugaucgugagcaagcaggagcggggcaagagccugcuguucaagaccuccgccggggugaacaugugcacccucaucgccauggaccugggcgagcugugcgaggacacgaugaccuacaagugcccccgcaucaccgaggccgagcccgacgacguggacugcuggugcaacgccaccgacacgugggugaccuacgggaccugcagccagaccggcgagcaccggcgcgacaagcgguccguggcccucgcgccccacgugggccuggggcuggagacgcgcaccgagaccuggaugagcuccgagggcgccuggaagcagauccagcgggucgagaccugggcccuccgccaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcggugcugcggaagcucugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacaccggcgaccagcaccagguggggaacgaguccacggagcacggcaccaccgcgaccaucacgccccaggcccccacgaccgagauccagcucaccgacuacggggcccugacccuggacugcagcccccgcacgggccucgacuucaacgagaugguccugcugaccaugaaggagaaguccuggcucgugcacaagcagugguuccuggaccugccccuccccuggaccagcggggccagcaccucccaggagacguggaaccggcaggaccugcuggugaccuucaagaccgcccacgcgaagaagcaggaggucguggugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgucaugugcaccggguccuucaagcucgagaaggagguggcggagacgcagcacggcaccgugcugguccagaucaaguacgagggcaccgacgcccccugcaagauccccuucagcacccaggacgagaagggggugacgcagaacggccggcugaucaccgccaacccgaucgugaccgacaaggagaagcccgucaacaucgaggccgagccgcccuucggggaguccuacaucgugaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcgucgggaagcugauccaccagaucuucggcaccgccuacgggguccucuucuccggcgugagcuggaccaugaagaucgggaucggcguccugcugacguggcucggccugaacucccgcagcaccucccugagcaugaccugcaucgccguggggcucgugacccuguaccugggcgucauggugcaggccgacuccgggugcgugaucaacuggaagggccgggagcucaagugcgggagcggcaucuucgucacgaacgaggugcacaccuggaccgagcaguacaaguuccaggcggacagcccgaagcgccuguccgccgccaucggcaaggccugggaggagggggugugcggcauccggagcgccacccgccuggagaacaucauguggaagcagaucuccaacgagcucaaccacauccugcuggagaacgacaugaagcucaccgucguggugggggacgucgcgggcauccuggggcagggcaagaagaugauccggccccagcccauggaguacaaguacagcuggaaguccuggggcaaggccaagaucaucggggccgacgcccagaacacgaccuucaucaucgacggccccaacaccccggagugccccgacgaccagcgcgcguggaacaucugggagguggaggacuacggguucggcaucuucaccacgaacaucuggcugaagcuccgggacagcuacacccaggugugcgaccaccgccugauguccgccgccaucaaggacagcaaggccguccacgccgacaugggcuacuggaucgaguccgagaagaacgagaccuggaagcuggcgcgggccagcuucaucgaggugaagaccugcaucuggcccaagucccacacgcucuggagcaacggggugcuggaguccgagaugaucauccccaagaucuacggcgggccgaucagccagcacaacuaccgccccggcuacuucacccagaccgccgggcccuggcaccugggcaagcucgagcuggacuucgaccugugcgagggcaccacggucgugguggacgagcacugcgggaaccggggcccgucccuccgcaccaccaccgucacggggaagaucauccacgaguggugcugccggagcugcacccugccgccccugcgcuuccggggcgaggacgggugcugguacggcauggagauccgccccgugaaggagaaggaggagaaccucgugaaguccauggucagcgccggcagcggggagguggacuccuucagccugggccugcucugcaucuccaucaugaucgaggaggugaugcggagccgcuggucccggaagaugcugaugaccgggacccuggccgucuucuuccuccugaucaugggccagcugacguggaacgaccucauccgccugugcaucauggugggggcgaacgccuucgaccgcaugggcaugggcaccaccuaccuggcccucauggccaccuucaagaugcggccgauguucgccguggggcugcuguuccgccggcucacgagccgcgagguccugcugcucaccaucggccugucccugguggcgagcguggagcuccccaacucccuggaggagcugggggacggccucgccaugggcaucaugauccugaagcugcucaccgacuuccagagccaccagcugugggccacccugcucucccugacguucaucaagaccaccuucagccugcacuacgccuggaagaccauggcgaugguccucuccaucgugagccuguucccccugugccucuccacgaccagccagaagaccaccuggcugcccguccugcucgggucccugggcugcaagccgcugacgauguuccucaucgccgagaacaagaucugggggcggaaguccuggccccugaacgagggcaucauggccguggggaucguguccauccugcucagcagccugcugaagaacgacgucccccucgccggcccccugaucgccggcgggaugcugaucgcgugcuacgugaucuccggcagcuccgccgaccucagccuggagaaggccgccgagguguccugggaggaggaggccgagcacagcggggcgucccacaacauccuggucgaggugcaggacgacggcaccaugaagaucaaggacgaggagcgcgacgacacccucaccauccugcugaaggccacccuccuggccgugagcggggucuacccgcuguccauccccgccacccucuucgugugguacuucuggcagaagaagaagcagcggagcggcgugcugugggacacccccagcccgcccgucguggagcgcgccgugcuggacgacggcaucuaccggaucaugcagcgcgggcugcucggccggagccaggucggggugggcguguuccaggagaacgucuuccacaccauguggcacgugacccgcggggcggugcugauguaccagggcaagcggcuggagcccuccugggccagcgucaagaaggaccucaucuccuacggcgggggcuggcgccugcgggggagcuggaacacgggcgaggagguccaggugaucgccgucgagcccgggaagaaccccaagaacgugcagaccgcccccggcaccuucaagacccccgagggcgaggugggggccaucgcgcuggacuucaagcccggcacguccgggagccccaucgucaaccgcgagggcaagaucgugggccucuacgggaacggcguggucaccaccuccgggaccuacgugagcgccaucgcccaggccaaggcgagccaggagggcccgcugcccgagaucgaggacgagguguuccggaagcgcaaccugacgaucauggaccuccaccccggguccggcaagacccggcgcuaccugccggccaucguccgggaggccaucaagcgcaagcugcgcacccucauccuggcccccacccgggugguggccagcgagauggcggaggcccugaagggcaugcccauccgcuaccagacgaccgccgucaaguccgagcacaccgggaaggagaucguggaccucaugugccacgccaccuucacgaugcggcugcugagccccgugcgcgucccgaacuacaacaugaucaucauggacgaggcccacuucaccgaccccuccagcaucgcggcccggggcuacaucuccacccgcguggggaugggcgaggccgccgccaucuucaugaccgcgacgccgcccgggagcguggaggccuucccgcaguccaacgccgucauccaggacgaggagcgggacauccccgagcgcagcuggaacuccggccacgaguggaucaccgacuuccccggcaagaccgugugguucgugcccagcaucaaguccgggaacgacaucgccaacugccuccggaagaacggcaagcgcgucauccagcugagccggaagaccuucgacacggaguaccagaagaccaagaacaacgacugggacuacguggugaccaccgacaucuccgagaugggggcgaacuuccgcgccgaccgggucaucgacccgcgccggugccugaagcccgugauccucaaggacggccccgagcgcgugauccuggccgggcccaugccggucacgguggccagcgccgcgcagcggcgcggccggaucggccgcaaccacaacaaggagggggaccaguacaucuacaugggccagccccugaacaacgacgaggaccacgcccacuggaccgaggccaagaugcuccuggacaacaucaacacccccgaggggaucauccccgcccuguucgagccggagcgcgagaaguccgccgcggucgacggcgaguaccggcuccgcggggaggcccggaagaccuucguggagcugaugcgccggggcgaccugcccguguggcucagcuacaaggucgccuccgagggcuuccaguacagcgaccgccgguggugcuucgacggggagcgcaacaaccaggugcuggaggagaacauggacguggagaucuggacgaaggagggcgagcggaagaagcugcgcccccgguggcucgacgcccgcaccuacagcgacccccuggcccugcgggaguucaaggaguucgcggccgggcgccgguccgucagcggcgaccucauccuggagaucggcaagcugccgcagcaccucacccagcgcgcccagaacgcccuggacaaccuggugaugcuccacaacuccgagcagggcgggcgggcguaccgccacgccauggaggagcugcccgacaccaucgagacgcugaugcuccuggcccugaucgccgugcucaccgggggcgucacccuguucuuccugagcgggcggggccucggcaagaccuccaucgggcugcugugcgugauggccagcuccgugcuccuguggauggcgagcgucgagccccacuggaucgccgccuccaucauccuggaguucuuccucauggugcugcugauccccgagccggaccgccagcggacgccccaggacaaccagcucgccuacguggucaucggccugcuguucaugauccucacgguggccgcgaacgagauggggcugcuggagaccaccaagaaggaccucggcaucgggcacguggccgucgagaaccaccaccacgccgccaugcuggacguggaccugcaccccgccagcgcguggacccucuacgccguggccacgaccaucaucaccccgaugaugcgccacaccaucgagaacacgaccgccaacaucucccugaccgccaucgcgaaccaggccgccauccugaugggccucgacaagggcuggcccaucagcaagauggacaucggggucccccugcuggcccucggcugcuacucccaggugaacccccugacccugacggcggccgugcucaugcuggucgcccacuacgccaucaucgggccgggccugcaggccaaggcgacccgcgaggcccagaagcggaccgccgccgggaucaugaagaaccccaccguggacggcaucguggccaucgaccucgaccccgucguguacgacgcgaaguucgagaagcagcugggccagaucaugcugcucauccugugcacgagccagauccugcucaugcgcaccaccugggcccugugcgaguccaucacccuggccacggggccccucaccacccugugggagggcagcccggggaaguucuggaacaccacgaucgccguguccauggccaacaucuuccggggcagcuaccuggcgggcgccgggcucgccuucucccugaugaagucccugggcgggggccgccgggggaccggcgcccagggcgagacccucggggagaaguggaagcgccagcugaaccagcugagcaaguccgaguucaacaccuacaagcggagcggcaucauggaggucgaccgcuccgaggcgaaggaggggcucaagcggggcgagacgaccaagcacgccgugagccgcgggaccgccaagcugcggugguucguggagcgcaaccuggucaagcccgagggcaaggugaucgaccugggcugcgggcggggcgggugguccuacuacugcgccggccucaagaaggugaccgaggucaagggguacacgaagggcggccccgggcacgaggagcccaucccgauggccaccuacggcuggaaccuggugaagcugcacagcgggaaggacguguucuucaucccgcccgagaagugcgacacccuccugugcgacaucggcgaguccagccccaacccgaccaucgaggaggggcgcacgcugcggguccucaagaugguggagcccuggcugcgcggcaaccaguucugcaucaagauccugaaccccuacaugcccuccguggucgagacccucgagcagaugcagcggaagcacggcgggaugcuggugcgcaacccgcugagccggaacuccacccacgagauguacugggugagcugcggcaccgggaacaucgucuccgcggugaacaugaccagccgcaugcuccugaaccgcuucacgauggcccaccggaagcccaccuacgagcgcgacguggaccugggcaccggcacccggcacgucgccguggagcccgagguggccaaccucgacaucaucgggcagcgcaucgagaacaucaagcacgagcacaaguccacguggcacuacgacgaggacaaccccuacaagaccugggccuaccacggcagcuacgaggucaagccguccgggagcgcguccagcauggugaacggcgucgugaagcugcugaccaagcccugggacgugauccccauggucacccagaucgccaugacggacaccacccccuucgggcagcagcggguguucaaggagaagguggacacccgcacgccgaaggccaagcggggcaccgcccagaucauggaggucaccgcccgcuggcucuggggcuuccugagccggaacaagaagccccgcaucugcacccgggaggaguucacgcgcaaggugcgguccaacgcggccaucggggccguguucgucgacgagaaccaguggaacagcgccaaggaggcgguggaggacgagcgcuucugggaccuggugcaccgggagcgcgagcuccacaagcagggcaagugcgcgaccugcgucuacaacaugauggggaagcgggagaagaagcugggcgaguucgggaaggccaagggcucccgcgccaucugguacauguggcugggcgcccgguuccucgaguucgaggcgcugggguucaugaacgaggaccacugguucagccgcgagaacucccugagcggcguggagggggagggccuccacaagcugggguacauccugcgggacaucuccaagauccccggcggcaacauguacgccgacgacaccgccgggugggacacccgcaucacggaggacgaccuccagaacgaggccaagaucaccgacaucauggagccggagcacgcccugcuggcgaaggccaucuucaagcucaccuaccagaacaaggugguccgcgugcagcggcccgccaagaacggcaccgugauggacgucaucagccgccgggaccagcgcggguccggccaggugggcacguacgggcugaacaccuucaccaacauggaggcccagcugauccggcagauggagagcgagggcaucuucucccccagcgagcucgagacccccaaccuggccgagcgcgcgcuggacuggcucgagaaguacgggguggagcggcugaagcgcauggccaucuccggcgacgacugcgucgugaagccgaucgacgaccgguucgccacggcccugaccgcccucaacgacauggggaaggugcgcaaggacaucccccagugggagcccagcaagggcuggaacgacuggcagcagguccccuucugcucccaccacuuccaccagcugaucaugaaggacggccgggagaucguggugccgugccgcaaccaggacgagcuggucgggcgggcgcgcgugagccagggcgccggguggucccuccgggagaccgccugccugggcaagagcuacgcccagauguggcagcugauguacuuccaccgccgggaccuccgccuggcggccaacgccaucugcagcgccgugcccgucgacugggugcccaccucccggacgaccuggagcauccacgcccaccaccaguggaugaccaccgaggacaugcuguccguguggaaccgcgucuggaucgaggagaaccccuggauggaggacaagacgcacaucagcuccugggaggacgugccguaccucgggaagcgcgaggaccaguggugcggcagccugaucggccugaccgcgcgggccaccugggccaccaacauccagguggccaucaaccagguccgccggcucaucgggaacgagaacuaccuggacuacaugaccuccaugaagcgcuucaagaacgagagcgaccccgagggcgcccugugguga

SEQ ID NO: 8423 - RNA, 9879 nt, Artificial Sequence
  derived and/or modified CDS sequence (opt1) from DENV-1__FJ410256__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggggaguucugcgaggacaccaugaccuacaagugcccccggaucaccgaggccgagcccgacgacguggacugcuggugcaacgccaccgacacgugggugaccuacgggaccugcagccagaccggggagcaccggcgcgacaagcgguccguggcccuggcgccccacgugggccucgggcuggagacgcgcaccgagaccuggaugagcuccgagggcgccuggaagcagauccagaaggucgagaccugggcccugcggcaccccggguucacggugaucgcccucuuccuggcgcacgccaucggcaccagcaucacccagaaggggaucaucuucauccugcucaugcuggugacccccuccauggccaugcgcugcgucggcaucggcagccgggacuucguggaggggcuguccggcgccacguggguggacgucgugcucgagcacgggagcugcgugaccaccauggccaaggacaagcccacccuggacaucgagcugcucaagacggaggucaccaaccccgcggugcugcgcaagcugugcaucgaggccaagaucuccaacaccaccacggacagccggugcccgacccagggcgaggccacccucguggaggagcaggacaccaacuucgucugccgccggacguucguggaccgcggcugggggaacggcugcgggcuguucggcaaggggucccugaucacgugcgccaaguucaagugcgugaccaagcucgagggcaagaucguccaguacgagaaccugaaguacagcgugaucgugaccguccacacgggcgaccagcaccagguggggaacgaguccaccgagcacggcaccaccgccaccaucacgccccaggcgcccagcaccgagauccagcugaccgacuacggggcccucacccuggacugcagcccccggacgggccuggacuucaacgagaugguccuccugaccaugaaggagaaguccuggcuggugcacaagcagugguuccucgaccugccgcugcccuggaccagcggggccuccaccagccaggagacguggaaccgcaaggaccuccuggugaccuucaagaccgcccacgccaagaagcaggaggucguggugcugggcucccaggagggcgcgaugcacaccgcccucacgggggccaccgagauccagaccagcggcaccacgaccaucuucgccgggcaccugaagugccggcugaagauggacaagcucacccugaagggcauguccuacgucaugugcaccgggagcuucaagcuggagaaggagguggccgagacgcagcacggcaccgugcucguccagaucaaguacgagggcaccgacgcgcccugcaagauccccuucuccacccaggacgagaagggggugacgcagaacggccgccugaucaccgccaacccgaucgugaccgacaaggagaagcccgucaacaucgaggccgagccgcccuucggggagagcuacaucgugaucggcgccggcgagaaggcgcugaagcuguccugguucaagaaggggagcuccaucggcaagauguucgaggccaccgcccgcggggcccgccggauggccauccucggcgacacggcgugggacuucgggagcaucggcggcguguucaccuccgucgggaagcuggugcaccagaucuucggcaccgccuacggggugcuguucagcggcgucuccuggaccaugaagaucgggaucggcgugcuccugacguggcugggccucaacagccgcuccaccagccuguccaugaccugcaucgccguggggcuggucacccucuaccugggcgugauggugcaggccgacagcgggugcgucaucaacuggaagggccgcgagcugaagugcgggagcggcaucuucgugacgaacgaggugcacaccuggaccgagcaguacaaguuccaggccgacuccccgaagcggcucagcgcggccaucggcaaggccugggaggagggggucugcggcauccgcuccaccacccggcuggagaacaucauguggaagcagaucagcaacgagcugaaccacauccuccuggagaacgacaugaaguucacggugguggucggggacguggccggcauccuggcccaggggaagaagaugauccgcccccagcccauggaguacaaguacuccuggaaguccuggggcaaggcgaagaucaucggcgccgacgugcagaacaccaccuucaucaucgacgggcccaacaccccggagugccccgacgaccagcgggccuggaacaucugggaggucgaggacuacggcuucgggaucuucacgaccaacaucuggcucaagcugcgcgacuccuacacccaggugugcgaccaccggcugaugagcgccgcgaucaaggacuccaaggccgugcacgccgacaugggcuacuggaucgagagcgagaagaacgagaccuggaagcucgcccgcgccuccuucaucgaggucaagacgugcaucuggcccaagagccacacccugugguccaacggcgugcuggagagcgagaugaucauccccaagaucuacgggggcccgaucucccagcacaacuaccggcccggguacuucacccagaccgcgggccccuggcaccucgggaagcuggagcuggacuucgaccucugcgagggcacgaccguggucguggacgagcacugcggcaaccgcgggccgagccugcggaccaccacggugaccggcaagaucauccacgaguggugcugccgcuccugcacccugccgccccugcgguucaagggggaggacggcugcugguacgggauggagauccgccccgucaaggagaaggaggagaaccuggucaagagcauggugagcgccggcuccggcgaggucgacagcuucucccuggggcuccugugcaucagcaucaugaucgaggaggugaugcggucccgcuggagccggaagaugcugaugaccggcacgcucgccguguucuuccugcugaucauggggcagcucaccuggaacgaccugauccgccugugcaucauggucggcgccaacgccuccgaccggauggggaugggcaccaccuaccucgcgcugauggccacguucaagaugcgcccgauguucgccgugggccuccuguuccgccggcugaccagccgcgaggugcugcuccugaccaucgggcugucccucgucgccagcguggagcugcccaacucccuggaggagcucggcgacgggcuggccaugggcaucaugauccugaagcuccugaccgacuuccagagccaccagcugugggcgacgcuccugucccugaccuucaucaagaccaccuucagccuccacuacgccuggaagacgauggccaugguccuguccaucgugagccuguucccccucugccuguccaccaccagccagaagaccacguggcugcccgugcuccugggcucccuggggugcaagccgcucaccauguuccugaucgccgagaacaagaucuggggccgcaagagcuggccccugaacgaggggaucauggcggucggcaucgugagcauccuccuguccagccugcucaagaacgacgugccccuggccgggccccugaucgccggcggcaugcucaucgccugcuacgucaucuccgggagcuccgccgaccugagccuggagaaggcggccgagguguccugggaggaggaggccgagcacagcggcgccucccacaacauccucguggagguccaggacgacgggaccaugaagaucaaggacgaggagcgcgacgacacccugaccauccugcucaaggccacgcugcuggcggugagcggcguguacccgcucuccauccccgccacccuguucgucugguacuucuggcagaagaagaagcagcggagcggggugcugugggacacccccagcccgcccgagguggagcgcgccguccucgacgacggcaucuaccggaucaugcagcgcggccugcuggggcggagccaggugggcgugggggucuuccaggagaacguguuccacaccauguggcacgugacgcgcggcgccguccugauguaccaggggaagcggcucgagcccuccugggccagcgugaagaaggaccugaucuccuacggcggcggguggcgccugcagggcagcuggaacaccggggaggaggugcaggucaucgcgguggagcccggcaagaaccccaagaacgugcagaccgcccccgggaccuucaagacguccgagggcgaggucggcgccaucgcccucgacuucaagcccgggaccagcggcagccccaucgugaaccgggaggggaagaucgugggccuguacggcaacggggucgugaccaccuccggcacguacgugagcgccaucgcgcaggccaaggccucccaggaggggccccugccggagaucgaggacgaggucuuccgcaagcggaaccucaccaucauggaccugcaccccggcagcgggaagacccgccgguaccugcccgccaucgugcgcgaggcgaucaagcggaagcuccgcacccugauccuggccccgacgcggguggucgccuccgagauggccgaggcccucaagggcaugcccauccgcuaccagaccaccgcggucaagagcgagcacaccggcaaggagaucguggaccugaugugccacgccacguucaccaugcgccugcucucccccguccgggugcccaacuacaacaugaucaucauggacgaggcccacuucaccgacccgagcuccaucgccgcccgcggguacaucagcacccgggugggcaugggggaggcggccgccaucuucaugacggccacgccgcccggcuccgucgaggccuucccccagagcaacgcggugauccaggacgaggagcgcgacaucccggagcgguccuggaacagcggguacgaguggaucaccgacuuccccggcaagaccgugugguucguccccuccaucaagagcggcaacgacaucgccaacugccugcgcaagaacgggaagcgggugauccagcugucccgcaagacguucgacaccgaguaccagaagaccaagaacaacgacugggacuacguggucaccacggacaucagcgagaugggcgccaacuuccgggccgaccgcgugaucgacccccggcgcugccucaagccggugauccugaaggacgggcccgagcgggucauccuggcgggccccaugcccgugaccgucgccuccgccgcccagcgccgggggcgcaucggccggaaccacaacaaggagggcgaccaguacaucuacauggggcagccgcucaacaacgacgaggaccacgcccacuggaccgaggcgaagaugcugcuggacaacaucaacacccccgagggcaucauccccgcccucuucgagcccgagcgcgagaaguccgccgccaucgacggggaguaccggcugcgcggcgaggcccgcaagacguucguggagcugaugcggcgcggggaccucccgguguggcugagcuacaaggucgcguccgagggcuuccaguacagcgaccggcgcuggugcuucgacggcgagcggaacaaccaggugcuggaggagaacauggacguggagaucuggaccaaggagggggagcgcaagaagcuccggccccgcuggcuggacgcccggaccuacuccgacccccuggcccuccgcgaguucaaggaguucgccgccggccggcgcagcgucuccggggaccugauccuggagaucggcaagcucccccagcaccugacccagcgggcgcagaacgcccuggacaaccucgugaugcugcacaacagcgagcagggcgggcgcgccuaccggcacgccauggaggagcugccggacacgaucgagacccucaugcugcuggcgcucaucgccgugcugaccggcggggucacccuguucuuccucuccggccgcgggcugggcaagaccagcaucggccugcucugcgugguggccuccagcguccugcuguggauggccuccguggagccccacuggaucgccgcgagcaucauccucgaguucuuccugauggugcugcucauccccgagcccgaccggcagcgcacgccgcaggacaaccagcuggccuacgucgugaucgggcuccucuucaugauccugaccguggccgccaacgagaugggccugcucgagaccaccaagaaggaccuggggaucggccacgucgccgcggagaaccaccaccacgccgccaugcuggacguggaccuccaccccgccuccgccuggacgcuguacgcgguggccaccaccaucaucacccccaugaugcggcacacgaucgagaacaccaccgccaacaucagccugaccgccaucgccaaccaggcggccauccucauggggcuggacaagggcuggccgaucuccaagauggacaucggcgucccccugcucgcccuggggugcuacagccaggugaacccccugacgcucaccgccgcggugcugaugcuggucgcccacuacgccaucaucggccccgggcuccaggccaaggccacccgcgaggcgcagaagcggaccgccgccggcaucaugaagaacccgacgguggacgggaucguggccaucgaccuggaccccgucguguacgacgccaaguucgagaagcagcugggccagaucaugcuccugauccugugcaccucccagauccuccugaugcgcaccaccugggcgcugugcgagagcaucacgcucgccaccggcccccugaccacccugugggaggggucccccggcaaguucuggaacacgaccaucgccgugagcauggccaacaucuuccgcgggagcuaccucgccggcgcgggccuggccuucucccugaugaagucccucgggggcgggcggcgcggcaccggggcccagggcgagacccugggcgagaaguggaagcggcagcugaaccagcucuccaagagcgaguucaacacguacaagcgcuccgggaucauggaggucgaccggagcgaggccaaggagggccugaagcgcggggagaccaccaagcacgcggugucccggggcaccgccaagcugcgcugguucguggagcggaaccucgucaagccggaggggaaggugaucgaccugggcugcggccgcgggggcuggagcuacuacugcgccgggcugaagaaggugacggaggucaagggcuacaccaagggcgggcccggccacgaggagcccauccccauggccaccuacggguggaaccuggugaagcuccacuccggcaaggacguguucuucaucccgcccgagaagugcgacacccugcugugcgacaucggggagagcucccccaaccccacgaucgaggagggccggacccuccgcguccugaagaugguggagccguggcugcgggggaaccaguucugcaucaagauccucaaccccuacaugcccagcguggucgagacccuggagcagaugcagcgcaagcacggcggcaugcuggugcggaacccccucucccgcaacagcacccacgagauguacuggguguccugcgggaccggcaacaucgucagcgccgugaacaugacgucccggaugcugcugaaccgcuucaccauggcgcaccggaagccgaccuacgagcgcgacguggaccucggggccggcacccgccacgucgccguggagcccgagguggccaaccuggacaucaucggccagcggaucgagaacaucaagcacgagcacaagagcacguggcacuacgacgaggacaaccccuacaagaccugggccuaccacggguccuacgaggucaagcccagcggcagcgcguccagcauggugaacggggucgugaagcugcucaccaagccgugggacgugauccccauggucacccagaucgccaugacggacaccacccccuucggccagcagcgcguguucaaggagaagguggacacccggacgcccaaggccaagcgcgggaccgcccagaucauggaggucaccgccaaguggcuguggggcuuccugucccggaacaagaagccgcgcaucugcacccgggaggaguucacgcgcaaggugcggagcaacgcggccaucggcgccguguucgucgacgagaaccaguggaacuccgccaaggaggcgguggaggacgagcgcuucugggaccucgugcaccgggagcgcgagcugcacaagcaggggaagugcgcgaccugcgucuacaacaugaugggcaagcgggagaagaagcugggggaguucggcaaggccaaggggagccgcgccaucugguacauguggcucggcgcccgguuccuggaguucgaggcgcugggcuucaugaacgaggaccacugguucucccgcgagaacagccucuccgggguggagggcgaggggcugcacaagcugggcuacauccuccgggacaucagcaagauccccgggggcaacauguacgccgacgacaccgccggcugggacacccgcaucacggaggacgaccugcagaacgaggccaagaucaccgacaucauggagcccgagcacgcccugcucgcgaaguccaucuucaagcugaccuaccagaacaaggugguccgggugcagcgcccggccaagaacgggaccgugauggacgucaucagccggcgcgaccagcgcggcuccggccaggugggcacguacggccugaacaccuucaccaacauggaggcccagcucauccggcagauggagagcgaggggaucuucucccccagcgagcuggagacccccaaccuggccggccgcgugcucgacuggcuggagaagcacggggccgagcggcugaagcgcauggcgaucuccggcgacgacugcgucgugaagcccaucgacgaccgguucgccacggcccucaccgcccugaacgacauggggaaggugcgcaaggacaucccgcagugggagcccagcaagggcuggaacgacuggcagcagguccccuucugcagccaccacuuccaccagcugaucaugaaggacggccgggagaucguggugcccugccgcaaccaggacgagcucgucgggcgggcccgcgugucccagggcgcgggguggagccugcgggagaccgccugccugggcaaguccuacgcccagauguggcagcucauguacuuccaccgccgggaccugcgccuggccgcgaacgccaucugcagcgccgugccggucgacugggugcccaccucccggacgaccuggagcauccacgcccaccaccaguggaugaccaccgaggacaugcucuccguguggaaccgcgucuggaucgaggagaaccccuggauggaggacaagacgcacaucagcuccuggggcgacgugcccuaccugggcaagcgggaggaccaguggugcggcagccugaucgggcucaccgcccgcgcgaccugggccaccaacauccagguggccaucaaccagguccggcgccugaucggcaacgagaacuaccuggacuacaugaccuccaugaagcgcuucaagaacgagagcgacccggagggggcccucugguga

SEQ ID NO: 8424 - RNA, 9879 nt, Artificial Sequence
  derived and/or modified CDS sequence (opt1) from DENV-1__FJ410257__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacacgaugaccuacaagugcccccgcaucaccgaggccgagcccgacgacguggacugcuggugcaacgccaccgacaccugggugaccuacgggaccugcagccagaccggcgagcaccggcgcgacaagcgguccguggcccucgcgccccacgugggccuggggcuggagacgcgcaccgagaccuggaugagcuccgagggcgccuggaagcagauccagcgggucgagaccugggcccuccgccaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcggugcugcggaagcucugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacaccggcgaccagcaccagguggggaacgaguccacggagcacggcaccaccgcgaccaucacgccccaggcccccacgaccgagauccagcucaccgacuacggggcccugacccuggacugcagcccccgcacgggccucgacuucaacgagaugguccugcugaccaugaaggagaaguccuggcucgugcacaagcagugguuccuggaccugccgcuccccuggaccagcggggccagcaccucccaggagacguggaaccggcaggaccugcuggugaccuucaagaccgcccacgcgaagaagcaggaggucguggugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgucaugugcaccggguccuucaagcucgagaaggagguggcggagacgcagcacggcaccgugcugguccagaucaaguacgagggcaccgacgcccccugcaagauccccuucaccacgcaggacgagaagggggugacccagaacggccggcugaucaccgccaacccgaucgugaccgacaaggagaagcccgucaacaucgaggccgagccgcccuucggggagagcuacaucgugaucggcgcgggcgagaaggcccugaagcucuccugguucaagaaggggagcuccaucggcaagauguucgaggccacggcccgcggggcccggcgcauggcgauccugggcgacaccgccugggacuucgggagcaucggcggcguguucaccuccgucgggaagcuggugcaccagaucuucggcaccgccuacgggguccuguucagcggcgucuccuggacgaugaagaucgggaucggcgugcugcugaccuggcucggccugaacagccgcuccaccagccuguccaugaccugcaucgccguggggcucgucacgcuguaccugggcgugauggugcaggccgacagcgggugcgucaucaacuggaagggccgggagcucaagugcggguccggcaucuucgugaccaacgaggugcacaccuggaccgagcaguacaaguuccaggcggacagcccgaagcgccugagcgccgccaucggcaaggccugggaggagggggucugcggcauccgguccgccacccgccuggagaacaucauguggaagcagaucagcaacgagcucaaccacauccugcuggagaacgacaugaagcucacggugguggucggggacguggcgggcauccuggggcagggcaagaagaugauccggccccagcccauggaguacaaguacuccuggaaguccuggggcaaggccaagaucaucggggccgacgcccagaacaccaccuucaucaucgacggccccaacaccccggagugccccgacgaccagcgcgcguggaacaucugggagguggaggacuacggguucggcaucuucacgaccaacaucuggcugaagcuccgggacuccuacacccaggucugcgaccaccgccugaugagcgccgccaucaaggacuccaaggccgugcacgccgacaugggcuacuggaucgagagcgagaagaacgagaccuggaagcuggcgcgggccuccuucaucgaggugaagacgugcaucuggcccaagagccacacccucugguccaacgggguccuggagagcgagaugaucauccccaagaucuacggcgggccgaucucccagcacaacuaccgccccggcuacuucacccagaccgccgggcccuggcaccugggcaagcucgagcuggacuucgaccugugcgagggcacgaccgugguggucgacgagcacugcgggaaccggggcccgagccuccgcaccaccacggugaccgggaagaucauccacgaguggugcugccgguccugcacccugccgccccugcgcuuccggggcgaggacgggugcugguacggcauggagauccgccccgugaaggagaaggaggagaaccucgucaagagcaugguguccgccggcagcggggagguggacagcuucucccugggccugcucugcaucagcaucaugaucgaggaggucaugcggucccgcuggagccggaagaugcugaugaccgggacgcuggccguguucuuccuccugaucaugggccagcugaccuggaacgaccucauccgccugugcaucauggugggggcgaacgccuccgaccgcaugggcaugggcaccaccuaccuggcccucauggccacguucaagaugcggccgauguucgccgucgggcugcuguuccgccggcucaccagccgcgaggugcugcugcucaccaucggccugucccugguggcgagcgucgagcuccccaacucccuggaggagcugggggacggccucgccaugggcaucaugauccugaagcugcucaccgacuuccagagccaccagcugugggccacgcugcucucccugaccuucaucaagaccaccuucagccugcacuacgccuggaagacgauggcgauggugcucuccaucgucagccuguucccccugugccucuccaccaccagccagaagaccacguggcugcccgugcugcucgggucccugggcugcaagccgcugaccauguuccucaucgccgagaacaagaucugggggcgcaagagcuggccccugaacgagggcaucauggccguggggaucgucuccauccugcucagcagccugcugaagaacgacgugccccucgccggcccccugaucgccggcgggaugcugaucgcgugcuacgugaucuccggcagcuccgccgaccucagccuggagaaggccgccgaggucuccugggaggaggaggccgagcacagcggggcgucccacaacauccugguggaggugcaggacgacggcaccaugaagaucaaggacgaggagcgcgacgacacccucaccauccugcugaaggccacgcuccuggccgucagcgggguguacccgcuguccauccccgccacccucuucgugugguacuucuggcagaagaagaagcagcggagcggcguccugugggacacccccagcccgcccgagguggagcgcgccgugcuggacgacggcaucuaccggaucaugcagcgcgggcugcucggccggagccaggucggggugggcguguuccaggagaacgucuuccacaccauguggcacgugacgcgcggggcggugcugauguaccagggcaagcggcuggagcccuccugggccagcgucaagaaggaccucaucuccuacggcgggggcuggcgccugcgggggagcuggaacaccggcgaggagguccaggugaucgccgucgagcccgggaagaaccccaagaacgugcagaccgcccccggcaccuucaagacgcccgagggcgaggugggggccaucgcgcuggacuucaagcccggcaccuccgggagccccaucgucaaccgcgagggcaagaucgugggccucuacgggaacggcguggucaccaccuccgggacguacgugagcgccaucgcccaggccaaggcgagccaggagggcccgcugcccgagaucgaggacgagguguuccggaagcgcaaccugaccaucauggaccuccaccccggguccggcaagacccggcgcuaccugccggccaucguccgggaggccaucaagcgcaagcugcgcacccucauccuggcccccacgcgggugguggccagcgagauggcggaggcccugaagggcaugcccauccgcuaccagaccaccgccgucaaguccgagcacaccgggaaggagaucguggaccucaugugccacgccacguucaccaugcggcugcugagccccgugcgcgucccgaacuacaacaugaucaucauggacgaggcccacuucaccgaccccuccagcaucgcggcccggggcuacaucuccacccgcguggggaugggcgaggccgccgccaucuucaugacggcgacgccgcccgggagcguggaggccuucccgcaguccaacgccgucauccaggacgaggagcgggacauccccgagcgcagcuggaacuccggcuacgaguggaucaccgacuucagcggcaagaccgugugguucgugcccuccaucaagagcgggaacgacaucgccaacugccuccggaagaacggcaagcgcgucauccagcugucccggaagacguucgacaccgaguaccagaagaccaagaacaacgacugggacuacguggugaccacggacaucagcgagaugggggcgaacuuccgcgccgaccgggucaucgacccccgccggugccugaagccggugauccucaaggacggccccgagcgcgugauccuggccgggcccaugcccgucaccguggccuccgccgcgcagcggcgcggccggaucggccgcaacuacaacaaggagggggaccaguacaucuacaugggccagccgcugaacaacgacgaggaccacgcccacuggaccgaggccaagaugcuccuggacaacaucaacacccccgaggggaucauccccgcccuguucgagcccgagcgcgagaaguccgccgcggucgacggcgaguaccggcuccgcggggaggcccggaagacguucguggagcugaugcgccggggcgaccugccgguguggcucuccuacaaggucgccagcgagggcuuccaguacagcgaccgccgguggugcuucgacggggagcgcaacaaccaggugcuggaggagaacauggacguggagaucuggaccaaggagggcgaccggaagaagcugcgcccccgguggcucgacgcccgcaccuacuccgacccccuggcccugcgggagcucaaggaguucgcggccgggcgccggagcgucuccggcgaccugauccuggagaucggcaagcucccccagcaccugacccagcgcgcccagaacgcccuggacaaccucgugaugcugcacaacagcgagcagggcgggcgggcguaccgccacgccauggaggagcugccggacacgaucgagacccucaugcugcuggcccucaucgccgugcugaccgggggcgucacccuguucuuccucuccgggcggggccugggcaagaccagcaucgggcugcucugcgugauggccuccagcgugcugcuguggauggcguccgucgagccccacuggaucgccgccagcaucauccucgaguucuuccugauggugcugcucauccccgagcccgaccgccagcggacgccgcaggacaaccagcuggccuacguggucaucggccuccucuucaugauccugaccguggccgcgaacgagauggggcugcucgagaccaccaagaaggaccugggcaucgggcacguggccgucgagaaccaccaccacgccgccaugcuggacguggaccuccaccccgccuccgcguggacgcuguacgccguggccaccaccaucaucacccccaugaugcgccacacgaucgagaacaccaccgccaacaucagccugaccgccaucgcgaaccaggccgccauccucaugggccuggacaagggcuggccgaucuccaagauggacaucggggucccccugcucgcccugggcugcuacagccaggugaacccccugacgcucaccgcggccgugcugaugcuggucgcccacuacgccaucaucgggcccggccuccaggccaaggcgacccgcgaggcccagaagcggaccgccgccgggaucaugaagaacccgacgguggacggcaucguggccaucgaccuggaccccgucguguacgacgcgaaguucgagaagcagcugggccagaucaugcuccugauccugugcaccucccagauccuccugaugcgcaccaccugggcccugugcgagagcaucacgcucgccaccgggccccugaccacccugugggagggcucccccgggaaguucuggaacacgaccaucgccgugagcauggccaacaucuuccggggcuccuaccucgcgggcgccgggcuggccuucagccugaugaagucccucggcgggggccgccgggggaccggcgcccagggcgagacccugggggagaaguggaagcgccagcugaaccagcucuccaagagcgaguucaacacguacaagcgguccggcaucauggaggucgaccgcagcgaggcgaaggaggggcugaagcggggcgagaccaccaagcacgccgugucccgcgggaccgccaagcugcggugguucguggagcgcaaccuggucaagccggagggcaaggugaucgaccucggcugcgggcggggcggguggagcuacuacugcgccggccugaagaaggugacggaggucaagggguacaccaagggcggccccgggcacgaggagcccauccccauggccaccuacggcuggaaccuggugaagcuccacuccgggaaggacguguucuucaucccgcccgagaagugcgacacccugcugugcgacaucggcgagagcucccccaaccccacgaucgaggaggggcgcacccuccggguccugaagaugguggagccguggcugcgcggcaaccaguucugcaucaagauccucaaccccuacaugcccagcguggucgagacccuggagcagaugcagcggaagcacggcgggaugcuggugcgcaacccccucucccggaacagcacccacgagauguacuggguguccugcggcaccgggaacaucgucagcgcggugaacaugacgucccgcaugcugcugaaccgcuucaccauggcccaccggaagccgaccuacgagcgcgacguggaccucggcaccggcacgcggcacgucgccguggagcccgagguggccaaccuggacaucaucgggcagcgcaucgagaacaucaagcacgagcacaagagcaccuggcacuacgacgaggacaaccccuacaagaccugggccuaccacggcuccuacgaggucaagcccagcggguccgcgagcagcauggugaacggcgucgugaagcugcucaccaagccgugggacgugauccccauggucacgcagaucgccaugaccgacaccacccccuucgggcagcagcggguguucaaggagaagguggacacgcgcacccccaaggccaagcggggcaccgcccagaucauggaggucaccgcccgcuggcuguggggcuuccugucccggaacaagaagccgcgcaucugcacgcgggaggaguucacccgcaaggugcggagcaacgcggccaucggggccguguucgucgacgagaaccaguggaacuccgccaaggaggcgguggaggacgagcgcuucugggaccucgugcaccgggagcgcgagcugcacaagcagggcaagugcgcgaccugcgucuacaacaugauggggaagcgggagaagaagcugggcgaguucgggaaggccaagggcagccgcgccaucugguacauguggcucggcgcccgguuccuggaguucgaggcgcugggguucaugaacgaggaccacugguucucccgcgagaacagccucuccggcguggagggggagggccugcacaagcugggguacauccuccgggacaucagcaagauccccggcggcaacauguacgccgacgacaccgccgggugggacacgcgcaucaccgaggacgaccugcagaacgaggccaagaucaccgacaucauggagcccgagcacgcccugcucgcgaaggccaucuucaagcugaccuaccagaacaaggugguccgcgugcagcggccggccaagaacggcacggugauggacgucaucucccgccgggaccagcgcgggagcggccaggugggcaccuacgggcugaacaccuucaccaacauggaggcccagcucauccggcagauggaguccgagggcaucuucagccccuccgagcuggagacgcccaaccuggccgagcgcgcgcucgacuggcuggagaaguacgggguggagcggcugaagcgcauggccaucagcggcgacgacugcgucgugaagcccaucgacgaccgguucgccaccgcccucaccgcccugaacgacauggggaaggugcgcaaggacaucccgcagugggagcccuccaagggcuggaacgacuggcagcagguccccuucugcagccaccacuuccaccagcugaucaugaaggacggccgggagaucguggugcccugccgcaaccaggacgagcucgucgggcgggcgcgcgugucccagggcgccggguggagccugcgggagaccgccugccugggcaagagcuacgcccagauguggcagcucauguacuuccaccgccgggaccugcgccuggcggccaacgccaucugcuccgccgugccggucgacugggugcccacgagccggaccaccugguccauccacgcccaccaccaguggaugaccacggaggacaugcucagcguguggaaccgcgucuggaucgaggagaaccccuggauggaggacaagacccacaucuccagcugggaggacgugcccuaccuggggaagcgcgaggaccaguggugcggcucccugaucggccucaccgcgcgggccaccugggccaccaacauccagguggccaucaaccagguccgccggcugaucgggaacgagaacuaccuggacuacaugacgagcaugaagcgcuucaagaacgaguccgacccggagggcgcccucugguga

SEQ ID NO: 8425 - RNA, 9879 nt, Artificial Sequence
  derived and/or modified CDS sequence (opt1) from DENV-1__FJ461332__SS-prME
agcgugaccaugcugcucaugcugaugcccaccgcccuggccuuccaccucaccacccgcggcggggagccccacaugaucgugagcaagcaggagcggggcaagagccugcuguucaagaccuccgcgggggugaacaugugcacccucaucgccauggaccugggcgagcugugcgaggacacgaugaccuacaagugcccccgcaucaccgaggccgagcccgacgacguggacugcuggugcaacgccaccgacacgugggugaccuacgggaccugcagccagaccggcgagcaccggcgcgacaagcgguccguggcccucgcgccccacgugggccuggggcuggagacgcgcaccgagaccuggaugagcuccgagggcgccuggaagcagauccagcggguggagaccugggcccuccgccaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcggugcugcggaagcucugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacaccggcgaccagcaccagguggggaacgaguccacggagcacggcaccaccgcgaccaucacgccccaggcccccacgaccgagauccagcucaccgacuacggggcccugacccuggacugcagcccccgcacgggccucgacuucaacgagaugguccugcugaccaugaaggagaaguccuggcucgugcacaagcagugguuccuggaccugccccuccccuggaccagcggggccagcaccucccaggagacguggaaccggcaggaccugcuggugaccuucaagaccgcccacgcgaagaagcaggaggucguggugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgucaugugcaccggguccuucaagcucgagaaggagguggcggagacgcagcacggcaccgugcugguccagaucaaguacgagggcaccgacgcccccugcaagauccccuucagcacccaggacgagaagggggugacgcagaacggccggcugaucaccgccaacccgaucgugaccgacaaggagaagcccgucaacaucgaggccgagccgcccuucggggaguccuacaucgugaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcgucgggaagcugauccaccagaucuucggcaccgccuacgggguccucuucuccggcgugagcuggaccaugaagaucgggaucggcguccugcugacguggcucggccugaacucccgcagcaccucccugagcaugaccugcaucgccguggggcucgugacccuguaccugggcgucauggugcaggccgacuccgggugcgugaucaacuggaagggccgggagcucaagugcgggagcggcaucuucgucacgaacgaggugcacaccuggaccgagcaguacaaguuccaggcggacagcccgaagcgccuguccgccgccaucggcaaggccugggaggagggggugugcggcauccggagcgccacccgccuggagaacaucauguggaagcagaucuccaacgagcucaaccacauccugcuggagaacgacaugaagcucaccgucguggugggggacgucgcgggcauccuggggcagggcaagaagaugauccggccccagcccauggaguacaaguacagcuggaaguccuggggcaaggccaagaucaucggggccgacgcccagaacacgaccuucaucaucgacggccccaacaccccggagugccccgacgaccagcgcgcguggaacaucugggagguggaggacuacggguucggcaucuucaccacgaacaucuggcugaagcuccgggacagcuacacccaggugugcgaccaccgccugauguccgccgccaucaaggacagcaaggccguccacgccgacaugggcuacuggaucgaguccgagaagaacgagaccuggaagcuggcgcgggccagcuucaucgaggugaagaccugcaucuggcccaagucccacacgcucuggagcaacggggugcuggaguccgagaugaucauccccaagaucuacggcgggccgaucagccagcacaacuaccgccccggcuacuucacccagaccgccgggcccuggcaccugggcaagcucgagcuggacuucgaccugugcgagggcaccacggucgugguggacgagcacugcgggaaccggggcccgucccuccgcaccaccaccgucacggggaagaucauccacgaguggugcugccggagcugcacccugccgccccugcgcuuccggggcgaggacgggugcugguacggcauggagauccgccccgugaaggagaaggaggagaaccucgugaaguccauggucagcgccggcagcggggagguggacuccuucagccugggccugcucugcaucuccaucaugaucgaggaggugaugcggagccgcuggucccggaagaugcugaugaccgggacccuggccgucuucuuccuccugaucaugggccagcugacguggaacgaccucauccgccugugcaucauggugggggcgaacgccuucgaccgcaugggcaugggcaccaccuaccuggcccucauggccaccuucaagaugcggccgauguucgccguggggcugcuguuccgccggcucacgagccgcgagguccugcugcucaccaucggccugucccugguggcgagcguggagcuccccaacucccuggaggagcugggggacggccucgccaugggcaucaugauccugaagcugcucaccgacuuccagagccaccagcugugggccacccugcucucccugacguucaucaagaccaccuucagccugcacuacgccuggaagaccauggcgaugguccucuccaucgugagccuguucccccugugccucuccacgaccagccagaagaccaccuggcugcccguccugcucgggucccugggcugcaagccgcugacgauguuccucaucgccgagaacaagaucugggggcggaaguccuggccccugaacgagggcaucauggccguggggaucguguccauccugcucagcagccugcugaagaacgacgucccccucgccggcccccugaucgccggcgggaugcugaucgcgugcuacgugaucuccggcagcuccgccgaccucagccuggagaaggccgccgagguguccugggaggaggaggccgagcacagcggggcgucccacaacauccuggucgaggugcaggacgacggcaccaugaagaucaaggacgaggagcgcgacgacacccucaccauccugcugaaggccacccuccuggccgugagcggggucuacccgcuguccauccccgccacccucuucgugugguacuucuggcagaagaagaagcagcggagcggcgugcugugggacacccccagcccgcccgucguggagcgcgccgugcuggacgacggcaucuaccggaucaugcagcgcgggcugcucggccggagccaggucggggugggcguguuccaggagaacgucuuccacaccauguggcacgugacccgcggggcggugcugauguaccagggcaagcggcuggagcccuccugggccagcgucaagaaggaccucaucuccuacggcgggggcuggcgccugcgggggagcuggaacacgggcgaggagguccaggugaucgccgucgagcccgggaagaaccccaagaacgugcagaccgcccccggcaccuucaagacccccgagggcgaggugggggccaucgcgcuggacuucaagcccggcacguccgggagccccaucgucaaccgcgagggcaagaucgugggccucuacgggaacggcguggucaccaccuccgggaccuacgugagcgccaucgcccaggccaaggcgagccaggagggcccgcugcccgagaucgaggacgagguguuccggaagcgcaaccugacgaucauggaccuccaccccggguccggcaagacccggcgcuaccugccggccaucguccgggaggccaucaagcgcaagcugcgcacccucauccuggcccccacccgggugguggccagcgagauggcggaggcccugaagggcaugcccauccgcuaccagacgaccgccgucaaguccgagcacaccgggaaggagaucguggaccucaugugccacgccaccuucacgaugcggcugcugagccccgugcgcgucccgaacuacaacaugaucaucauggacgaggcccacuucaccgaccccuccagcaucgcggcccggggcuacaucuccacccgcguggggaugggcgaggccgccgccaucuucaugaccgcgacgccgcccgggagcguggaggccuucccgcaguccaacgccgucauccaggacgaggagcgggacauccccgagcgcagcuggaacuccggccacgaguggaucaccgacuuccccggcaagaccgugugguucgugcccagcaucaaguccgggaacgacaucgccaacugccuccggaagaacggcaagcgcgucauccagcugagccggaagaccuucgacacggaguaccagaagaccaagaacaacgacugggacuacguggugaccaccgacaucuccgagaugggggcgaacuuccgcgccgaccgggucaucgacccgcgccggugccugaagcccgugauccucaaggacggccccgagcgcgugauccuggccgggcccaugccggucacgguggccagcgccgcgcagcggcgcggccggaucggccgcaaccacaacaaggagggggaccaguacaucuacaugggccagccccugaacaacgacgaggaccacgcccacuggaccgaggccaagaugcuccuggacaacaucaacacccccgaggggaucauccccgcccuguucgagccggagcgcgagaaguccgccgcggucgacggcgaguaccggcuccgcggggaggcccggaagaccuucguggagcugaugcgccggggcgaccugcccguguggcucagcuacaaggucgccuccgagggcuuccaguacagcgaccgccgguggugcuucgacggggagcgcaacaaccaggugcuggaggagaacauggacguggagaucuggacgaaggagggcgagcggaagaagcugcgcccccgguggcucgacgcccgcaccuacagcgacccccuggcccugcgggaguucaaggaguucgcggccgggcgccgguccgucagcggcgaccucauccuggagaucggcaagcugccgcagcaccucacccagcgcgcccagaacgcccuggacaaccuggugaugcuccacaacuccgagcagggcgggcgggcguaccgccacgccauggaggagcugcccgacaccaucgagacgcugaugcuccuggcccugaucgccgugcucaccgggggcgucacccuguucuuccugagcgggcggggccucggcaagaccuccaucgggcugcugugcgugauggccagcuccgugcuccuguggauggcgagcgucgagccccacuggaucgccgccuccaucauccuggaguucuuccucauggugcugcugauccccgagccggaccgccagcggacgccccaggacaaccagcucgccuacguggucaucggccugcuguucaugauccucacgguggccgcgaacgagauggggcugcuggagaccaccaagaaggaccucggcaucgggcacguggccgucgagaaccaccaccacgccgccaugcuggacguggaccugcaccccgccagcgcguggacccucuacgccguggccacgaccaucaucaccccgaugaugcgccacaccaucgagaacacgaccgccaacaucucccugaccgccaucgcgaaccaggccgccauccugaugggccucgacaagggcuggcccaucagcaagauggacaucggggucccccugcuggcccucggcugcuacucccaggugaacccccugacccugacggcggccgugcucaugcuggucgcccacuacgccaucaucgggccgggccugcaggccaaggcgacccgcgaggcccagaagcggaccgccgccgggaucaugaagaaccccaccguggacggcaucguggccaucgaccucgaccccgucguguacgacgugaaguucgagaagcagcugggccagaucaugcugcucauccugugcacgagccagauccugcucaugcgcaccaccugggcgcugugcgaguccaucacccuggccacggggccccucaccacccugugggagggcagcccggggaaguucuggaacaccacgaucgccgucuccauggccaacaucuuccggggcagcuaccuggccggcgcggggcucgccuucucccugaugaagucccugggcgggggccgccgggggaccggcgcccagggcgagacccucggggagaaguggaagcgccagcugaaccagcugagcaaguccgaguucaacaccuacaagcggagcggcaucauggagguggaccgcuccgaggccaaggaggggcucaagcggggcgagacgaccaagcacgcggugagccgcgggaccgccaagcugcggugguucgucgagcgcaaccuggugaagcccgagggcaaggugaucgaccugggcugcgggcggggcgggugguccuacuacugcgccggccucaagaaggucaccgaggugaagggguacacgaagggcggccccgggcacgaggagcccaucccgauggccaccuacggcuggaaccuggugaagcugcacagcgggaaggacgucuucuucaucccgcccgagaagugcgacacccuccugugcgacaucggcgaguccagccccaacccgaccaucgaggaggggcgcacgcugcgggugcucaagaugguggagcccuggcugcgcggcaaccaguucugcaucaagauccugaaccccuacaugcccuccgucguggagacccucgagcagaugcagcggaagcacggcgggaugcuggugcgcaacccgcugagccggaacuccacccacgagauguacugggucagcugcggcaccgggaacaucguguccgccgugaacaugaccagccgcaugcuccugaaccgcuucacgauggcgcaccggaagcccaccuacgagcgcgacgucgaccugggcaccggcacccggcacguggccguggagcccgaggucgccaaccucgacaucaucgggcagcgcaucgagaacaucaagcacgagcacaaguccacguggcacuacgacgaggacaaccccuacaagaccugggccuaccacggcagcuacgaggugaagccguccgggagcgccuccagcauggucaacggcguggugaagcugcugaccaagcccugggacgucauccccauggugacccagaucgcgaugacggacaccacccccuucgggcagcagcggguguucaaggagaaggucgacacccgcacgccgaaggccaagcggggcaccgcccagaucauggaggugaccgcccgcuggcucuggggcuuccugagccggaacaagaagccccgcaucugcacccgggaggaguucacgcgcaaggugcgguccaacgccgcgaucggggccgucuucguggacgagaaccaguggaacagcgccaaggaggccguggaggacgagcgcuucugggaccugguccaccgggagcgcgagcuccacaagcagggcaagugcgcgaccugcguguacaacaugauggggaagcgggagaagaagcugggcgaguucgggaaggccaagggcucccgcgccaucugguacauguggcugggcgcccgguuccucgaguucgaggcccugggguucaugaacgaggaccacugguucagccgcgagaacucccugagcggcguggagggggagggccuccacaagcugggguacauccugcgggacaucuccaagauccccggcggcaacauguacgcggacgacaccgccgggugggacacccgcaucacggaggacgaccuccagaacgaggccaagaucaccgacaucauggagccggagcacgcccugcuggccaaggcgaucuucaagcucaccuaccagaacaaggucgugcgcgugcagcggcccgccaagaacggcaccgucauggacgugaucagccgccgggaccagcgcggguccggccaggugggcacguacgggcugaacaccuucaccaacauggaggcccagcugauccggcagauggagagcgagggcaucuucucccccagcgagcucgagacccccaaccuggccgagcgcgcccuggacuggcucgagaaguacggggucgagcggcugaagcgcauggcgaucuccggcgacgacugcguggugaagccgaucgacgaccgguucgccacggcccugaccgcccucaacgacauggggaagguccgcaaggacaucccccagugggagcccagcaagggcuggaacgacuggcagcagguccccuucugcucccaccacuuccaccagcugaucaugaaggacggccgggagaucguggucccgugccgcaaccaggacgagcugguggggcgggcccgcgugagccagggcgcgggguggucccuccgggagaccgccugccugggcaagagcuacgcccagauguggcagcugauguacuuccaccgccgggaccuccgccuggccgcgaacgccaucugcagcgccguccccguggacugggugcccaccucccggacgaccuggagcauccacgcccaccaccaguggaugaccaccgaggacaugcuguccgucuggaaccgcguguggaucgaggagaaccccuggauggaggacaagacgcacaucagcuccugggaggacgugccguaccucgggaagcgcgaggaccaguggugcggcagccugaucggccugaccgcccgggcgaccugggccaccaacauccaggucgccaucaaccaggugcgccggcucaucgggaacgagaacuaccuggacuacaugaccuccaugaagcgcuucaagaacgagagcgaccccgagggcgcccugugguga

SEQ ID NO: 8426 - RNA, 9879 nt, Artificial Sequence
  derived and/or modified CDS sequence (opt1) from DENV-1__FJ461333__SS-prME
agcgugaccaugcugcucaugcugaugcccaccgcccuggccuuccaccucaccacccggggcggggagccccacaugguggugagcaagcaggagcggggcaagagccugcuguucaagaccagcgcgggggugaacaugugcacccucaucgccauggaccugggcgagcugugcgaggacaccaugaccuacaagugcccccggaucaccgaggccgagcccgacgacguggacugcuggugcaacgccaccgacacgugggugaccuacgggaccugcagccagaccggcgagcaccggcgcgacaagcgguccguggcccucgcgccccacgugggccuggggcuggagacgcgcaccgagaccuggaugagcuccgagggcgccuggaagcagauccagcggguggagaccugggcccuccgccaccccggguucacggugaucgcccuguuccuggcgcacgccaucggcaccagcaucacccagaaggggaucaucuucauccuccugaugcuggucacccccuccauggccaugcggugcgugggcaucggcagccgcgacuucguggaggggcucuccggcgccacgugggucgacguggugcuggagcacgggagcugcgucaccaccauggccaaggacaagcccacccuggacaucgagcuccugaagacggaggugaccaaccccgcgauccugcggaagcucugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacaccggcgaccagcaccagguggggaacgaguccacggagcacggcaccaccgcgaccaucacgccccaggcccccacgaccgagauccagcucaccgacuacggggcccugacccuggacugcagcccccgcacgggccucgacuucaacgagaugguccugcugaccaugaaggagaaguccuggcucgugcacaagcagugguuccuggaccugccccuccccuggaccagcggggccagcaccucccaggagacguggaaccggcaggaccugcuggugaccuucaagaccgcccacgcgaagaagcaggaggucguggugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgucaugugcaccggguccuucaagcucgagaaggagguggcggagacgcagcacggcaccgugcugguccagaucaaguacgagggcaccgacgcccccugcaagauccccuucagcacccaggacgagaagggggugacgcagaacggccggcugaucaccgccaacccgaucgugaccgacaaggagaagcccgucaacaucgaggccgagccgcccuucggggaguccuacaucgugaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcgucgggaagcuggugcaccagaucuucggcaccgccuacgggguccuguucuccggcgucagcuggaccaugaagaucgggcugggcgugcugcucacguggcugggccugaacucccgcagcaccucccucagcaugaccugcaucgccguggggcuggucacccuguaccucggcgugauggugcaggccgacuccgggugcgucaucaacuggaagggccgggagcugaagugcgggagcggcaucuucgugacgaacgaggugcacaccuggaccgagcaguacaaguuccaggcggacagcccgaagcgccuguccgccgccaucggcaaggccugggaggagggggucugcggcauccggagcgccacccgccucgagaacgugauguggaagcagaucuccaacgagcugaaccacauccugcucgagaacgacaugaaguucaccguggucgugggggacguggcgggcauccuggcccaggggaagaagaugauccggccccagcccauggagcacaaguacagcuggaaguccuggggcaaggccaagaucaucggcgccgacguccagaacacgaccuucaucaucgacgggcccaacaccccggagugccccgacgaccagcgcgcguggaacaucugggagguggaggacuacggcuucgggaucuucaccacgaacaucuggcugaagcuccgggacagcuacacccaggugugcgaccaccgccugauguccgccgccaucaaggacagcaaggccguccacgccgacaugggcuacuggaucgaguccgagaagaacgagaccuggaagcuggcgcgggccagcuucaucgaggugaagaccugcaucuggcccaagucccacacgcucuggagcaacggcgugcuggaguccgagaugaucauccccaagaucuacgggggcccgaucagccagcacaacuaccgccccggguacuucacccagaccgccggccccuggcaccuggggaagcucgagcuggacuucgaccugugcgagggcaccacggucgugguggacgagcacugcggcaaccgggggccgucccuccgcaccaccaccgucacgggcaagaucauccacgaguggugcugccggagcugcacccugccgccccugcgcuuccgcggggaggacggcugcugguacgggauggagauccgccccgugaaggagaaggaggagaaccucgugaaguccauggucagcgccggcagcggcgagguggacuccuucagccuggggcugcucugcaucuccaucaugaucgaggaggugaugcggagccgcuggucccggaagaugcugaugaccggcacccuggccgucuuccuccugcugaucauggggcagcucacguggaacgaccugauccgccugugcaucauggugggcgcgaacgccagcgaccgcauggggaugggcaccaccuaccucgcccugauggccaccuucaagaugcggccgauguucgccguggggcuccuguuccgccggcugacgucccgcgagguccugcuccugaccaucgggcugagccucguggcguccgucgagcugcccaacagccuggaggagcucggcgacgggcuggccaugggcaucaugauccugaagcuccugaccgacuuccagucccaccagcugugggccacccuccugagccugacguucaucaagaccaccuucucccuccacuacgccuggaagaccauggcgauggugcugagcaucgugucccuguucccccucugccugagcacgaccucccagaagaccaccuggcugcccguccuccugggcagccuggggugcaagccgcucacgauguuccugaucgccgagaacaagaucuggggccggcgcuccuggccccugaacgaggggaucauggccgugggcaucgugagcauccuccugagcucccugcucaagaacgacgucccccuggccgggccccugaucgccggcggcaugcucaucgcgugcuacgugaucagcggguccagcgccgaccugucccuggagaaggccgccgaggugagcugggaggaggaggccgagcacuccggcgcgagccacaacauccucgucgaggugcaggacgacgggaccaugaagaucaaggacgaggagcgggacgacacccugaccauccugcucaaggccacccugcuggccguguccggcgucuacccgcucagcauccccgccacgcuguucgugugguacuucuggcagaagaagaagcagcgcuccggggugcugugggacacccccagcccgcccgaggucgagcgggccgugcuggacgacggcaucuaccgcaucaugcagcggggccuccuggggcgcucccaggugggcgucgggguguuccaggagaacguguuccacaccauguggcacgucacccggggcgcggugcugauguaccaggggaagcgccucgagcccagcugggccuccgugaagaaggaccugaucagcuacggcggcggguggcggcugcagggcuccuggaacacgggggaggagguccaggugaucgccguggagcccggcaagaaccccaagaacguccagaccgcccccgggaccuucaagacccccgagggcgaggugggcgccaucgcgcucgacuucaagcccgggacgagcggcucccccaucgugaaccgcgaggggaagaucgucggccuguacggcaacgggguggugaccaccagcggcaccuacgucagcgccaucgcccaggccaaggcgucccaggaggggccgcugcccgagaucgaggacgagguguuccggaagcgcaaccucacgaucauggaccugcaccccggcagcgggaagacccggcgcuaccugccggccaucgugcgggaggccaucaagcgcaagcuccgcacccugauccuggcccccacccgggucguggccuccgagauggcggaggcccucaagggcaugcccauccgcuaccagacgaccgccgucaagagcgagcacaccggcaaggagaucgucgaccugaugugccacgccaccuucacgaugcggcugcucucccccgugcgcgugccgaacuacaacaugaucaucauggacgaggcccacuucaccgaccccagcuccaucgcggcccggggguacaucagcacccgcgucggcaugggggaggccgccgccaucuucaugaccgcgacgccgcccggcuccguggaggccuucccgcagagcaacgccgugauccaggacgaggagcgggacauccccgagcgcuccuggaacagcggguacgaguggaucaccgacuuccccggcaagaccgucugguucgugcccuccaucaagagcggcaacgacaucgccaacugccugcggaagaacgggaagcgcgugauccagcugucccggaagaccuucgacacggaguaccagaagaccaagaacaacgacugggacuacgucgugaccaccgacaucagcgagaugggcgcgaacuuccgcgccgaccgggugaucgacccgcgccggugccucaagcccgucauccugaaggacgggcccgagcgcgugauccuggccggccccaugccggucacgguggccuccgccgcgcagcggcgcgggcggaucggccgcaaccacaacaaggagggcgaccaguacaucuacauggggcagccccucaacaacgacgaggaccacgcccacuggaccgaggccaagaugcugcuggacaacaucaacacccccgagggcaucauccccgcccucuucgagccggagcgcgagaaguccgccgcgaucgacggggaguaccggcugcgcggcgaggcccggaagaccuucguggagcugaugcgccgcggggaccuccccgucuggcuguccuacaagguggccagcgagggcuuccaguacagcgaccgccgguggugcuucgacggcgagcgcaacaaccaggugcuggaggagaacauggacgucgagaucuggacgaaggagggggagcggaagaagcuccgcccccgguggcuggacgcccgcaccuacuccgacccccuggcccuccgggaguucaaggaguucgcggccggccgccggagcguguccggggaccugauccuggagaucggcaagcucccgcagcaccugacccagcgcgcccagaacgcccuggacaaccucgugaugcugcacaacagcgagcagggcgggcgggcguaccgccacgccauggaggagcugcccgacaccaucgagacgcucaugcugcuggcccucaucgccguccugaccggcggggugacccuguucuuccucuccggccgggggcugggcaagaccagcaucggccugcucugcgugauggccuccagcguccugcuguggauggcguccguggagccccacuggaucgccgccagcaucauccucgaguucuuccugauggugcugcucauccccgagccggaccgccagcggacgccccaggacaaccagcuggccuacgucgugaucgggcuccucuucaugauccugacgguggccgcgaacgagaugggccugcucgagaccaccaagaaggaccuggggaucggccacgccgccgucgggaaccaccaccacgccgccaugcuggacguggaccuccaccccgcguccgccuggacccuguacgccguggccacgaccaucaucaccccgaugaugcgccacaccaucgagaacacgaccgccaacaucagccugaccgcgaucgccaaccaggccgccauccucaugggccuggacaagggcuggcccaucuccaagauggacaucggggucccccugcucgcgcugggcugcuacagccaggugaacccccugacccucacggccgccgugcugaugcuggucgcccacuacgccaucaucgggccgggccuccaggcgaaggccacccgcgaggcccagaagcggaccgccgccgggaucaugaagaaccccaccguggacggcaucguggcgaucgaccuggaccccgucguguacgacgccaaguucgagaagcagcugggccagaucaugcuccugauccugugcacgucccagauccuccugaugcgcaccaccugggcccugugcgagagcaucacccucgccacggggccccugaccacccugugggagggcuccccggggaaguucuggaacaccacgaucgccgugagcauggcgaacaucuuccggggcuccuaccucgccggcgccgggcuggccuucagccugaugaagucccucggcgggggccgccgggggaccggcgcgcagggcgagacccugggggagaaguggaagcgccagcugaaccagcucuccaagagcgaguucaacaccuacaagcgguccggcaucauggaggucgaccgcagcgaggccaaggaggggcugaagcggggcgagacgaccaagcacgccgugucccgcgggaccgccaagcugcggugguucguggagcgcaaccuggucaagcccgagggcaaggugaucgaccucggcugcgggcggggcggguggagcuacuacugcgccggccugaagaaggugaccgaggucaagggguacacgaagggcggccccgggcacgaggagcccaucccgauggcgaccuacggcuggaaccuggugaagcuccacuccgggaaggacguguucuucaucccgcccgagaagugcgacacccugcugugcgacaucggcgagagcucccccaacccgaccaucgaggaggggcgcacgcuccggguccugaagaugguggagcccuggcugcgcggcaaccaguucugcaucaagauccucaaccccuacaugcccagcguggucgagacccuggagcagaugcagcggaagcacggcgggaugcuggugcgcaacccgcucucccggaacagcacccacgagauguacuggguguccugcggcaccgggaacaucgucagcgccgugaacaugaccucccgcaugcugcugaaccgcuucacgauggcccaccggaagcccaccuacgagcgcgacguggaccucggcgccggcacccggcacgucgccguggagcccgagguggcgaaccuggacaucaucgggcagcgcaucgagaacaucaagcacgagcacaagagcaccuggcacuacgacgaggacaaccccuacaagacgugggccuaccacggcuccuacgaggucaagccgagcggguccgccagcagcauggugaacggcgucgugaagcugcucaccaagcccugggacgugauccccauggucacccagaucgccaugaccgacacgacccccuucgggcagcagcggguguucaaggagaagguggacacccgcaccccgaaggccaagcggggcacggcgcagaucauggaggucaccgccaaguggcuguggggcuuccugucccgcaacaagaagccccggaucugcacccgcgaggaguucacccggaaggugcgcagcaacgccgccaucggggcgguguucgucgacgagaaccaguggaacuccgccaaggaggccguggaggacgagcgguucugggaccucgugcaccgcgagcgggagcugcacaagcagggcaagugcgccacgugcgucuacaacaugauggggaagcgcgagaagaagcugggcgaguucgggaaggccaagggcagccgggcgaucugguacauguggcucggcgcccgcuuccuggaguucgaggcccugggguucaugaacgaggaccacugguucucccgggagaacagccucuccggcguggagggggagggccugcacaagcugggguacauccuccgcgacaucagcaagauccccggcggcaacauguacgccgacgacaccgccgggugggacacccggaucaccgaggacgaccugcagaacgaggcgcgcaucacggacaucauggagccggagcacgcccugcucgccaaguccaucuucaagcugaccuaccagaacaaggugguccgcgugcagcggcccgccaagaacggcaccgugauggacgucaucagccgccgggaccagcgcggguccggccaggugggcaccuacgggcugaacacguucaccaacauggaggcccagcucauccggcagauggagagcgagggcaucuucucccccagcgagcuggagacccccaaccuggcggagcgcgugcucgacuggcuggagaaguacggggucgagcggcugaagcgcauggccaucuccggcgacgacugcguggugaagccgaucgacgaccgguucgccaccgcccucacggcccugaacgacauggggaagguccgcaaggacaucccccagugggagcccagcaagggcuggaacgacuggcagcagguccccuucugcucccaccacuuccaccagcugaucaugaaggacggccgggagaucguggucccgugccgcaaccaggacgagcucguggggcgggcgcgcgugagccagggcgccggguggagccugcgggagaccgccugccugggcaaguccuacgcccagauguggcagcucauguacuuccaccgccgggaccugcgccuggcggccaacgccaucugcagcgccguccccguggacuggauccccaccucccggaccacguggagcauccacgcccaccaccaguggaugaccaccgaggacaugcucuccguguggaaccgcgucuggaucgaggagaaccccuggauggaggacaagacccacaucagcuccuggggcgacgugccguaccugggcaagcgcgaggaccaguggugcggcagccugaucgggcucacggcgcgggccaccugggccaccaacgugcaggucgccaucaaccaggugcgccggcugaucggcaacgagaacuaccuggacuacaugaccuccaugaagcgcuucaagaacgagagcgaccccgagggggcccucugguga

SEQ ID NO: 8427 - RNA, 9879 nt, Artificial Sequence
  derived and/or modified CDS sequence (opt1) from DENV-1__FJ410262__SS-prME
agcgugaccaugcugcucaugcugaugcccaccgcccuggccuuccaccucacgacccgcggcggggagccccacaugaucgugagcaagcaggagcggggcaagagccugcuguucaagaccagcgcgggggugaacaugugcacccucaucgccauggaccugggcgaguucugcgaggacacgaugaccuacaagugcccccgcaucaccgaggccgagcccgacgacguggacugcuggugcaacgccaccgacacgugggugaccuacgggaccugcagccagaccggcgagcaccggcgcgacaagcgguccguggcccuggcgccccacgugggccucgggcuggagacgcgcaccgagaccuggaugagcuccgagggcgccuggaagcagauccagcggguggagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugcccgacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaagaccguccaguacgagaaccugaaguacagcgugaucgugaccguccacacgggcgaccagcaccagguggggaacgaguccaccgagcacggcaccaccgcgaccaucacgccccaggcccccagcaccgagauccagcugaccgacuacggggcccucacccuggacugcagcccccggacgggccuggacuucaacgagaugguccuccugaccaugaaggagaaguccuggcuggugcacaagcagugguuccucgaccugccgcugcccuggaccagcggggccuccaccagccaggagacguggaaccggaaggaccuccuggugaccuucaagaccgcccacgcgaagaagcaggaggucguggugcugggcucccaggagggcgccaugcacaccgcccucacgggggccaccgagauccagaccagcggcaccacgaccaucuucgccgggcaccugaagugccgccugaagauggacaagcucacccugaagggcauguccuacgucaugugcaccgggagcuucaagcuggagaaggagguggcggagacgcagcacggcaccgugcucguccagaucaaguacgagggcaccgacgcccccugcaagauccccuucuccacccaggacgagaagggggugacgcagaacggccggcugaucaccgccaacccgaucgugaccgacaaggagaagcccgucaacaucgaggccgagccgcccuucggggagagcuacaucgugaucggcgcgggcgagaaggcccugaagcuguccugguucaagaaggggagcuccaucggcaagauguucgaggccaccgcccgcggggcccggcgcauggcgauccucggcgacacggccugggacuucgggagcaucggcggcguguucaccuccgucgggaagcuggugcaccagaucuucggcaccgccuacggggugcuguucagcggcgucuccuggaccaugaagaucgggaucggcgugcuccugacguggcugggccucaacagccgcuccaccagccuguccaugaccugcaucgccguggggcuggucacccucuaccugggcgugauggugcaggccgacagcgggugcgucaucaacuggaagggccgggagcugaagugcgggagcggcaucuucgugacgaacgaggugcacaccuggaccgagcaguacaaguuccaggcggacuccccgaagcgccucagcgccgccaucggcaaggccugggaggagggggucugcggcauccgguccgccacccgccuggagaacaucauguggaagcagaucagcaacgagcugaaccacauccuccuggagaacgacaugaaguucaccgugguggucggggacguggcgggcauccuggcccaggggaagaagaugauccggccccagcccauggaguacaaguacuccuggaaguccuggggcaaggccaagaucaucggcgccgacgugcagaacacgaccuucaucaucgacgggcccaacaccccggagugccccgacgaccagcgcgcguggaacaucugggaggucgaggacuacggcuucgggaucuucaccacgaacaucuggcucaagcugcgggacuccuacacccaggugugcgaccaccgccugaugagcgccgccaucaaggacuccaaggccgugcacgccgacaugggcuacuggaucgagagcgagaagaacgagaccuggaagcucgcgcgggccuccuucaucgaggucaagaccugcaucuggcccaagagccacacgcugugguccaacggcgugcuggagagcgagaugaucauccccaagaucuacgggggcccgaucucccagcacaacuaccgccccggguacuucacccagaccgccggccccuggcaccucgggaagcuggagcuggacuucggccucugcgagggcaccacgguggucguggacgagcacugcgggaaccggggcccgagccugcgcaccaccaccgugacggggaagaucauccacgaguggugcugccgguccugcacccugccgccccugcgcuucaagggcgaggacgggugcugguacggcauggagauccggcccgucaaggagaaggaggagaaccuggucaagagcauggugagcgccggcuccggggaggucgacagcuucucccugggccuccugugcaucagcaucaugaucgaggaggugaugcgcucccgguggagccgcaagaugcugaugaccgggacccucgccguguucuuccugcugaucaugggccagcucacguggaacgaccugauccggcugugcaucauggucggggcgaacgccuccgaccgcaugggcaugggcaccaccuaccucgcccugauggccaccuucaagaugcgcccgauguucgccguggggcuccuguuccggcgccugacgagccgggaggugcugcuccugaccaucggccugucccucgucgcgagcguggagcugcccaacucccuggaggagcucggggacggccuggccaugggcaucaugauccugaagcuccugaccgacuuccagagccaccagcugugggccacccuccugucccugacguucaucaagaccaccuucagccuccacuacgccuggaagaccauggcgaugguccuguccaucgugagccuguucccccucugccuguccacgaccagccagaagaccaccuggcugcccgugcuccuggggucccugggcugcaagccgcucacgauguuccugaucgccgagaacaagaucugggggcgcaagagcuggccccugaacgagggcaucauggccgucgggaucgugagcauccuccuguccagccugcucaagaacgacgugccccuggccggcccccugaucgccggcgggaugcucaucgcgugcuacgucaucuccggcagcuccgccgaccugagccuggagaaggccgccgagguguccugggaggaggaggccgagcacagcggggcgucccacaacauccucguggagguccaggacgacggcaccaugaagaucaaggacgaggagcgggacgacacccugaccauccugcucaaggccacccugcuggccgugagcgggguguacccgcucuccauccccgccacgcuguucgucugguacuucuggcagaagaagaagcagcgcagcggcgugcugugggacacccccagcccgcccgagguggagcgggccguccucgacgacggcaucuaccgcaucaugcagcgggggcugcugggccgcagccaggugggggugggcgucuuccaggagaacguguuccacaccauguggcacgugacccgcggggcgguccugauguaccagggcaagcgccucgagcccuccugggccagcgugaagaaggaccugaucuccuacggcgggggcuggcggcugcaggggagcuggaacacgggcgaggaggugcaggucaucgccguggagcccgggaagaaccccaagaacgugcagaccgcccccggcaccuucaagaccuccgagggcgaggucggggccaucgcgcucgacuucaagcccggcacgagcgggagccccaucgugaaccgcgagggcaagaucgugggccuguacgggaacggcgucgugaccaccuccgggaccuacgugagcgccaucgcccaggccaaggcgucccaggagggcccccugccggagaucgaggacgaggucuuccggaagcgcaaccucacgaucauggaccugcaccccgggagcggcaagacccggcgcuaccugcccgccaucgugcgggaggccaucaagcgcaagcuccggacccugauccuggccccgacccgcguggucgccuccgagauggcggaggcccucaagggcaugcccauccgcuaccagacgaccgccgucaagagcgagcacaccgggaaggagaucguggaccugaugugccacgccaccuucacgaugcggcugcucucccccguccgcgugcccaacuacaacaugaucaucauggacgaggcccacuucaccgacccgagcuccaucgcggcccggggcuacaucagcacccgcguggggaugggcgaggccgccgccaucuucaugaccgcgacgccgcccggguccgucgaggccuucccccagagcaacgccgugauccaggacgaggagcgggacaucccggagcgcuccuggaacagcggcuacgaguggaucaccgacuuccccggcaagaccgugugguucguccccuccaucaagagcgggaacgacaucgccaacugccugcggaagaacggcaagcgcgugauccagcugucccggaagaccuucgacacggaguaccagaagaccaagaacaacgacugggacuacguggucaccaccgacaucagcgagaugggggcgaacuuccgcgccgaccgggugaucgacccccgccggugccucaagccggugauccugaaggacggccccgagcgcgucauccuggccgggcccaugcccgugacggucgccuccgccgcgcagcggcgcggccggaucggccgcaaccacaacaaggagggggaccaguacaucuacaugggccagccgcucaacaacgacgaggaccacgcccacuggaccgaggccaagaugcugcuggacaacaucaacacccccgaggggaucauccccgcccucuucgagcccgagcgggagaaguccgccgcgaucgacggcgaguaccgccugcgcggggaggcccggaagaccuucguggagcugaugcgccggggcgaccucccgguguggcugagcuacaaggucgccuccgagggcuuccaguacagcgaccgccgguggugcuucgacggggagcgcaacaaccaggugcuggaggagaacauggacguggagaucuggacgaaggagggcgagcggaagaagcuccgcccccgguggcuggacgcccgcaccuacuccgacccccuggcccuccgggaguucaaggaguucgcggccgggcgccggagcgucuccggcgaccugauccuggagaucggcaagcucccccagcaccugacccagcgcgcccagaacgcccuggacaaccucgugaugcugcacaacagcgagcagggcgggcgggcguaccgccacgccauggaggagcugccggacaccaucgagacgcucaugcugcuggcccucaucgccgugcugaccgggggcgucacccuguucuuccucuccgggcggggccugggcaagaccagcaucgggcugcucugcgugauggccuccagcgugcugcuguggauggcguccgucgagccccacuggaucgccgccagcaucauccucgaguucuuccugauggugcugcucauccccgagcccgaccgccagcggaccccgcaggacaaccagcuggccuacguggucaucggccuccucuucaugauccugacgguggccgcgaacgagauggggcugcucgagaccaccaagaaggaccugggcaucgggcacguggccgucgagaaccaccaccacgccgccaugcuggacguggaccuccaccccgccuccgcguggacccuguacgccguggccacgaccaucaucacccccaugaugcgccacaccaucgagaacacgaccgccaacaucagccugaccgccaucgcgaaccaggccgccauccucaugggccuggacaagggcuggccgaucuccaagauggacaucggggucccccugcucgcccugggcugcuacagccaggugaacccccugacccucacggcggccgugcugaugcuggucgcccacuacgccaucaucgggcccggccuccaggccaaggcgacccgggaggcccagaagcgcaccgccgccgggaucaugaagaacccgaccguggacggcaucguggccaucgaccuggaccccgucguguacgacgcgaaguucgagaagcagcugggccagaucaugcuccugauccugugcacgucccagauccuccugaugcgcaccaccugggcccugugcgagagcaucacccucgccacggggccccugaccacccugugggagggcucccccgggaaguucuggaacaccacgaucgccgugagcauggccaacaucuuccggggcagcuaccucgcgggcgccgggcuggccuucucccugaugaagucccucggcgggggccgccgggggaccggcgcccagggcgagacccugggggagaaguggaagcgccagcugaaccagcucuccaagagcgaguucaacaccuacaagcgguccggcaucauggaggucgaccgcagcgaggcgaaggaggggcugaagcggggcgagacgaccaagcacgccgugucccgcgggaccgccaagcugcggugguucguggagcgcaaccucgucaagccggagggcaaggugaucgaccugggcugcgggcggggcggguggagcuacuacugcgccggccugaagaaggugaccgaggucaagggguacacgaagggcggccccgggcacgaggagcccauccccauggccaccuacggcuggaaccuggugaagcuccacuccgggaaggacguguucuucaucccgcccgagaagugcgacacccugcugugcgacaucggcgagagcucccccaaccccaccaucgaggaggggcgcacgcuccggguccugaagaugguggagccguggcugcgcggcaaccaguucugcaucaagauccucaaccccuacaugcccagcguggucgagacccuggagcagaugcagcggaagcacggcgggaugcuggugcgcaacccccucucccggaacagcacccacgagauguacuggguguccugcggcaccgggaacaucgucagcgcggugaacaugaccucccgcaugcugcugaaccgguucacgauggcccaccgcaagccgaccuacgagcgcgacguggaccucggcgccggcacccggcacgucgccguggagcccgagguggccaaccuggacaucaucgggcagcgcaucgagaacaucaagcacgagcacaagagcaccuggcacuacgacgaggacaaccccuacaagacgugggcguaccacggcuccuacgaggucaagcccagcgggagcgccuccagcauggugaacggcgucgugaagcugcucaccaagccgugggacgugauccccauggucacccagaucgccaugaccgacacgacccccuucgggcagcagcggguguucaaggagaagguggacacccgcacccccaaggccaagcggggcacggcccagaucauggaggucaccgcgaaguggcuguggggcuuccugucccgcaacaagaagccgcggaucugcacccgcgaggaguucacccggaaggugcgcagcaacgccgccaucggggccguguucgucgacgagaaccaguggaacuccgcgaaggaggccguggaggacgagcgguucugggaccucgugcaccgcgagcgggagcugcacaagcagggcaagugcgccacgugcgucuacaacaugauggggaagcgcgagaagaagcugggcgaguucgggaaggccaagggcagccgggccaucugguacauguggcucggcgcgcgcuuccuggaguucgaggcccugggguucaugaacgaggaccacugguucucccgggagaacagccucuccggcguggagggggagggccugcacaagcugggguacauccuccgcgacaucagcaagauccccggcggcaacauguacgccgacgacaccgccgggugggacacccggaucaccgaggacgaccugcagaacgaggccaagaucacggacaucauggagcccgagcacgcgcugcucgccaaguccaucuucaagcugaccuaccagaacaaggugguccgcgugcagcggccggccaagaacggcaccgugauggacgucaucagccgccgcgaccagcggggguccggccaggugggcaccuacgggcugaacacguucaccaacauggaggcccagcucauccgccagauggagagcgagggcaucuucucccccagcgagcuggagacccccaaccuggccgggcgggugcucgacuggcuggagaagcacggcgucgagcgccugaagcggauggcgaucuccggggacgacugcguggugaagcccaucgacgaccgcuucgccaccgcccucacggcccugaacgacaugggcaagguccggaaggacaucccgcagugggagcccagcaagggcuggaacgacuggcagcagguccccuucugcagccaccacuuccaccagcugaucaugaaggacgggcgcgagaucgugguccccugccggaaccaggacgagcucgugggccgcgcccgggugucccagggggcgggcuggagccugcgcgagaccgccugccuggggaaguccuacgcccagauguggcagcucauguacuuccaccggcgcgaccugcggcuggccgcgaacgccaucugcagcgccgucccgguggacugggugcccaccucccgcaccacguggagcauccacgcccaccaccaguggaugaccaccgaggacaugcucuccgucuggaaccggguguggaucgaggagaaccccuggauggaggacaagacccacaucagcuccuggggcgacgugcccuaccugggcaagcgcgaggaccaguggugcgggagccugaucggccucacggcccgggcgaccugggccaccaacauccaggucgccaucaaccaggugcgccgccugaucgggaacgagaacuaccuggacuacaugaccuccaugaagcgguucaagaacgagagcgacccggagggcgcccucugguga

SEQ ID NO: 8428 - RNA, 9879 nt, Artificial Sequence
  derived and/or modified CDS sequence (opt1) from DENV-1__FJ410263__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaucaugaccuacaagugcccccgcaucaccgagaccgagcccgacgacguggacugcuggugcaacgccaccgacaccugggugaccuacgggaccugcagccagaccggcgagcaccggcgcgacaagcgguccguggcccucgcgccccacgugggccuggggcuggagacgcgcaccgagaccuggaugagcuccgagggcgccuggaagcagauccagcgggucgagaccugggcccuccgccaccccggguucacggugaucgcccuguuccuggcccacgcgaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgccgugcugcggaagcucugcaucgaggcgaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacaccggcgaccagcaccagguggggaacgaguccacggagcacggcaccaccgccaccaucacgccccaggcgcccacgaccgagauccagcucaccgacuacggggcccugacccuggacugcagcccccgcacgggccucgacuucaacgagaugguccugcugaccaugaaggagaaguccuggcucgugcacaagcagugguuccuggaccugccccuccccuggaccagcggggccagcaccucccaggagacguggaaccggcaggaccugcuggugaccuucaagaccgcccacgccaagaagcaggaggucguggugcucggcagccaggagggcgcgaugcacaccgcccugacgggggccaccgagauccagaccuccggcaccacgaccaucuucgccgggcaccugaagugccgccucaagauggacaagcugacccugaagggcaugagcuacgucaugugcaccggguccuucaagcucgagaaggagguggccgagacgcagcacggcaccgugcugguccagaucaaguacgagggcaccgacgcgcccugcaagauccccuucagcacccaggacgagaagggggugacgcagaacggccggcugaucaccgccaacccgaucgugaccgacaaggagaagcccgucaacaucgaggccgagccgcccuucggggaguccuacaucgugaucggcgccggcgagaaggcgcugaagcucagcugguucaagaagggguccagcaucggcaagauguucgaggccaccgcccgcggggcccggcgcauggccauccugggcgacacggcgugggacuucggguccaucggcggcguguucaccagcgucgggaagcuggugcaccagaucuucggcaccgccuacggggugcuguucuccggcgucagcuggaccaugaagaucgggaucggcgugcugcugacguggcucggccugaacucccgcagcaccucccugagcaugaccugcaucgccguggggcucgucacccuguaccugggcgugauggugcaggccgacuccgggugcgucaucaacuggaagggccgggagcucaagugcgggagcggcaucuucgugacgaacgaggugcacaccuggaccgagcaguacaaguuccaggccgacagcccgaagcgccuguccgcggccaucggcaaggccugggaggagggggucugcggcauccggagcgccacccgccuggagaacaucauguggaagcagaucuccaacgagcucaaccacauccugcuggagaacgacaugaaguucaccgugguggucggggacguggccggcauccucgcgcaggggaagaagaugauccggccccagcccauggaguacaaguacagcuggaaguccuggggcaaggccaagaucaucggcgccgacgugcagaacacgaccuucaucaucgacgggcccaacaccccggagugccccgacgaccagcgcgccuggaacaucugggaggucgaggacuacggcuucgggaucuucaccacgaacaucuggcugaagcugcgggacagcuacacccaggugugcgaccaccgccucauguccgcggccaucaaggacagcaaggccgugcacgccgacaugggcuacuggaucgaguccgagaagaacgagaccuggaagcuggcccgggcgagcuucaucgaggucaagaccugcaucuggcccaagucccacacgcuguggagcaacggcgugcucgaguccgagaugaucauccccaagaucuacgggggcccgaucagccagcacaacuaccgccccggguacuucacccaggccgccggccccuggcaccuggggaagcuggagcucgacuucgaccugugcgagggcaccaccguggucguggacgagcacugcggcaaccgggggccgucccugcgcacgaccaccgugaccggcaagaucauccacgaguggugcugccggagcugcacgcugccgccccuccgcuuccgcggggaggacggcugcugguacgggauggagauccgccccgucaaggagaaggaggagaaccuggugaaguccauggugagcgccggcagcggcgaggucgacuccuucagccucgggcugcugugcaucuccaucaugaucgaggaggugaugcggagccgcuggucccggcgcaugcucaugaccggcacccuggccguguucuuccugcucaucauggggcagcugaccuggaacgaccugauccgccucugcaucauggucggcgcgaacgccagcgaccggauggggaugggcacgaccuaccuggcccugauggccaccuucaagaugcgcccgauguucgccgugggccuccuguuccggcgccugaccucccgggaggugcuccugcugacgaucgggcucagccuggucgcguccguggagcugcccaacagccucgaggagcugggcgacgggcuggccaugggcaucaugauccucaagcugcugaccgacuuccagucccaccagcucugggccacccugcugagccucaccuucaucaagacgaccuucucccugcacuacgccuggaagaccauggcgaugguccugagcaucgugucccucuucccccugugccugagcaccacgucccagaagaccaccuggcuccccgugcugcugggcagccucgggugcaagccgcugaccauguuccugaucgccgagaacaagaucuggggccgccgguccuggccccucaacgaggggaucauggccgucggcaucgugagcauccugcugagcucccuccugaagaacgacgugccccuggccgggccccucaucgccggcggcaugcugaucgcgugcuacgucaucagcggguccagcgccgaccugucccucgagaaggccgccgaggugagcugggaggaggaggccgagcacuccggcgcgagccacaacauccugguggagguccaggacgacgggacgaugaagaucaaggacgaggagcgcgacgacacccugaccauccuccugaaggccacccugcucgccguguccggcguguacccgcugagcauccccgccacccuguucgucugguacuucuggcagaagaagaagcagcgguccggggugcucugggacacgcccagcccgcccgagguggagcgcgccguccuggacgacggcaucuaccggaucaugcagcgcggccugcuggggcggucccaggugggcgugggggucuuccaggagaacguguuccacaccauguggcacgugacccgcggcgcgguccucauguaccaggggaagcggcuggagcccagcugggccuccgugaagaaggaccugaucagcuacggcggcggguggcgccuccagggcuccuggaacaccggggaggaggugcaggucaucgccguggagcccggcaagaaccccaagaacgugcagacggcccccgggaccuucaagacccccgagggcgaggucggcgccaucgcgcuggacuucaagcccgggaccagcggcucccccaucgugaaccgggaggggaagaucgugggccuguacggcaacggggucgugacgaccagcggcaccuacgugagcgccaucgcccaggccaaggcgucccaggaggggccgcuccccgagaucgaggacgaggucuuccgcaagcggaaccugaccaucauggaccugcaccccggcagcgggaagacgcgccgguaccucccggccaucgugcgcgaggccaucaagcgcaagcugcggacccugauccucgcccccacccgcguggucgccuccgagauggcggaggcccugaagggcaugcccauccgguaccagaccacggccgucaagagcgagcacaccggcaaggagaucguggaccugaugugccacgccaccuucaccaugcgccuccugucccccguccgggugccgaacuacaacaugaucaucauggacgaggcccacuucacggaccccagcuccaucgcggcccgcggguacaucagcacccgggugggcaugggggaggccgccgccaucuucaugaccgcgacgccgcccggcuccgucgaggccuucccgcagagcaacgccgugauccaggacgaggagcgcgacauccccgagcgguccuggaacagcggguacgaguggaucacggacuuccccggcaagaccgugugguucguccccuccaucaagagcggcaacgacaucgccaacugccugcgcaagaacgggaagcgggugauccagcucucccgcaagaccuucgacaccgaguaccagaagacgaagaacaacgacugggacuacguggucaccaccgacaucagcgagaugggcgcgaacuuccgggccgaccgcgugaucgacccgcggcgcugccugaagcccgugauccugaaggacgggcccgagcgggucauccucgccggccccaugccggugaccgucgccuccgccgcgcagcgccgggggcgcaucggccgcaaccacaacaaggagggcgaccaguacaucuacauggggcagccccugaacaacgacgaggaccacgcccacuggacggaggccaagaugcugcucgacaacaucaacacccccgagggcaucauccccgcccuguucgagccggagcgggagaaguccgccgcgaucgacggggaguaccgccugcggggcgaggcccgcaagaccuucguggagcucaugcggcgcggggaccugcccguguggcuguccuacaaggucgccagcgagggcuuccaguacagcgaccggcgcuggugcuucgacggcgagcggaacaaccaggugcucgaggagaacauggacguggagaucuggaccaaggagggggagcgcaagaagcugcggccccgcuggcuggacgcccggacguacuccgacccccucgcccugcgcgaguucaaggaguucgcggccggccggcgcagcgucuccggggaccugauccucgagaucggcaagcugccgcagcaccugacccagcgggcccagaacgcccucgacaaccuggugaugcugcacaacagcgagcagggcgggcgcgcguaccggcacgccauggaggagcuccccgacaccaucgagacccugaugcugcucgcccugaucgccgugcugacgggcggggucacccucuucuuccuguccggccgcgggcugggcaagaccagcaucggccuccugugcgugauggccuccagcgugcugcucuggauggcguccgucgagccccacuggaucgccgccagcaucauccuggaguucuuccugauggugcuccugauccccgagccggaccggcagcgcacgccccaggacaaccagcuggccuacguggucaucgggcuccuguucaugauccugaccguggccgcgaacgagaugggccuccuggagacgaccaagaaggaccuggggaucggccacguggccgucgagaaccaccaccacgccgccaugcucgacguggaccugcaccccgccuccgcguggacccuguacgccguggccaccacgaucaucaccccgaugaugcgccacaccaucgagaacaccacggccaacaucagccucaccgccaucgcgaaccaggccgccauccugauggggcuggacaagggcuggcccaucuccaagauggacaucggcgucccccuccuggcccuggggugcuacagccaggugaacccccucacccugaccgcggccgugcugaugcucgucgcccacuacgccaucaucggcccggggcugcaggccaaggcgacgcgggaggcccagaagcgcaccgccgccggcaucaugaagaaccccaccguggacgggaucguggccaucgaccuggaccccgucguguacgacgcgaaguucgagaagcagcucggccagaucaugcugcugauccucugcaccucccagauccugcugaugcggacgaccugggcccucugcgagagcaucacccuggccaccggcccccugacgacccucugggagggguccccgggcaaguucuggaacaccaccaucgccgugagcauggccaacaucuuccgcggguccuaccuggcgggcgccggccuggccuucagccucaugaagucccucgggggcgggcggcgcgggacgggggcccagggcgagacccugggcgagaaguggaagcggcagcucaaccagcuguccaagagcgaguucaacaccuacaagcgcuccgggaucauggaggucgaccggagcgaggcgaaggagggccugaagcgcggggagaccacgaagcacgccgugucccggggcaccgccaagcuccgcugguucguggagcggaaccuggucaagcccgaggggaaggugaucgaccugggcugcggccgcgggggcuggagcuacuacugcgccgggcugaagaaggugaccgaggucaagggcuacaccaagggcggccccggccacgaggagcccaucccgauggccacguacggguggaaccucgugaagcugcacuccggcaaggacguguucuucaucccgcccgagaagugcgacacccugcucugcgacaucggggagagcucccccaacccgaccaucgaggagggccggacccugcgcguccugaagaugguggagcccuggcuccgggggaaccaguucugcaucaagauccugaaccccuacaugcccagcguggucgagacgcuggagcagaugcagcgcaagcacggcggcaugcucgugcggaacccgcugucccgcaacagcacccacgagauguacuggguguccugcgggaccggcaacaucgucagcgcggugaacaugaccucccgcaugcugcucaaccgguucaccauggcccaccgcaagcccacguacgagcgggacguggaccugggggccggcacccgccacgucgccguggagcccgagguggccaaccuggacaucaucggccagcggaucgagaacaucaagcacgagcacaagagcaccuggcacuacgacgaggacaaccccuacaagaccugggcguaccacggguccuacgaggucaagccgagcggcuccgccagcagcauggugaacggggucgugaagcuccugacgaagcccugggacgugauccccauggucacccagaucgccaugaccgacaccacgcccuucggccagcagcgcguguucaaggagaagguggacacccggaccccgaaggccaagcgcgggaccgcccagaucauggaggucacggcgaaguggcuguggggcuuccucucccggaacaagaagccccgcaucugcacccgggaggaguucacccgcaaggugcggagcaacgccgccaucggcgccguguucgucgacgagaaccaguggaacuccgcgaaggaggccguggaggacgagcgcuucugggaccuggugcaccgggagcgcgagcugcacaagcaggggaagugcgcgaccugcgucuacaacaugaugggcaagcgggagaagaagcucggggaguucggcaaggccaaggggagccgcgccaucugguacauguggcugggcgcgcgguuccuggaguucgaggcccucggcuucaugaacgaggaccacugguucucccgcgagaacagccuguccgggguggagggcgaggggcugcacaagcucggcuacauccugcgggacaucagcaagauccccgggggcaacauguacgccgacgacacggccggcugggacacccgcaucaccgaggacgaccugcagaacgaggcccgcaucaccgacaucauggagccggagcacgcgcuccuggccaaguccaucuucaagcugacguaccagaacaaggugguccgggugcagcgccccgccaagaacgggaccgugauggacgucaucagccggcgcgaccagcggggcuccggccagguggggaccuacggccucaacaccuucacgaacauggaggcccagcugauccgccagauggagagcgaggggaucuucucccccagcgagcuggagacccccaaccucgccgagcgggugcuggacuggcuggagaaguacggcgucgagcgccucaagcggauggcgaucuccggggacgacugcguggugaagccgaucgacgaccgcuucgccaccgcccugaccgcccugaacgacaugggcaagguccggaaggacaucccccagugggagcccagcaagggguggaacgacuggcagcagguccccuucugcucccaccacuuccaccagcucaucaugaaggacggccgcgagaucguggucccgugccggaaccaggacgagcuggugggccgcgcccgggugagccagggggcgggcuggagccugcgcgagacggccugccucgggaaguccuacgcccagauguggcagcugauguacuuccaccggcgcgaccugcggcucgccgcgaacgccaucugcagcgccguccccguggacuggauccccaccucccgcaccaccuggagcauccacgcccaccaccaguggaugacgaccgaggacaugcuguccguguggaaccgcgucuggaucgaggagaaccccuggauggaggacaagacccacaucagcuccuggggcgacgugccguaccuggggaagcgggaggaccaguggugcggcagccucaucggccugaccgcccgcgcgacgugggccaccaacauccagguggccaucaaccagguccggcgccugaucgggaacgagaacuaccucgacuacaugaccuccaugaagcgguucaagaacgagagcgaccccgagggcgcccugugguga

SEQ ID NO: 8429 - RNA, 9879 nt, Artificial Sequence
  derived and/or modified CDS sequence (opt1) from DENV-1__FJ410264__SS-prME
agcgugaccaugcugcucaugcugaugcccaccgcccuggccuuccaccucaccacccggggcggggagccccacaugaucgugaccaagcaggagcggggcaagagccugcuguucaagaccagcgccggggugaacaugugcacccucaucgccauggaccugggcgagcugugcgaggacaccaugaccuacaagugcccccggaucaccgaggccgagcccgacgacguggacugcuggugcaacgccacggacaccugggugaccuacgggaccugcagccagacgggcgagcaccggcgcgacaagcggagcguggcccucgcgccccacgugggccuggggcuggagacccgcaccgagaccuggauguccagcgagggcgccuggaagcagauccagcgggucgagacgugggcccuccgccaccccggguucaccgugaucgcccuguuccuggcgcacgccaucggcaccuccaucacccagaaggggaucaucuucauccuccugaugcuggugacgcccagcauggccaugcggugcgucggcaucggcucccgcgacuucguggaggggcucagcggcgccaccuggguggacgucgugcuggagcacggguccugcgugaccaccauggccaaggacaagcccacgcuggacaucgagcuccugaagaccgaggucaccaaccccgcggugcugcggaagcucugcaucgaggccaagaucagcaacaccacgaccgacucccgcugccccacccagggcgaggccacccugauggaggagcaggacgccaacuucgugugccggcgcacguucgucgaccggggcugggggaacggcugcgggcuguucggcaaggggagccucaucacgugcgccaaguucaagugcgugaccaagcuggagggcaagaucgugcaguacgagaaccugaaguacuccgucaucgugaccgugcacacgggcgaccagcaccaggucgggaacgagagcaccgagcacggcaccaccgcgaccaucacgccccaggcccccaccuccgagauccagcucaccgacuacggggcccugacccuggacugcagcccccgcacgggccucgacuucaacgagauggugcugcugaccaugaaggagaaguccuggcucguccacaagcagugguuccuggaccugccgcuccccuggaccagcggggccagcaccucccaggagacguggaaccggcaggaccugcuggugaccuucaagaccgcccacgcgaagaagcaggagguggucgugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgugaugugcaccggguccuucaagcucgagaaggaggucgcggagacgcagcacggcaccgugcuggugcagaucaaguacgagggcaccgacgcccccugcaagauccccuucagcacccaggacgagaagggggucauccagaacggccggcugaucacggccaacccgaucgugaccgacaaggagaagcccgugaacaucgaggccgagccgcccuucggggaguccuacaucgucaucggcgcgggcgagaaggcccugaagcucagcugguucaagaagggguccagcaucggcaagauguucgaggccaccgcccgcggggcccggcgcauggcgauccugggcgacaccgccugggacuucggguccgugggcggcguguucacgagcgucgggaagcuggugcaccagaucuucggcaccgccuacgggguccuguucuccggcgucagcuggaccaugaagaucgggaucggcgugcugcugaccuggcucggccugaacucccgcagcacgucccugagcaugaccugcaucgccguggggcucgucacccuguaccugggcgugauggugcaggccgacuccgggugcgucaucaacuggaagggccgggagcucaagugcgggagcggcaucuucgugaccaacgaggugcacacguggaccgagcaguacaaguuccaggcggacagcccgaagcgccuguccgccgccaucggcaaggccugggaggagggggucugcggcauccggagcgccacccgccuggagaacaucauguggaagcagaucuccaacgagcucaaccacauccugcuggagaacgacaugaaguucaccgugguggucggggacguggugggcauccucgcgcaggggaagaagaugauccggccccagcccauggagcacaaguacagcuggaaguccuggggcaaggccaagaucaucggcgccgacguccagaacaccacguucaucaucgacgggcccaacaccccggagugccccgacgaccagcgcgccuggaacaucugggagguggaggacuacggcuucgggaucuucaccaccaacaucuggcugaagcugcgggacagcuacacccaggugugcgaccaccgccucauguccgcggccaucaaggacagcaaggccguccacgccgacaugggcuacuggaucgaguccgagaagaacgagaccuggaagcuggcccgggcgagcuucaucgaggugaagaccugcaucuggcccaagucccacacccuguggagcaacggcgugcucgaguccgagaugaucauccccaagaucuacgggggcccgaucagccagcacaacuaccgccccggguacuucacgcagaccgccggccccuggcaccuggggaagcuggagcucgacuucgaccugugcgagggcaccaccgucgugguggacgagcacugcggcaaccgggggccgucccugcgcacgaccaccgucaccggcaagaucauccacgaguggugcugccggagcugcacgcugccgccccuccgcuucaagggggaggacggcugcugguacgggauggagauccggcccgugaaggagaaggaggagaaccuggugaaguccauggucagcgccggcagcggcgagguggacuccuucagccucgggcugcugugcaucuccaucaugaucgaggaggugaugcgcagccgguggucccgcaagaugcucaugaccggcacccuggccgucuuccugcuccugaucauggggcagcugaccuggaacgaccucauccggcugugcaucauggugggcgccaacgcgagcgaccgcauggggaugggcacgaccuaccuggcccucauggccaccuucaagaugcgcccgauguucgccguggggcugcuguuccggcgccucaccucccgggagguccugcugcucacgaucgggcugagccugguggccuccgucgagcuccccaacagccuggaggagcugggcgacgggcucgcgaugggcaucaugauccugaagcugcucaccgacuuccagucccaccagcugugggccacccugcucagccugaccuucaucaagacgacccugucccuccacuacgccuggaagaccauggccauggugcugagcaucgugucccuguucccccucugccugagcaccacgucccagaagaccaccuggcugcccguccuccugggcagccuggggugcaagccgcucaccauguuccugaucacggagaacaagaucuggggccgcaaguccuggccccugaacgaggggaucauggcggugggcguggucagcauccuccugagcucccugcucaagaacgacgugccccuggccgggccccugaucgccggcggcaugcucaucgccugcuacgugaucagcggguccagcgccgaccugucccuggagaaggcggccgaggucagcugggaggaggaggccgagcacuccggcgccagccacaacauccucguggaggugcaggacgacgggaccaugaagaucaaggacgaggagcgggacgacacccugaccauccugcucaaggccacccugcuggcggucuccggcguguacccgcucagcauccccgccacgcuguucgugugguacuucuggcagaagaagaagcagcgcuccgggguccugugggacacccccagcccgcccgagguggagcgggccgugcuggacgacggcaucuaccgcaucaugcagcggggccuccuggggcgcucccaggucggcguggggguguuccaggagaacgucuuccacaccauguggcacgugacccggggcgccgugcugauguaccaggggaagcgccucgagcccagcugggccuccgucaagaaggaccugaucagcuacggcggcggguggcggcugcagggcuccuggaacacgggggaggagguccaggugaucgcggucgagcccggcaagaaccccaagaacgugcagaccgcccccgggaccuucaagacccccgagggcgaggugggcgccaucgcccucgacuucaagcccgggacgagcggcucccccaucgucaaccgcgaggggaagaucgugggccuguacggcaacgggguggucaccaccagcggcaccuacgugagcgccaucgcgcaggccaaggccucccaggaggggccgcugcccgagaucgaggacgagguguuccggaagcgcaaccucacgaucauggaccugcaccccggcagcgggaagacccggcgcuaccugccggccaucguccgggaggcgaucaagcgcaagcuccggacccugauccuggcccccacccgcgugguggccuccgagauggccgaggcccucaagggcaugcccauccgcuaccagacgaccgcggucaagagcgagcacaccggcaaggagaucguggaccugaugugccacgccaccuucacgaugcggcugcucucccccgugcgcgucccgaacuacaacaugaucaucauggacgaggcccacuucaccgaccccagcuccaucgccgcccggggguacaucagcacccgcgugggcaugggggaggcggccgccaucuucaugaccgccacgccgcccggcuccguggaggccuucccgcagagcaacgcggucauccaggacgaggagcgggacauccccgagcgcuccuggaacagcggguacgaguggaucaccgacuuccccggcaagaccgugugguucgugcccuccaucaagagcggcaacgacaucgccaacugccugcggaagaacgggaagcgcgucauccagcugucccggaagaccuucgacacggaguaccagaagaccaagaacaacgacugggacuacguggugaccaccgacaucagcgagaugggcgccaacuuccgcgccgaccgggucaucgacccgcgccggugccucaagcccgugauccugaaggacgggcccgagcgcgucauccuggcgggccccaugccggugacgguggccuccgccgcccagcggcgcgggcggaucggccgcaaccacaacaaggagggcgaccaguacaucuacauggggcagccccucaacaacgacgaggaccacgcccacuggaccgaggcgaagaugcugcuggacaacaucaacacccccgagggcaucauccccgcccucuucgagccggagcgggagaaguccgccgccaucgacggggaguaccgccugcgcggcgaggcccggaagaccuucgucgagcugaugcgccgcggggaccuccccguguggcuguccuacaagguggcgagcgagggcuuccaguacagcgaccgccgguggugcuucgacggcgagcgcaacaaccagguccuggaggagaacauggacguggagaucuggacgaaggagggggagcggaagaagcuccgcccccgguggcuggacgcccgcaccuacuccgacccccuggcccuccgggaguucaaggaguucgccgccggccgccggagcguguccggggaccugauccuggagaucggcaagcucccgcagcaccugacccagcgcgcgcagaacgcccuggacaaccucgucaugcugcacaacagcgagcagggcgggcgggccuaccgccacgccauggaggagcugcccgacaccaucgagacgcucaugcugcuggcgcucaucgccgugcugaccggcggggugacccuguucuuccucuccggccgggggcugggcaagaccagcaucggccugcucugcgucauggccuccagcgugcugcuguggauggccuccguggagccccacuggaucgccgcgagcaucauccucgaguucuuccugaugguccugcucauccccgagccggaccgccagcggacgccccaggacaaccagcuggccuacguggugaucgggcuccucuucaugauccugacggucgccgccaacgagaugggccugcucgagaccaccaagaaggaccuggggaucggccacguggccguggagaaccaccaccacgcgaccaugcuggacgucgaccuccaccccgccuccgccuggacgcuguacgccguggccaccaccaucaucaccccgaugaugcgccacacgaucgagaacaccaccgcgaacaucagccugaccgccaucgccaaccaggccgccauccucauggggcuggacaagggcuggcccaucuccaagauggacaucggcgugccccugcucgcgcuggggugcuacagccaggucaacccccugacgcucaccgccgccgugcugaugcugguggcccacuacgcgaucaucggcccggggcuccaggccaaggccacccgggaggcccagaagcgcaccgccgcgggcaucaugaagaaccccacggucgacgggaucguggccaucgaccuggaccccguggucuacgacgccaaguucgagaagcagcugggccagaucaugcuccugauccugugcaccucccagauccuccugaugcgcaccaccugggcccugugcgagagcaucacgcucgccaccggcccccugaccacccugugggagggguccccgggcaaguucuggaacacgaccaucgcggugagcauggccaacaucuuccggggguccuaccucgccggcgccggccuggccuucagccugaugaagucccucgggggcgggcgccggggcaccggggcgcagggcgagacccugggcgagaaguggaagcgccagcugaaccagcucuccaagagcgaguucaacaucuacaagcgguccgggaucauggagguggaccgcagcgaggccaaggagggccugaagcgcggggagacgacccgccacgccgucucccggggcaccgccaagcugcgcugguucguggagcggaaccuggugaagcccgaggggaaggucaucgaccucggcugcggccgcgggggcuggagcuacuacugcgcggggcugaagaaggugaccgaggugaagggcuacacgaagggcgggcccggccacgaggagcccaucccgauggccaccuacggguggaaccuggucaagcuccacuccggcaaggacguguucuucacgccgcccgagaagugcgacacccugcugugcgacaucggggagagcucccccaacccgacgaucgaggagggccggacccuccgcgugcugaagauggucgagcccuggcugcgggggaaccaguucugcaucaagauccucaaccccuacaugcccagcgugguggagacccuggagcagaugcagcgcaagcacggcggcaugcugguccggaacccgcucucccgcaacagcacccacgagauguacuggguguccugcgggaccggcaacaucgugagcgccgucaacaugacgucccggaugcugcugaaccgcuucaccauggcccaccgcaagcccaccuacgagcgggacguggaccucggggccggcacccgccacguggcggucgagcccgagguggccaaccuggacaucaucggccagcggaucgagaacaucaagcacgagcacaagagcacguggcacuacgacgaggacaaccccuacaagaccugggccuaccacggguccuacgaggucaagccgagcggcuccgccagcagcauggugaacgggguggucaagcugcucaccaagcccugggacgugauccccauggugacccagaucgccaugacggacaccacccccuucggccagcagcgcgucuucaaggagaagguggacacccggacgccgaaggcgaagcgcgggaccgcccagaucauggaggugaccgcccgguggcuguggggcuuccugucccgcaacaagaagccccggaucugcacccgcgaggaguucacgcggaagguccgcagcaacgccgccaucggcgcgguguucguggacgagaaccaguggaacuccgccaaggaggccgucgaggacgagcgguucugggaccucgugcagaaggagcgcgagcugcacaagcaggggaagugcgcgaccugcguguacaacaugaugggcaagcgggagaagaagcugggggaguucggcaaggcgaaggggagccgcgccaucugguacauguggcucggcgcccgguuccuggaguucgaggcccugggcuucaugaacgaggaccacugguucucccgcgagaacagccucuccggggucgagggcgaggggcugcacaagcugggcuacauccuccgggacaucagcaagauccccgggggcaacauguacgccgacgacaccgcgggcugggacacccgcaucacggaggacgaccugcagaacgaggccaagaucaccgacaucauggagccggagcacgcccugcucgccaccuccaucuucaagcugaccuaccagaacaagguggugcggguccagcgccccgccaagaacgggacggugauggacgugaucagccgccgggaccagcgcggcuccgggcaggucggcaccuacggccugaacaccuucaccaacauggaggcgcagcucauccggcagauggagagcgaggggaucuuccugcccuccgagcuggagacgcccaaccucgccgagcgcgugcuggacuggcuggagaaguacggcguggagcggcucaagcgcauggccaucagcggggacgacugcgucgugaagccgaucgacgaccgguucgccaccgcccugaccgcgcugaacgacaugggcaaggugcgcaaggacaucccccagugggagcccuccaagggguggaacgacuggcagcagguccccuucugcagccaccacuuccaccagcucaucaugaaggacggccgggagaucguggugccgugccgcaaccaggacgagcuggucggccgggcccgcgugucccagggggccggcuggagccugcgggagaccgccugccucggcaagagcuacgcccagauguggcagcugauguacuuccaccgccgggaccugcgccucgcggccaacgccaucugcuccgccgugcccgucgacugggugcccacgagccggaccaccugguccauccacgcgcaccaccaguggaugaccacggaggacaugcugagcguguggaaccgcgucuggaucgaggagaaccccuggauggaggacaagacccacguguccagcuggggcgacgugccguaccuggggaagcgggaggaccaguggugcggcucccucaucggccugaccgcccgcgccaccugggccagcaacauccaggucgccaucaaccaggugcgccggcugaucgggaacgagaacuaccucgacuacaugaccuccaugaagcgcuucaagaacgagggcgaccccgagggggcgcugugguga

SEQ ID NO: 8430 - RNA, 9879 nt, Artificial Sequence
  derived and/or modified CDS sequence (opt1) from DENV-1__FJ410265__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccgcaucaccgagaccgagcccgacgacguggacugcuggugcaacgccacggacaccugggucaccuacgggaccugcagccagacgggcgagcaccggcgcgacaagcgguccguggcccucgcgccccacgugggccuggggcuggagacccgcaccgagaccuggaugagcuccgagggcgccuggaagcagauccagcgggucgagacgugggcccuccgccaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagguggccgagacccagcacggcaccgugcugguccagaucaaguacgagggcaccgacgcgcccugcaagauccccuucagcacgcaggacgagaagggggugacccagaacggccggcugaucaccgccaacccgaucgugaccgacaaggagaagcccgucaacaucgaggccgagccgcccuucggggaguccuacaucgugaucggcgccggcgagaaggcgcugaagcucagcugguucaagaagggguccagcaucggcaagauguucgaggccacggcccgcggggcccggcgcauggccauccugggcgacaccgcgugggacuucggguccaucggcggcguguucaccagcgucgggaagcuggugcaccagaucuucggcaccgccuacggggugcuguucuccggcgucagcuggacgaugaagaucgggaucggcgugcugcugaccuggcucggccugaacucccgcagcaccucccugagcaugaccugcaucgccguggggcucgucacgcuguaccugggcgugauggugcaggccgacuccgggugcgucaucaacuggaagggccgggagcucaagugcgggagcggcaucuucgugaccaacgaggugcacaccuggaccgagcaguacaaguuccaggccgacagcccgaagcgccuguccgcggccaucggcaaggccugggaggagggggucugcggcauccggagcgccacccgccuggagaacaucauguggaagcagaucuccaacgagcucaaccacauccugcuggagaacgacaugaaguucacggugguggucggggacguggccggcauccucgcgcaggggaagaagaugauccggccccagcccauggaguacaaguacagcuggaaguccuggggcaaggccaagaucaucggcgccgacgugcagaacaccaccuucaucaucgacgggcccaacaccccggagugccccgacgaccagcgcgccuggaacaucugggaggucgaggacuacggcuucgggaucuucacgaccaacaucuggcugaagcugcgggacagcuacacccaggugugcgaccaccgccucauguccgcggccaucaaggacagcaaggccgugcacgccgacaugggcuacuggaucgaguccgagaagaacgagaccuggaagcuggcccgggcgagcuucaucgaggucaagacgugcaucuggcccaagucccacacccuguggagcaacggcgugcucgaguccgagaugaucauccccaagaucuacgggggcccgaucagccagcacaacuaccgccccggguacuucacccaggccgccggccccuggcaccuggggaagcuggagcucgacuucgaccugugcgagggcaccacgguggucguggacgagcacugcggcaaccgggggccgucccugcgcaccaccaccgugacgggcaagaucauccacgaguggugcugccggagcugcacccugccgccccuccgcuuccgcggggaggacggcugcugguacgggauggagauccgccccgucaaggagaaggaggagaaccuggugaaguccauggugagcgccggcagcggcgaggucgacuccuucagccucgggcugcugugcaccuccaucaugaucgaggaggugaugcggagccgcuggucccggcgcaugcucaugaccggcacgcuggccguguucuuccugcucaucauggggcagcugaccuggaacgaccugauccgccucugcaucauggucggcgcgaacgccagcgaccggauggggaugggcaccaccuaccuggcccugauggccacguucaagaugcgcccgauguucgccgugggccuccuguuccggcgccugaccucccgggaggugcuccugcugaccaucgggcucagccuggucgcguccguggagcugcccaacagccucgaggagcugggcgacgggcuggccaugggcaucaugauccucaagcugcugaccgacuuccagucccaccagcucugggccacgcugcugagccucaccuucaucaagaccaccuucucccugcacuacgccuggaagacgauggcgaugguccugagcaucgugucccucuucccccugugccugagcaccaccucccagaagaccacguggcuccccgugcugcugggcagccucgggugcaagccgcugaccauguuccugaucgccgagaacaagaucuggggccgccgguccuggccccucaacgaggggaucauggccgucggcaucgugagcauccugcugagcucccuccugaagaacgacgugccccuggccgggccccucaucgccggcggcaugcugaucgcgugcuacgucaucagcggguccagcgccgaccugucccucgagaaggccgccgaggugagcugggaggaggaggccgagcacuccggcgcgagccacaacauccugguggagguccaggacgacgggaccaugaagaucaaggacgaggagcgcgacgacacccugaccauccuccugaaggccacgcugcucgccguguccggcguguacccgcugagcauccccgccacccuguucgucugguacuucuggcagaagaagaagcagcgguccggggugcucugggacacccccagcccgcccgagguggagcgcgccguccuggacgacggcaucuaccggaucaugcagcgcggccugcuggggcggucccaggugggcgugggggucuuccaggagaacguguuccacaccauguggcacgugacgcgcggcgcgguccucauguaccaggggaagcggcuggagcccagcugggccuccgugaagaaggaccugaucagcuacggcggcggguggcgccuccagggcuccuggaacaccggggaggaggugcaggucaucgccguggagcccggcaagaaccccaagaacgugcagaccgcccccgggaccuucaagacgcccgagggcgaggucggcgccaucgcgcuggacuucaagcccgggaccagcggcucccccaucgugaaccgggaggggaagaucgugggccuguacggcaacggggucgugaccaccagcggcacguacgugagcgccaucgcccaggccaaggcgucccaggaggggccgcuccccgagaucgaggacgaggucuuccgcaagcggaaccugaccaucauggaccugcaccccggcagcgggaagacccgccgguaccucccggccaucgugcgcgaggccaucaagcgcaagcugcggacccugauccucgcccccacgcgcguggucgccuccgagauggcggaggcccugaagggcaugcccauccgguaccagaccaccgccgucaagagcgagcacaccggcaaggagaucguggaccugaugugccacgccacguucaccaugcgccuccugucccccguccgggugccgaacuacaacaugaucaucauggacgaggcccacuucaccgaccccagcuccaucgcggcccgcggguacaucagcacccgggugggcaugggggaggccgccgccaucuucaugacggcgacgccgcccggcuccgucgaggccuucccgcagagcaacgccgugauccaggacgaggagcgcgacauccccgagcgguccuggaacagcggguacgaguggaucaccgacuuccccggcaagaccgugugguucguccccuccaucaagagcggcaacgacaucgccaacugccugcgcaagaacgggaagcgggugauccagcucucccgcaagacguucgacaccgaguaccagaagaccaagaacaacgacugggacuacguggucaccacggacaucagcgagaugggcgcgaacuuccgggccgaccgcgugaucgacccgcggcgcugccugaagcccgugauccugaaggacgggcccgagcgggucauccucgccggccccaugccggugaccgucgccuccgccgcgcagcgccgggggcgcaucggccgcaaccacaacaaggagggcgaccaguacaucuacauggggcagccccugaacaacgacgaggaccacgcccacuggaccgaggccaagaugcugcucgacaacaucaacacccccgagggcaucauccccgcccuguucgagccggagcgggagaaguccgccgcgaucgacggggaguaccgccugcggggcgaggcccgcaagacguucguggagcucaugcggcgcggggaccugcccguguggcuguccuacaaggucgccagcgagggcuuccaguacagcgaccggcgcuggugcuucgacggcgagcggaacaaccaggugcucgaggagaacauggacguggagaucuggaccaaggagggggagcgcaagaagcugcggccccgcuggcuggacgcccggaccuacuccgacccccucgcccugcgcgaguucaaggaguucgcggccggccggcgcagcgucuccggggaccugauccucgagaucggcaagcugccgcagcaccugacccagcgggcccagaacgcccucgacaaccuggugaugcugcacaacagcgagcagggcgggcgcgcguaccggcacgccauggaggagcuccccgacacgaucgagacccugaugcugcucgcccugaucgccgugcugaccggcggggucacccucuucuuccuguccggccgcgggcugggcaagaccagcaucggccuccugugcgugauggccuccagcgugcugcucuggauggcguccgucgagccccacuggaucgccgccagcaucauccuggaguucuuccugauggugcuccugauccccgagccggaccggcagcgcacgccccaggacaaccagcuggccuacguggucaucgggcuccuguucaugauccugaccguggccgcgaacgagaugggccuccuggagaccaccaagaaggaccuggggaucggccacguggccgucgagaaccaccaccacgccgccaugcucgacguggaccugcaccccgccuccgcguggacgcuguacgccguggccaccaccaucaucaccccgaugaugcgccacacgaucgagaacaccaccgccaacaucagccucaccgccaucgcgaaccaggccgccauccugauggggcuggacaagggcuggcccaucuccaagauggacaucggcgucccccuccuggcccuggggugcuacagccaggugaacccccucacgcugaccgcggccgugcugaugcucgucgcccacuacgccaucaucggcccggggcugcaggccaaggcgacccgggaggcccagaagcgcaccgccgccggcaucaugaagaaccccacgguggacgggaucguggccaucgaccuggaccccgucguguacgacgcgaaguucgagaagcagcucggccagaucaugcugcugauccucugcaccucccagauccugcugaugcggaccaccugggcccucugcgagagcaucacgcuggccaccggcccccugaccacccucugggagggguccccgggcaaguucuggaacacgaccaucgccgugagcauggccaacaucuuccgcggguccuaccuggcgggcgccggccuggccuucagccucaugaagucccucgggggcgggcggcgcgggaccggggcccagggcgagacccugggcgagaaguggaagcggcagcucaaccagcuguccaagagcgaguucaacacguacaagcgcuccgggaucauggaggucgaccggagcgaggcgaaggagggccugaagcgcggggagaccaccaagcacgccgugucccggggcaccgccaagcuccgcugguucguggagcggaaccuggucaagcccgaggggaaggugaucgaccugggcugcggccgcgggggcuggagcuacuacugcgccgggcugaagaaggugacggaggucaagggcuacaccaagggcggccccggccacgaggagcccaucccgauggccaccuacggguggaaccucgugaagcugcacuccggcaaggacguguucuucaucccgcccgagaagugcgacacccugcucugcgacaucggggagagcucccccaacccgacgaucgaggagggccggacccugcgcguccugaagaugguggagcccuggcuccgggggaaccaguucugcaucaagauccugaaccccuacaugcccagcguggucgagacccuggagcagaugcagcgcaagcacggcggcaugcucgugcggaacccgcugucccgcaacagcacccacgagauguacuggguguccugcgggaccggcaacaucgucagcgcggugaacaugacgucccgcaugcugcucaaccgguucaccauggcccaccgcaagcccaccuacgagcgggacguggaccugggggccggcacccgccacgucgccguggagcccgagguggccaaccuggacaucaucggccagcggaucgagaacaucaagcacgagcacaagagcacguggcacuacgacgaggacaaccccuacaagaccugggcguaccacggguccuacgaggucaagccgagcggcuccgccagcagcauggugaacggggucgugaagcuccugaccaagcccugggacgugauccccauggucacccagaucgccaugacggacaccacccccuucggccagcagcgcguguucaaggagaagguggacacccggacgccgaaggccaagcgcgggaccgcccagaucauggaggucaccgcgaaguggcuguggggcuuccucucccggaacaagaagccccgcaucugcacccgggaggaguucacgcgcaaggugcggagcaacgccgccaucggcgccguguucgucgacgagaaccaguggaacuccgcgaaggaggccguggaggacgagcgcuucugggaccuggugcaccgggagcgcgagcugcacaagcaggggaagugcgcgaccugcgucuacaacaugaugggcaagcgggagaagaagcucggggaguucggcaaggccaaggggagccgcgccaucugguacauguggcugggcgcgcgguuccuggaguucgaggcccucggcuucaugaacgaggaccacugguucucccgcgagaacagccuguccgggguggagggcgaggggcugcacaagcucggcuacauccugcgggacaucagcaagauccccgggggcaacauguacgccgacgacaccgccggcugggacacccgcaucacggaggacgaccugcagaacgaggccaagaucaccgacaucauggagccggagcacgcgcuccuggccaaguccaucuucaagcugaccuaccagaacaaggugguccgcgugcagcggcccgccaagaacgggaccgugauggacgucaucagccgccgggaccagcgcggcuccggccagguggggacguacggccucaacaccuucaccaacauggaggcccagcugauccggcagauggagagcgaggggaucuucucccccagcgagcuggagacccccaaccucgccgagcgcgcgcuggacuggcuggagaaguacggcguggagcggcucaagcgcauggccaucuccggggacgacugcgucgugaagccgaucgacgaccgguucgccacggcccugaccgcccugaacgacaugggcaaggugcgcaaggacaucccccagugggagcccagcaagggguggaacgacuggcagcagguccccuucugcucccaccacuuccaccagcucaucaugaaggacggccgggagaucguggugccgugccgcaaccaggacgagcuggucggccgggcgcgcgugagccagggggccggcuggagccugcgggagaccgccugccucgggaaguccuacgcccagauguggcagcugauguacuuccaccgccgggaccugcgccucgcggccaacgccaucugcagcgccgugcccgucgacuggauccccaccucccggacgaccuggagcauccacgcccaccaccaguggaugaccaccgaggacaugcuguccguguggaaccgcguguggaucgaggagaaccccuggauggaggacaagacgcacaucagcuccuggggcgacgucccguaccuggggaagcgcgaggaccaguggugcggcagccucaucggccugaccgcgcgggccaccugggccaccaacauccagguggccaucaaccaggugcgccggcugaucgggaacgagaacuaccucgacuacaugaccuccaugaagcgcuucaagaacgagagcgaccccgagggcgcccugugguga

SEQ ID NO: 8431 - RNA, 9879 nt, Artificial Sequence
  derived and/or modified CDS sequence (opt1) from DENV-1__FJ461336__SS-prME
agcgugaccaugcugcucaugcugaugcccaccgcccuggccuuccaccucaccacccggggcggggagccccacaugaucgugagcaagcaggagcggggcaagagccugcuguucaagaccuccgccggggugaacaugugcacccucaucgccauggaccugggcgagcugugcgaggacaccaugaccuacaagugcccccgcaucaccgagaccgagcccgacgacguggacugcuggugcaacgccacggacaccugggugaccuacgggaccugcagccagacgggcgagcaccggcgcgacaagcgguccguggcccucgcgccccacgugggccuggggcuggagacccgcaccgagaccuggaugagcuccgagggcgcguggaagcagauccagcgggucgagacgugggcccuccgccaccccggguucaccgugaucgcccuguuccuggcccacgcgaucggcaccagcaucacccagaaggggaucaucuucauccuccugaugcuggugacgcccuccauggccaugcggugcgucggcaucggcaaccgcgacuucguggaggggcucagcggcgccaccuggguggacgucgugcuggagcacggguccugcgugaccaccauggccaaggacaagcccacgcuggacaucgagcuccugaagaccgaggucaccaaccccgccgugcugcggaagcucugcaucgaggcgaagaucagcaacaccacgaccgacucccgcugcccgacccagggcgaggccacccugguggaggagcaggacgccaacuucgucugccggcgcacguucguggaccggggcugggggaacggcugcgggcuguucggcaaggggagccucaucacgugcgccaaguucaagugcgugaccaagcuggagggcaagaucguccaguacgagaaccugaaguacuccgugaucgugaccguccacacgggcgaccagcaccagguggggaacgagagcaccgagcacggcaccaccgccaccaucacgccccaggcgcccaccaccgagauccagcucaccgacuacggggcccugacgcuggacugcagcccccggaccggccucgacuucaacgagaugguccugcugaccaugaaggagaaguccuggcucgugcacaagcagugguuccuggaccugccccuccccuggaccuccggggccagcacgagccaggagaccuggaaccggcaggaccugcuggugaccuucaagaccgcccacgccaagaagcaggaggucguggugcucggcucccaggagggcgcgaugcacacggcccugaccggggccaccgagauccagaccagcggcacgaccaccaucuucgccgggcaccugaagugccgccucaagauggacaagcugacccugaagggcauguccuacgucaugugcacggggagcuucaagcucgagaaggagguggccgagacccagcacggcaccgugcugguccagaucaaguacgagggcaccgacgcgcccugcaagauccccuucuccacgcaggacgagaagggggugacccagaacggccggcugaucaccgccaacccgaucgugaccgacaaggagaagcccgucaacaucgaggccgagccgcccuucggggagagcuacaucgugaucggcgccggcgagaaggcgcugaagcucuccugguucaagaaggggagcuccaucggcaagauguucgaggccacggcccgcggggcccggcgcauggccauccugggcgacaccgcgugggacuucgggagcaucggcggcgugcugaccuccgucgggaagcucgugcaccagaucuucggcaccgccuacggggugcuguucagcggcgucuccuggacgaugaagaucgggaucggcgugcugcucaccuggcugggccugaacagccgcuccaccagccucuccaugaccugcaucgccguggggcuggucacgcuguaccucggcgugauggugcaggccgacagcgggugcgucaucaacuggaagggccgggagcugaagugcggguccggcaucuucgugaccaacgaggugcacaccuggaccgagcaguacaaguuccaggccgacagcccgaagcgccugagcgcggccaucggcaaggccugggaggagggggucugcggcauccgguccgccacccgccucgagaacaucauguggaagcagaucagcaacgagcugaaccacauccugcucgagaacgacaugaaguucacggugguggucggggacguggccggcauccuggcgcaggggaagaagaugauccggccccagcccauggaguacaaguacuccuggaaguccuggggcaaggccaagaucaucggcgccgacgugcagaacaccaccuucaucaucgacgggcccaacaccccggagugccccgacgaccagcgcgccuggaacaucugggaggucgaggacuacggcuucgggaucuucacgaccaacaucuggcugaagcuccgggacuccuacacccaggugugcgaccaccgccugaugagcgcggccaucaaggacuccaaggccgugcacgccgacaugggcuacuggaucgagagcgagaagaacgagaccuggaagcuggcccgggcguccuucaucgaggucaagacgugcaucuggcccaagagccacacccucugguccaacggcgugcuggagagcgagaugaucauccccaagaucuacgggggcccgaucucccagcacaacuaccgccccggguacuucacccagaccgccggccccuggcaccuggggaagcucgagcuggacuucgaccugugcgagggcacgaccguggucguggacgagcacugcggcaaccgggggccgagccuccgcaccaccacggugaccggcaagaucauccacgaguggugcugccgguccugcacccugccgccccugcgcuuccgcggggaggacggcugcugguacgggauggagauccgccccgucaaggagaaggaggagaaccucgucaagagcaugguguccgccggcagcggcgaggucgacagcuucucccuggggcugcucugcaucagcaucaugaucgaggaggugaugcggucccgcuggagccggaagaugcugaugaccggcacgcuggccguguucuuccuccugaucauggggcagcugaccuggaacgaccucauccgccugugcaucauggucggcgccaacgcguccgaccgcauggggaugggcaccaccuaccuggcccucauggccacguucaagaugcggccgauguucgccguggggcugcuguuccgccggcucaccagccgcgaggugcugcugcucaccaucgggcugucccuggucgccagcguggagcuccccaacucccuggaggagcugggcgacgggcucgcgaugggcaucaugauccugaagcugcucaccgacuuccagagccaccagcugugggccacgcugcucucccugaccuucaucaagaccaccuucagccugcacuacgccuggaagacgauggccaugguccucuccaucgugagccuguucccccugugccucuccaccaccagccagaagaccacguggcugcccgugcugcucggcucccuggggugcaagccgcugaccauguuccucaucgcggagaacaagaucuggggccggcgcagcuggccccugaacgaggggaucauggccgucggcaucguguccauccugcucagcagccugcugaagaacgacgugccccucgccgggccccugaucgccggcggcaugcugaucgccugcuacgucaucuccgggagcuccgcggaccucagccuggagaaggccgccgagguguccugggaggaggaggccgagcacagcggcgccucccacaacauccugguggagguccaggacgacgggaccaugaagaucaaggacgaggagcgggacgacacccucaccauccugcugaaggcgacgcuccuggccgugagcggcguguacccgcuguccauccccgccacccucuucgucugguacuucuggcagaagaagaagcagcgcagcggggugcugugggacacccccagcccgcccgaggugggccgggccguccuggacgacggcaucuaccgcaucaugcagcgggggcugcucggccgcagccaggugggggugggcgucuuccaggagaacguguuccacaccauguggcacgugacgcgcggggccguccugauguaccagggcaagcgccuggagcccuccugggcgagcgugaagaaggaccucaucuccuacggcgggggcuggcggcugcaggggagcuggaacaccggcgaggaggugcaggucaucgccguggagcccgggaagaaccccaagaacgugcagaccgcccccggcaccuucaagacgcccgagggcgaggucggggccaucgcccuggacuucaagcccggcaccuccgggagccccaucgugaaccgcgagggcaagaucgugggccucuacgggaacggcgucgugaccaccuccgggacguacgugagcgcgaucgcccaggccaaggccagccaggagggcccgcugcccgagaucgaggacgaggucuuccggaagcgcaaccugaccaucauggaccuccaccccggguccggcaagacccggcgcuaccugccggcgaucgugcgggaggccaucaagcgcaagcugcgcacccucauccuggcccccacgcggguggucgccagcgagauggccgaggcgcugaagggcaugcccauccgcuaccagaccaccgccgugaaguccgagcacaccgggaaggagaucguggaccucaugugccacgccacguucaccaugcggcugcugagccccguccgcgugccgaacuacaacaugaucaucauggacgaggcccacuucaccgaccccuccagcaucgccgcgcggggcuacaucuccacccgcguggggaugggcgaggccgccgccaucuucaugacggccacgccgcccgggagcgucgaggcguucccgcaguccaacgccgugauccaggacgaggagcgggacauccccgagcgcagcuggaacuccggcuacgaguggaucaccgacuuccccggcaagaccgugugguucguccccagcaucaaguccgggaacgacaucgccaacugccuccggaagaacggcaagcgcgugauccagcugagccggaagacguucgacaccgaguaccagaagaccaagaacaacgacugggacuacguggucaccacggacaucuccgagaugggggccaacuuccgcgcggaccgggugaucgacccgcgccggugccugaagcccgugauccucaaggacggccccgagcgcgucauccuggccgggcccaugccggugaccgucgccagcgccgcccagcggcgcggccggaucggccgcaaccacaacaaggagggggaccaguacaucuacaugggccagccccugaacaacgacgaggaccacgcgcacuggaccgaggccaagaugcuccuggacaacaucaacacccccgaggggaucauccccgcccuguucgagccggagcgcgagaaguccgccgccaucgacggcgaguaccggcuccgcggggaggcgcggaagacguucguggagcugaugcgccggggcgaccugcccguguggcucagcuacaaggucgccuccgagggcuuccaguacagcgaccgccgguggugcuucgacggggagcgcaacaaccaggugcuggaggagaacauggacguggagaucuggaccaaggagggcgagcggaagaagcugcgcccccgguggcucgacgcccgcaccuacagcgacccccuggcccugcgggaguucaaggaguucgccgcggggcgccgguccgucagcggcgaccucauccuggagaucggcaagcugccgcagcaccucacccagcgcgcccagaacgcccuggacaaccuggugaugcuccacaacuccgagcagggcgggcgggccuaccgccacgcgauggaggagcugcccgacacgaucgagacccugaugcuccuggcccugaucgccgugcucaccgggggcgucacccuguucuuccugagcgggcggggccucggcaagaccuccaucgggcugcugugcgugauggccagcuccgugcuccuguggauggccagcgucgagccccacuggaucgcggccuccaucauccuggaguucuuccucauggugcugcugauccccgagccggaccgccagcggacgccccaggacaaccagcucgccuacguggucaucggccugcuguucaugauccucaccguggccgccaacgagauggggcugcuggagaccaccaagaaggaccucggcaucgggcacguggcggucgagaaccaccaccacgccgccaugcuggacguggaccugcaccccgccagcgccuggacgcucuacgcgguggccaccaccaucaucaccccgaugaugcgccacacgaucgagaacaccaccgccaacaucucccugaccgccaucgccaaccaggcggccauccugaugggccucgacaagggcuggcccaucagcaagauggacaucggggucccccugcuggcccucggcugcuacucccaggugaacccccugacgcugaccgccgcggugcucaugcuggucgcccacuacgccaucaucgggccgggccugcaggccaaggccacccgcgaggcgcagaagcggaccgccgccgggaucaugaagaaccccacgguggacggcaucguggccaucgaccucgaccccgucguguacgacgccaaguucgagaagcagcugggccagaucaugcugcucauccugugcaccagccagauccugcucaugcgcaccaccugggcgcugugcgaguccaucacgcuggccaccgggccccucaccacccugugggagggcagcccggggaaguucuggaacacgaccaucgccguguccauggccaacaucuuccggggcagcuaccuggccggcgcggggcucgccuucucccugaugaagucccugggcgggggccgccgggggaccggcgcccagggcgagacccucggggagaaguggaagcgccagcugaaccagcugagcaaguccgaguucaacacguacaagcggagcggcaucauggaggucgaccgcuccgaggccaaggaggggcucaagcggggcgagaccaccaagcacgcggugagccgcgggaccgccaagcugcggugguucguggagcgcaaccuggucaagcccgagggcaaggugaucgaccugggcugcgggcggggcgggugguccuacuacugcgccggccucaagaaggugacggaggucaagggguacaccaagggcggccccgggcacgaggagcccaucccgauggccaccuacggcuggaaccuggugaagcugcacagcgggaaggacguguucuucaucccgcccgagaagugcgacacccuccugugcgacaucggcgaguccagccccaacccgacgaucgaggaggggcgcacccugcggguccucaagaugguggagcccuggcugcgcggcaaccaguucugcaucaagauccugaaccccuacaugcccuccguggucgagacccucgagcagaugcagcggaagcacggcgggaugcuggugcgcaacccgcugagccggaacuccacccacgagauguacugggugagcugcggcaccgggaacaucgucuccgccgugaacaugacgagccgcaugcuccugaaccgcuucaccauggcgcaccggaagcccaccuacgagcgcgacguggaccugggcgccggcacccggcacgucgccguggagcccgagguggccaaccucgacaucaucgggcagcgcaucgagaacaucaagcacgagcacaaguccacguggcacuacgacgaggacaaccccuacaagaccugggccuaccacggcagcuacgaggucaagccguccgggagcgcguccagcauggugaacggcgucgugaagcugcugaccaagcccugggacgugauccccauggucacccagaucgccaugacggacaccacccccuucgggcagcagcggguguucaaggagaagguggacacccgcacgccgaaggccaagcggggcaccgcccagaucauggaggucaccgccaaguggcucuggggcuuccugagccgcaacaagaagccccggaucugcacccgcgaggaguucacgcggaaggugcgcuccaacgcggccaucggggccguguucgucgacgagaaccaguggaacagcgccaaggaggcgguggaggacgagcgguucugggaccuggugcaccgcgagcgggagcuccacaagcagggcaagugcgcgaccugcgucuacaacaugauggggaagcgcgagaagaagcugggcgaguucgggaaggccaagggcucccgggccaucugguacauguggcugggcgcccgcuuccucgaguucgaggcgcugggguucaugaacgaggaccacugguucagccgggagaacucccugagcggcguggagggggagggccuccacaagcugggguacauccugcgcgacaucuccaacauccccggcggcaacauguacgccgacgacaccgccgggugggacacccggaucacggaggacgaccuccagaacgaggcccgcaucaccgacaucauggagccggagcacgcccugcuggccaagagcaucuucaagcucaccuaccagaacaaggugguccgcgugcagcggcccgccaagaacggcaccgugauggacgucaucucccgccgggaccagcgcgggagcggccaggugggcacguacgggcugaacaccuucaccaacauggaggcccagcugauccggcagauggaguccgagggcaucuucagccccuccgagcucgagacccccaaccuggccgagcgcgugcuggacuggcucgagaaguacggggucgagcggcugaagcgcauggccaucagcggcgacgacugcguggugaagccgaucgacgaccgguucgcgacggcccugaccgcccucaacgacauggggaagguccgcaaggacaucccccagugggagcccuccaagggcuggaacgacuggcagcagguccccuucugcagccaccacuuccaccagcugaucaugaaggacggccgggagaucguggucccgugccgcaaccaggacgagcugguggggcgggcccgcgugucccagggcgccggguggagccuccgggagaccgcgugccugggcaagagcuacgcccagauguggcagcugauguacuuccaccgccgggaccuccgccuggccgccaacgcgaucugcuccgccguccccguggacuggauccccaccagccggacgaccugguccauccacgcccaccaccaguggaugaccaccgaggacaugcugagcguguggaaccgcgucuggaucgaggagaaccccuggauggaggacaagacgcacaucuccagcuggggcgacgugccguaccucggcaagcgcgaggaccaguggugcggcucccugaucgggcugaccgcccgggccaccugggcgaccaacauccagguggccaucaaccagguccgccggcucaucggcaacgagaacuaccuggacuacaugaccagcaugaagcgcuucaagaacgaguccgaccccgagggggcccugugguga

SEQ ID NO: 8432 - RNA, 9879 nt, Artificial Sequence
  derived and/or modified CDS sequence (opt1) from DENV-1__FJ410266__SS-prME
agcgugaccaugcugcucaugcugaugcccaccgcccuggccuuccaccucaccacccgcggcggggagccccacaugaucgugaccaagcaggagcggggcaagagccugcuguucaagaccagcgcgggggugaacaugugcacccucaucgccauggaccugggcgagcugugcgaggacaccaugaccuacaagugcccccggaucaccgaggccgagcccgacgacguggacugcuggugcaacgccacggacaccugggugaccuacgggaccugcagccagacgggcgagcaccggcgcgacaagcggagcguggcccucgcgccccacgugggccuggggcuggagacccgcaccgagaccuggauguccagcgagggcgccuggaagcagauccagcgggucgagacgugggcccuccgccaccccggguucaccgugaucgcccuguuccuggcgcacgccaucggcaccuccaucacccagaaggggaucaucuucauccuccugaugcuggugacgcccagcauggccaugcggugcgucggcaucggcucccgcgacuucguggaggggcucagcggcgccaccuggguggacgucgugcuggagcacggguccugcgugaccaccauggccaaggacaagcccacgcuggacaucgagcuccugaagaccgaggucaccaaccccgcggugcugcggaagcucugcaucgaggccaagaucagcaacaccacgaccgacucccgcugccccacccagggcgaggccacccugauggaggagcaggacgccaacuucgugugccggcgcacguucgucgaccggggcugggggaacggcugcgggcuguucggcaaggggagccucaucacgugcgccaaguucaagugcgugaccaagcuggagggcaagaucgugcaguacgagaaccugaaguacuccgucaucgugaccgugcacacgggcgaccagcaccaggucgggaacgagagcaccgagcacggcaccaccgcgaccaucacgccccaggcccccaccuccgagauccagcucaccgacuacggggcccugacccuggacugcagcccccgcacgggccucgacuucaacgagauggugcugcugaccaugaaggagaaguccuggcucguccacaagcagugguuccuggaccugccgcuccccuggaccagcggggccagcaccucccaggagacguggaaccggcaggaccugcuggugaccuucaagaccgcccacgcgaagaagcaggagguggucgugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgugaugugcaccggguccuucaagcucgagaaggaggucgcggagacgcagcacggcaccgugcuggugcagaucaaguacgagggcaccgacgcccccugcaagauccccuucagcacccaggacgagaagggggucacgcagaacggccggcugaucaccgccaacccgaucgugaccgacaaggagaagcccgugaacaucgaggccgagccgcccuucggggaguccuacaucgucaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcguggggaagcugguccaccagaucuucggcaccgccuacggggugcuguucuccggcgugagcuggaccaugaagaucgggaucggcguccugcugacguggcucggccugaacucccgcagcaccucccugagcaugaccugcaucgccguggggcucgugacccuguaccugggcgucauggugcaggccgacuccgggugcgugaucaacuggaagggccgggagcucaagugcgggagcggcaucuucgucacgaacgaggugcacaccuggaccgagcaguacaaguuccaggcggacagcccgaagcgccuguccgccgccaucggcaaggccugggaggagggggugugcggcauccggagcgccacccgccuggagaacaucauguggaagcagaucuccaacgagcucaaccacauccugcuggagaacgacaugaaguucaccgucguggugggggacgucgugggcauccucgcgcaggggaagaagaugauccggccccagcccauggagcacaaguacagcuggaaguccuggggcaaggccaagaucaucggcgccgacgugcagaacacgaccuucaucaucgacgggcccaacaccccggagugccccgacgaccagcgcgccuggaacaucugggaggucgaggacuacggcuucgggaucuucaccacgaacaucuggcugaagcugcgggacagcuacacccaggugugcgaccaccgccucauguccgcggccaucaaggacagcaaggccgugcacgccgacaugggcuacuggaucgaguccgagaagaacgagaccuggaagcuggcccgggcgagcuucaucgaggucaagaccugcaucuggcccaagucccacacgcuguggagcaacggcgugcucgaguccgagaugaucauccccaagaucuacgggggcccgaucagccagcacaacuaccgccccggguacuucacccagaccgccggccccuggcaccuggggaagcuggagcucgacuucgaccugugcgagggcaccacgguggucguggacgagcacugcggcaaccgggggccgucccugcgcaccaccaccgugacgggcaagaucauccacgaguggugcugccggagcugcacccugccgccccuccgcuucaagggggaggacggcugcugguacgggauggagauccggcccgucaaggagaaggaggagaaccuggugaaguccauggugagcgccggcagcggcgaggucgacuccuucagccucgggcugcugugcaucuccaucaugaucgaggaggugaugcgcagccggugguccaagaagaugcucaugaccggcacccuggccguguuccugcuccugaucauggggcagcugacguggaacgaccucauccgccugugcaucauggucggcgccaacgcgagcgaccggauggggaugggcaccaccuaccuggcccucaucgccaccuucaagaugcgcccgauguucgccgugggccugcuguuccgccggcucacgucccgcgaggugcugcugcucaccaucgggcugagccuggucgccuccguggagcuccccaacagccuggaggagcugggcgacgggcucgcgaugggcaucaugauccugaagcugcucaccgacuuccagucccaccagcugugggccacccugcucagcuucacguucaucaagaccacccugucccugcacuacgccuggaagaccauggccaugguccucagcaucgugucccuguucccccugugccucagcacgaccucccagaagaccaccuggcugcccgugcugcucggcagccuggggugcaagccgcugacgauguuccucaucgcggagaacaagaucuggggccggaaguccuggccccugaacgaggggaucauggccgucggcguggugagcauccugcucagcucccugcugaagaacgacgucccccucgccgggccccugaucgccggcggcaugcugaucgccugcuacgugaucagcggguccagcgcggaccucucccuggagaaggccgccgaggugagcugggaggaggaggccgagcacuccggcgccagccacaacauccuggucgaggugcaggacgacgggaccaugaagaucaaggacgaggagcgcgacgacacccucaccauccugcugaaggcgacccuccuggccguguccggcgucuacccgcugagcauccccgccacccucuucguguggcacuucuggcagaagaagaagcagcgguccggggugcugugggacacccccagcccgcccgaggucgagcgcgccgugcuggacgacggcaucuaccggaucaugcagcgcggccugcucgggcggucccaggugggcgucgggguguuccaggagaacguguuccacaccauguggcacgucacccgcggcgccgugcugauguaccaggggaagcggcuggagcccagcugggcguccgugaagaaggaccucaucagcuacggcggcggguggcgccugcagggcuccuggaacacgggggaggagguccaggugaucgccguggagcccggcaagaaccccaagaacguccagaccgcccccgggaccuucaagacccccgagggcgaggugggcgccaucgcccuggacuucaagcccgggacgagcggcucccccaucgugaaccgggaggggaagaucgucggccucuacggcaacgggguggugaccaccagcggcaccuacgucagcgcgaucgcccaggccaaggccucccaggaggggccgcugcccgagaucgaggacgagguguuccgcaagcggaaccugacgaucauggaccuccaccccggcagcgggaagacccgccgguaccugccggcgaucgugcgcgaggccaucaagcggaagcugcgcacccucauccuggcccccacccgggucguggccuccgagauggccgaggcgcugaagggcaugcccauccgcuaccagacgaccgccgucaagagcgagcacaccggcaaggagaucgucgaccucaugugccacgccaccuucacgaugcgccugcugucccccgugcgggugccgaacuacaacaugaucaucauggacgaggcccacuucaccgaccccagcuccaucgccgcgcgcggguacaucagcacccgggucggcaugggggaggccgccgccaucuucaugaccgccacgccgcccggcuccguggaggcguucccgcagagcaacgccgugauccaggacgaggagcgcgacauccccgagcgguccuggaacagcggguacgaguggaucaccgacuuccccggcaagaccgucugguucgugcccuccaucaagagcggcaacgacaucgccaacugccuccgcaagaacgggaagcgggugauccagcugucccgcaagaccuucgacacggaguaccagaagaccaagaacaacgacugggacuacgucgugaccaccgacaucagcgagaugggcgccaacuuccgggcggaccgcgugaucgacccgcggcgcugccugaagcccgucauccucaaggacgggcccgagcgggugauccuggccggccccaugccggucacgguggccuccgccgcccagcgccgggggcgcaucggccggaaccacaacaaggagggcgaccaguacaucuacauggggcagccccugaacaacgacgaggaccacgcgcacuggaccgaggccaagaugcuccuggacaacaucaacacccccgagggcaucauccccgcccuguucgagccggagcgcgagaaguccgccgccaucgacggggaguaccggcuccgcggcgaggcgcgcaagaccuucguggagcugaugcggcgcggggaccugcccgucuggcucuccuacaagguggccagcgagggcuuccaguacagcgaccggcgcuggugcuucgacggcgagcggaacaaccaggugcuggaggagaacauggacgucgagaucuggacgaaggagggggagcgcaagaagcugcggccccgcuggcucgacgcccggaccuacuccgacccccuggcccugcgcgaguucaaggaguucgccgcgggccggcgcagcguguccggggaccucauccuggagaucggcaagcugccgcagcaccucacccagcgggcccagaacgcccuggacaaccuggugaugcuccacaacagcgagcagggcgggcgcgccuaccggcacgcgauggaggagcugcccgacaccaucgagacgcugaugcuccuggcccugaucgccguccucaccggcggggugacccuguucuuccuguccggccgcgggcucggcaagaccagcaucggccugcugugcgugauggccuccagcguccuccuguggauggccuccguggagccccacuggaucgcggccagcaucauccuggaguucuuccucauggugcugcugauccccgagccggaccggcagcgcacgccccaggacaaccagcucgccuacgucgugaucgggcugcuguucaugauccucacgguggccgccaacgagaugggccugcuggagaccaccaagaaggaccucgggaucggccacgucgcgguggagaaccaccaccacgccaccaugcuggacguggaccugcaccccgccuccgccuggacgcucuacgccgucgcgaccaccaucaucaccccgaugaugcggcacacgaucgagaacaccaccgccaacaucagccugaccgccaucgccaaccaggccgcgauccugauggggcucgacaagggcuggcccaucuccaagauggacaucggcgugccccugcuggcccucgggugcuacagccaggugaacccccugacgcugaccgccgccguccucaugcugguggcgcacuacgccaucaucggcccggggcugcaggccaaggccacccgcgaggcccagaagcggaccgcggccggcaucaugaagaaccccacgguggacgggaucgucgccaucgaccucgaccccgugguguacgacgccaaguucgagaagcagcugggccagaucaugcugcucauccugugcaccucccagauccugcucaugcgcaccaccugggcccugugcgagagcaucacgcuggcgaccggcccccucaccacccugugggagggguccccgggcaaguucuggaacacgaccaucgccgucagcauggccaacaucuuccgcggguccuaccuggccggcgccggccucgcguucagccugaugaagucccucgggggcgggcggcgcgggaccggggcccagggcgagacccucggcgagaaguggaagcggcagcugaaccagcuguccaagagcgaguucaacacguacaagcgcuccgggaucauggagguggaccggagcgaggccaaggagggccucaagcgcggggagaccacccggcacgccgugucccgcggcaccgcgaagcugcggugguucgucgagcgcaaccuggugaagcccgaggggaaggugaucgaccugggcugcggccgcggcggguggagcuacuacugcgccgggcucaagaaggucacggaggugaagggguacaccaagggcgggcccggccacgaggagcccaucccgauggccaccuacggguggaaccuggugaagcugcacuccggcaaggacgucuucuucacgccgcccgagaagugcgacacgcuccugugcgacaucggggagagcucccccaacccgaccaucgaggagggccgcacccugcgggugcucaagaugguggagcccuggcugcgcgggaaccaguucugcaucaagauccugaaccccuacaugcccagcgucguggagacccucgagcagaugcagcggaagcacggcggcaugcuggugcgcaacccgcugucccggaacagcacccacgagauguacugggucuccugcgggacgggcaacaucgugagcgccgugaacaugaccucccgcaugcuccugaaccgguucaccauggcccaccgcaagcccaccuacgagcgcgacgucgaccugggggcgggcacgcggcacguggccguggagcccgaggucgccaaccucgacaucaucggccagcgcaucgagaacaucaagcacgagcacaagagcaccuggcacuacgacgaggacaaccccuacaagaccugggccuaccacggguccuacgaggugaagccgagcggcuccgccagcagcauggucaacgggguggugaagcugcugaccaagcccugggacgucauccccauggugacgcagaucgcgaugaccgacaccacccccuucggccagcagcggguguucaaggagaaggucgacacgcgcaccccgaaggccaagcgggggaccgcccagaucauggaggugaccgccaaguggcucuggggcuuccugucccgcaacaagaagccccggaucugcacgcgcgaggaguucacccggaaggugcgcagcaacgccgcgaucggcgccgucuucguggacgagaaccaguggaacuccgccaaggaggccguggaggacgagcgguucugggaccugguccagaaggagcgcgagcuccacaagcaggggaagugcgcgaccugcguguacaacaugaugggcaagcgggagaagaagcugggggaguucggcaaggccaaggggagccgcgccaucugguacauguggcugggcgcccgguuccucgaguucgaggcccugggcuucaugaacgaggaccacugguucucccgcgagaacagccuguccgggguggagggcgaggggcuccacaagcugggcuacauccugcgggacaucagcaagauccccgggggcaacauguacgcggacgacaccgccggcugggacacgcgcaucaccgaggacgaccuccagaacgaggccaagaucaccgacaucauggagccggagcacgcccugcuggccaccuccaucuucaagcucacguaccagaacaaggucgugcgggugcagcgccccgcgaagaacgggaccgucauggacgugaucagccggcgcgaccagcgcggcuccggccaggugggcaccuacggccugaacaccuucacgaacauggaggcccagcugauccggcagauggagagcgaggggaucuuccuccccggcgagcuggagacccccaaccuggccgagcgcguccucgacuggcuggagaaguacgggguggagcggcugaagcgcauggccaucuccggcgacgacugcguggucaagccgaucgacgaccgguucgccaccgcgcucaccgcccugaacgacauggggaaggugcgcaaggacaucccccagugggagcccagcaagggcuggaacgacuggcagcagguccccuucugcucccaccacuuccaccagcugaucaugaaggacggccgggagaucgucgugccgugccgcaaccaggacgagcucguggggcgggcccgcgucagccagggcgccggguggucccugcgggagacggccugccugggcaagagcuacgcgcagauguggcagcucauguacuuccaccgccgggaccugcgccuggccgccaacgccaucugcagcgcggugcccguggacuggguccccaccucccggaccaccuggagcauccacgcccaccaccaguggaugacgaccgaggacaugcucuccguguggaaccgcguguggaucgaggagaaccccuggauggaggacaagacccacgucagcuccuggggcgacgugccguaccugggcaagcgggaggaccaguggugcggcagccugaucgggcucaccgcccgcgccaccugggccuccaacauccagguggcgaucaaccagguccggcgccugaucggcaacgagaacuaccuggacuacaugacgagcaugaagcgcuucaagaacgagggggaccccgagggcgcccucugguga

SEQ ID NO: 8433 - RNA, 9879 nt, Artificial Sequence
  derived and/or modified CDS sequence (opt1) from DENV-1__FJ410269__SS-prME
agcgugaccaugcugcucaugcugaugcccaccgcccuggccuuccaccucaccacccggggcggggagccccacaugaucgugaccaagcaggagcggggcaagagccugcuguucaagaccagcgcgggggugaacaugugcacccucaucgccauggaccugggcgagcugugcgaggacaccaugaccuacaagugcccccggaucaccgaggccgagcccgacgacguggacugcuggugcaacgccaccgacaccugggugaccuacgggaccugcagccagaccggcgagcaccggcgcgacaagcggagcguggcccucgcgccccacgugggccuggggcuggagacccgcaccgagaccuggauguccagcgagggcgccuggaagcagauccagcgggucgagacgugggcccuccgccaccccggguucaccgugaucgcccuguuccuggcgcacgccaucggcaccuccaucacccagaaggggaucaucuucauccuccugaugcuggugacgcccagcauggccaugcggugcgucggcaucggcucccgcgacuucguggaggggcucagcggcgccaccuggguggacgucgugcuggagcacggguccugcgugaccaccauggccaaggacaagcccacgcuggacaucgagcuccugaagaccgaggucaccaaccccgcggugcugcggaagcucugcaucgaggccaagaucagcaacaccacgaccgacucccgcugccccacccagggcgaggccacccugauggaggagcaggacgccaacuucgugugccggcgcacguucgucgaccggggcugggggaacggcugcgggcuguucggcaaggggagccucaucacgugcgccaaguucaagugcgugaccaagcuggagggcaagaucgugcaguacgagaaccugaaguacuccgucaucgugaccgugcacacgggcgaccagcaccaggucgggaacgagagcaccgagcacggcaccaccgcgaccaucacgccccaggcccccaccuccgagauccagcucaccgacuacggggcccugacccuggacugcagcccccgcacgggccucgacuucaacgagauggugcugcugaccaugaaggagaaguccuggcucguccacaagcagugguuccuggaccugccgcuccccuggaccagcggggccagcaccucccaggagacguggaaccggcaggaccugcuggugaccuucaagaccgcccacgcgaagaagcaggagguggucgugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgugaugugcaccggguccuucaagcucgagaaggaggucgcggagacgcagcacggcaccgugcuggugcagaucaaguacgagggcaccgacgcccccugcaagauccccuucagcacccaggacgagaagggggucauccagaacggccggcugaucacggccaacccgaucgugaccgacaaggagaagcccgugaacaucgaggccgagccgcccuucggggaguccuacaucgucaucggcgugggcgagaaggcgcugaagcucagcugguucaagaagggguccagcaucggcaagauguucgaggccaccgcccgcggggcccggcgcauggccauccugggcgacaccgcgugggacuucggguccaucggcggcguguucacgagcgucgggaagcuggugcaccagaucuucggcaccgccuacggggugcuguucuccggcgucagcuggaccaugaagaucgggaucggcgugcugcugaccuggcucggccugaacucccgcagcacgucccugagcaugaccugcaucgccguggggcucgucacccuguaccugggcgugauggugcaggccgacuccgggugcgucaucaacuggaagggccgggagcucaagugcgggagcggcaucuucgugaccaacgaggugcacacguggaccgagcaguacaaguuccaggccgacagcccgaagcgccuguccgcggccaucggcaaggccugggaggagggggucugcggcauccggagcgugacccgccuggagaacaucauguggaagcagaucuccaacgagcucaaccacauccugcuggagaacgacaugaaguucaccguggucgugggggacguggucggcauccucgcccaggggaagaagaugauccggccccagcccauggagcacaaguacagcuggaaguccuggggcaaggccaagaucaucggcgcggacgugcagaacaccacguucaucaucgacgggcccaacaccccggagugccccgacgaccagcgcgccuggaacaucugggagguggaggacuacggcuucgggaucuucaccaccaacaucuggcugaagcugcgggacagcuacacgcaggccugcgaccaccgccucauguccgccgcgaucaaggacagcaaggccguccacgccgacaugggcuacuggaucgaguccgagaagaacgagaccuggaagcuggcccgggccagcuucaucgaggugaagaccugcaucuggcccaagucccacacccuguggagcaacggcgugcucgaguccgagauggucauccccaagaucuacgggggcccgaucagccagcacaacuaccgccccggguacuucacgcagaccgcgggccccuggcaccuggggaagcuggagcucgacuucgaccugugcgagggcaccaccgugguggucgacgagcacugcggcaaccgggggccgucccugcgcacgaccaccgugaccggcaagaucauccacgaguggugcugccggagcugcacgcugccgccccuccgcuucaagggggaggacggcugcugguacgggauggagauccggcccgugaaggagaaggaggagaaccuggucaaguccauggugagcgccggcagcggcgagguggacuccuucagccucgggcugcugugcaucuccaucaugaucgaggaggucaugcgcagccgguggucccgcaagaugcucaugaccggcacccuggccguguuccugcuccugaucauggggcagcugaccuggaacgaccucauccggcugugcaucauggugggcgccaacgccagcgaccgcauggggaugggcacgaccuaccuggcgcucauggccaccuucaagaugcgcccgauguucgccgucgggcugcuguuccggcgccucaccucccgggaggugcugcugcucacgaucgggcugagccuggucgccuccguggagauccccaacagccucgaggagcugggcgacgggcuggccaugggcaucaugauccucaagcugcugaccgacuuccagucccaccagcucugggcgacccugcugagccucaccuucaucaagacgacccugucccugcacuacgccuggaagaccauggccauggugcucagcaucgucucccuguucccccugugccucagcaccacgucccagaagaccaccuggcugcccgugcugcucggcagccuggggugcaagccgcugaccauguuccucaucgccgagaacaagaucuggggccgcaaguccuggccccugaacgaggggaucauggcggugggcgucgugagcauccugcucagcucccugcugaagaacgacgugccccucgccgggccccugaucgccggcggcaugcugaucgccugcuacgucaucagcggguccagcgccgaccucucccuggagaaggcggccgaggugagcugggaggaggaggccgagcacuccggcgccagccacaacauccugguggagguccaggacgacgggacgaugaagaucaaggacgaggagcgggacgacacccucaccauccugcugaaggccacccuccuggcgguguccggcguguacccgcugagcauccccgccacccucuucgucugguacuucuggcagaagaagaagcagcgcuccggggugcugugggacacgcccagcccgcccgagguggagcgggccguccuggacgacggcaucuaccgcaucaugcagcggggccugcucgggcgcucccaggugggcgugggggucuuccaggagaacguguuccacaccauguggcacgugacccggggcgccguccugauguaccaggggaagcgccuggagcccagcugggccuccgugaagaaggaccucaucagcuacggcggcggguggcggcugcagggcuccuggaacaccggggaggaggugcaggucaucgcgguggagcccggcaagaaccccaagaacgugcagacggcccccgggaccuucaagacccccgagggcgaggucggcgccaucgcccuggacuucaagcccgggaccagcggcucccccaucgugaaccgcgaggggaagaucgugggccucuacggcaacggggucgugacgaccagcggcaccuacgugagcgccaucgcgcaggccaaggccucccaggaggggccgcugcccgagaucgaggacgaggucuuccggaagcgcaaccugaccaucauggaccuccaccccggcagcgggaagacgcggcgcuaccugccggccaucgugcgggaggcgaucaagcgcaagcugcggacccucauccuggcccccacccgcguggucgccuccgagauggccgaggcccugaagggcaugcccauccgcuaccagaccacggcggucaagagcgagcacaccggcaaggagaucguggaccucaugugccacgccaccuucaccaugcggcugcugucccccguccgcgugccgaacuacaacaugaucaucauggacgaggcccacuucacggaccccagcuccaucgccgcccggggguacaucagcacccgcgugggcaugggggaggcggccgccaucuucaugaccgccacgccgcccggcuccgucgaggccuucccgcagagcaacgcggugauccaggacgaggagcgggacauccccgagcgcuccuggaacagcggguacgaguggaucacggacuuccccggcaagaccgugugguucguccccuccaucaagagcggcaacgacaucgccaacugccuccggaagaacgggaagcgcgugauccagcugucccggaagaccuucgacaccgaguaccagaagacgaagaacaacgacugggacuacguggucaccaccgacaucagcgagaugggcgccaacuuccgcgccgaccgggugaucgacccgcgccggugccugaagcccgucauccucaaggacgggcccgagcgcgugauccuggcgggccccaugccggugaccgucgccuccgccgcccagcggcgcgggcggaucggccgcaaccacaacaaggagggcgaccaguacaucuacauggggcagccccugaacaacgacgaggaccacgcccacuggacggaggcgaagaugcuccuggacaacaucaacacccccgagggcaucauccccgcccuguucgagccggagcgggagaaguccgccgccaucgacggggaguaccgccuccgcggcgaggcccggaagaccuucguggagcugaugcgccgcggggaccugcccguguggcucuccuacaaggucgcgagcgagggcuuccaguacagcgaccgccgguggugcuucgacggcgagcgcaacaaccaggugcuggaggagaacauggacguggagaucuggaccaaggagggggagcggaagaagcugcgcccccgguggcucgacgcccgcacguacuccgacccccuggcccugcgggaguucaaggaguucgccgccggccgccggagcgucuccggggaccucauccuggagaucggcaagcugccgcagcaccucacccagcgcgcgcagaacgcccuggacaaccuggugaugcuccacaacagcgagcagggcgggcgggccuaccgccacgccauggaggagcugcccgacaccaucgagacccugaugcuccuggcgcugaucgccgugcucacgggcggggucacccuguucuuccuguccggccgggggcucggcaagaccagcaucggccugcugugcgugauggccuccagcgugcuccuguggauggccuccgucgagccccacuggaucgccgcgagcaucauccuggaguucuuccucauggugcugcugauccccgagccggaccgccagcggacgccccaggacaaccagcucgccuacguggucaucgggcugcuguucaugauccucaccguggccgccaacgagaugggccugcuggagacgaccaagaaggaccucgggaucggccacguggccgucgagaaccaccaccacgcgaccaugcuggacguggaccugcaccccgccuccgccuggacccucuacgccguggccacgaccaucaucaccccgaugaugcgccacaccaucgagaacacgaccgcgaacaucagccugaccgccaucgccaaccaggccgccauccugauggggcucgacaagggcuggcccaucuccaagauggacaucggcgucccccugcuggcgcucgggugcuacagccaggugaacccccugacccugacggccgccgugcucaugcuggucgcccacuacgcgaucaucggcccggggcugcaggccaaggccacccgggaggcccagaagcgcaccgccgcgggcaucaugaagaaccccaccguggacgggaucguggccaucgaccucgaccccgucguguacgacgccaaguucgagaagcagcugggccagaucaugcugcucauccugugcacgucccagauccugcucaugcgcaccaccugggcccugugcgagagcaucacccuggccacgggcccccucaccacccugugggagggguccccgggcaaguucuggaacaccacgaucgcggugagcauggccaacaucuuccggggguccuaccuggccggcgccggccucgccuucagccugaugaagucccucgggggcgggcgccgggggaccggggcgcagggcgagacccucggcgagaaguggaagcgccagcugaaccagcuguccaagagcgaguucaacaucuacaagcgguccgggaucauggaggucgaccgcagcgaggccaaggagggccucaagcgcggggagaccacgcgccacgccgugucccggggcaccgccaagcugcgcugguucguggagcggaaccuggucaagcccgaggggaaggugaucgaccugggcugcggccgcgggggcuggagcuacuacugcgcggggcucaagaaggugaccgaggucaagggcuacaccaagggcgggcccggccacgaggagcccaucccgauggccacguacggguggaaccuggugaagcugcacuccggcaaggacguguucuucacgccgcccgagaagugcgacacccuccugugcgacaucggggagagcucccccaacccgaccaucgaggagggccggacgcugcgcguccucaagaugguggagcccuggcugcgggggaaccaguucugcaucaagauccugaaccccuacaugcccagcguggucgagacccucgagcagaugcagcgcaagcacggcggcaugcuggugcggaacccgcugucccgcaacagcacccacgagauguacuggguguccugcgggaccggcaacaucgucagcgccgugaacaugaccucccggaugcuccugaaccgcuucacgauggcccaccgcaagcccaccuacgagcgggacguggaccugggggccggcacccgccacgucgcgguggagcccgaggucgccaaccucgacaucaucggccagcggaucgagaacaucaagcacgagcacaagagcaccuggcacuacgacgaggacaaccccuacaagacgugggccuaccacggguccuacgaggugaagccgagcggcuccgccagcagcauggugaacggggucgugaagcugcugaccaagcccugggacgugauccccauggucacccagaucgccaugaccgacacgacccccuucggccagcagcgcguguucaaggagaagguggacacccggaccccgaaggcgaagcgcgggacggcccagaucauggaggucaccgcccgguggcucuggggcuuccugucccgcaacaagaagccccggaucugcacccgcgaggaguucacccggaaggugcgcagcaacgccgccaucggcgcgguguucgucgacgagaaccaguggaacuccgccaaggaggccguggaggacgagcgguucugggaccuggugcagaaggagcgcgagcuccacaagcaggggaagugcgccacgugcgucuacaacaugaugggcaagcgggagaagaagcugggggaguucggcaaggcgaaggggagccgcgccaucugguacauguggcugggcgcccgguuccucgaguucgaggcccugggcuucaugaacgaggaccacugguucucccgcgagaacagccuguccgggguggagggcgaggggcuccacaagcugggcuacauccugcgggacaucagcaagauccccgggggcaacauguacgccgacgacaccgcgggcugggacacccgcaucaccgaggacgaccuccagaacgaggccaagaucacggacaucauggagccggagcacgcccugcuggccaccuccaucuucaagcucaccuaccagaacaaggugguccgggugcagcgccccgccaagaacgggaccgugauggacgucaucagccgccgggaccagcgcggcuccggccaggugggcacguacggccugaacaccuucaccaacauggaggcgcagcugauccggcagauggagagcgaggggaucuuccuccccuccgagcuggagacccccaaccuggccgagcgcgugcucgacuggcuggagaagcacggcgucgagcggcugaagcgcauggccaucagcggggacgacugcguggugaagccgaucgacgaccgguucgccacggcccucaccgcgcugaacgacaugggcaagguccgcaaggacaucccccagugggagcccuccaagggguggaacgacuggcagcagguccccuucugcagccaccacuuccaccagcugaucaugaaggacggccgggagaucguggucccgugccgcaaccaggacgagcucgugggccgggcccgcgugucccagggggccggcuggagccugcgggagaccgccugccugggcaagagcuacgcccagauguggcagcucauguacuuccaccgccgggaccugcgccuggcggccaacgccaucugcuccgccguccccguggacugggugcccaccagccggacgaccugguccauccacgcgcaccaccaguggaugaccaccgaggacaugcucagcgucuggaaccgcguguggaucgaggagaaccccuggauggaggacaagacgcacguguccagcuggggcgacgucccguaccuggggaagcgggaggaccaguggugcggcucccugaucggccucaccgcccgcgccaccugggccagcaacauccagguggccaucaaccaggugcgccggcugaucgggaacgagaacuaccuggacuacaugaccuccaugaagcgcuucaagaacgagggcgaccccgagggggcgcucugguga

SEQ ID NO: 8434 - RNA, 9879 nt, Artificial Sequence
  derived and/or modified CDS sequence (opt1) from DENV-1__FJ410273__SS-prME
agcgugaccaugcugcucaugcugaugcccaccgcccuggccuuccaccucacgacccggggcggggagccccacaugaucgugagcaagcaggagcggggcaagagccugcuguucaagaccagcgcgggggugaacaugugcacccucaucgccauggaccugggcgagcugugcgaggacacgaugaccuacaagugcccccgcaucaccgaggccgagcccgacgacguggacugcuggugcaacgccaccgacacgugggugaccuacgggaccugcagccagaccggcgagcaccggcgggacaagcgguccguggcccucgcgccccacgugggccuggggcuggagacgcgcaccgagaccuggaugagcuccgagggcgccuggaagcagauccagcggguggagaccugggcccuccgccaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcggugcugcggaagcucugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacaccggcgaccagcaccagguggggaacgaguccacggagcacggcaccaccgcgaccaucacgccccaggcccccagcacggagauccagcucaccgacuacggggcccugacccuggacugcagcccccggaccggccucgacuucaacgagaugguccugcugacgaugaaggagaaguccuggcucgugcacaagcagugguuccuggaccugccgcuccccuggaccagcggggccuccaccagccaggagaccuggaaccggcaggaccugcuggugacguucaagaccgcccacgcgaagaagcaggaggucguggugcucggcucccaggagggcgccaugcacaccgcccugaccggggccacggagauccagaccagcggcaccaccacgaucuucgccgggcaccugaagugccgccucaagauggacaagcugacccugaagggcauguccuacgucaugugcaccgggagcuucaagcucgagaaggagguggcggagacccagcacggcacggugcugguccagaucaaguacgagggcaccgacgcccccugcaagauccccuucuccacccaggacgagaagggggugacccagaacggccggcugaucacggccaacccgaucgugaccgacaaggagaagcccgucaacaucgaggccgagccgcccuucggggagagcuacaucgugaucggcgcgggcgagaaggcccugaagcucuccugguucaagaaggggagcuccaucggcaagauguucguggccaccgcccgcggggcccggcgcauggcgauccugggcgacaccgccugggacuucgggagcaucggcggcgucuucacguccguggggaagcuggugcaccagaucuucggcaccgccuacgggguccucuucagcggcguguccuggaccaugaagaucgggaucggcgugcugcugaccuggcucggccugaacagccgcuccacgagccuguccaugaccugcaucgccgucgggcucgugacccuguaccugggcgugaugguccaggccgacagcgggugcgugaucaacuggaagggccgggagcucaagugcgggagcggcaucuucgugaccaacgagguccacacguggaccgagcaguacaaguuccaggcggacuccccgaagcgccugagcgccgccaucggcaaggccugggaggagggggugugcggcauccgguccgccacccgccuggagaacaucauguggaagcagaucagcaacgagcucaaccacauccugcuggagaacgacaugaaguucaccguggucgugggggacguggcgggcauccucacccaggggaagaagaugauccggccccagcccauggaguacaaguacuccuggaaguccuggggcaaggccaagaucaucggcgccgacguccagaacacgaccuucaucaucgacgggcccaacaccccggagugccccgacgaccagcgcgccuggaacaucugggagguggaggacuacggcuucgggaucuucaccacgaacaucuggcugaagcugcgggacuccuacacccaggugugcgaccaccgccucaugagcgcggccaucaaggacuccaaggccguccacgccgacaugggcuacuggaucgagagcgagaagaacgagaccuggaagcuggcccgggcguccuucaucgaggugaagaccugcaucuggcccaagagccacacgcugugguccaacggcgugcucgagagcgagaugaucauccccaagaucuacgggggcccgaucucccagcacaacuaccgccccggguacuucacccagaccgccggccccuggcaccuggggaagcuggagcucgacuucaaccugugcgagggcaccacggucgugguggacgagcacugcggcaaccgggggccgagccugcgcaccaccaccgucacgggcaagaucauccacgaguggugcugccgguccugcacccugccgccccuccgcuucaagggggaggacggcugcugguacgggauggagauccggcccgugaaggagaaggaggagaaccuggucaagagcauggucagcgccggcuccggcgagguggacagcuucucccucgggcugcugugcaucagcaucaugaucgaggaggugaugcgcucccgguggagccgcaagaugcucaugaccggcacccuggccgucuucuuccugcucaucauggggcagcugacguggaacgaccugauccggcucugcaucauggugggcgccaacgcguccgaccgcauggggaugggcaccaccuaccuggcccugauggccaccuucaagaugcgcccgaugcucgccgugggccugcuguuccggcgccucacgagccgggagguccugcugcucaccaucgggcugucccugguggccagcgucgagcuccccaacucccuggaggagcugggcgacgggcucgcgaugggcaucaugauccugaagcugcucaccgacuuccagagccaccagcugugggccacccugcucucccugacguucaucaagaccaccuacagccugcacuacgccuggaagaccauggccauggugcucuccaucgugagccuguucccccugugccucuccacgaccagccagaagaccaccuggcugcccguccugcucggcucccuggggugcaagccgcugacgauguuccucaucgcggagaacaagaucuggggccgcaagagcuggccccugaacgaggggaucauggccgugggcaucgugagcauccugcucuccagccugcugaagaacgacgucccccucgccgggccccugaucgccggcggcaugcugaucgccugcuacgugaucuccgggagcuccgcggaccucagccuggagaaggccgccgagguguccugggaggaggaggccgagcacagcggcgccucccacaacauccuggucgaggugcaggacgacgggaccaugaagaucaaggacgaggagcgggacgacacccucaccauccugcugaaggcgacccuccuggccgugagcggcgucuacccgcuguccauccccgccacccuguucgugugguacuucuggcagaagaagaagcagcgcagcggggugcugugggacacccccagcccgcccgaggucgagcgggccgugcuggacgacggcaucuaccgcaucaugcagcggggccugcucgggcgcagccaggugggcgucgggguguuccaggagaacguguuccacaccauguggcacgucacccggggcgccgugcugauguaccaggggaagcgccuggagcccuccugggcgagcgugaagaaggaccucaucuccuacggcggcggguggcggcugcagggcagcuggaacacgggggaggagguccaggugaucgccguggagcccggcaagaaccccaagaacguccagaccgcccccgggaccuucaagaccuccgagggcgaggugggcgccaucgcccuggacuucaagcccgggacgagcggcagccccaucgugaaccgcgaggggaagaucgucggccucuacggcaacgggguggugaccaccuccggcaccuacgucagcgcgaucgcccaggccaaggccucccaggaggggccccugccggagaucgagaacgagguguuccggaagcgcaaccugacgaucauggaccuccaccccggcagcgggaagacccggcgcuaccugcccgcgaucgugcgggaggccaucaagcgcaagcugcggacccucauccuggccccgacccgcgucguggccuccgagauggccgaggcgcugaagggcaugcccauccgcuaccagacgaccgccgucaagagcgagcacaccggcaaggagaucgucgaccucaugugccacgccaccuucacgaugcggcugcugucccccgugcgcgugcccaacuacaacaugaucaucauggacgaggcccacuucaccgacccgagcuccaucgccgcgcggggguacaucagcacccgcgucggcaugggggaggccgccgccaucuucaugaccgccacgccgcccggcuccguggaggcguucccccagagcaacgccgugauccaggacgaggagcgggacaucccggagcgcuccuggaacagcggguacgaguggaucaccgacuuccccggcaagaccgucugguucgugcccuccaucaagagcggcaacgacaucgccaacugccuccggaagaacgggaagcgcgugauccagcugucccggaagaccuucgacacggaguaccagaagaccaagaacaacgacugggacuacgucgugaccaccgacaucagcgagaugggcgccaacuuccgcgcggaccgggugaucgacccccgccggugccugaagccggucauccucaaggacgggcccgagcgcgugauccuggccggccccaugcccgucacgguggccuccgccgcccagcggcgcgggcggaucggccgcaaccacaacaaggagggcgaccaguacaucuacauggggcagccgcugaacaacgacgaggaccacgcgcacuggaccgaggccaagaugcuccuggacaacaucaacacccccgagggcaucauccccgcccuguucgagcccgagcgggagaaguccgccgccaucgacggggaguaccgccuccgcggcgaggcgcggaagaccuucguggagcugaugcgccgcggggaccugccggucuggcucagcuacaagguggccuccgagggcuuccaguacagcgaccgccgguggugcuucgacggcgagcgcaacaaccaggugcuggaggagaacauggacgucgagaucuggacgaaggagggggagcggaagaagcugcgcccccgguggcucgacgcccgcaccuacuccgacccccuggcccugcgggaguucaaggaguucgccgcgggccgccggagcguguccggggaccucauccuggagaucggcaagcugccccagcaccucacccagcgcgcccagaacgcccuggacaaccuggugaugcuccacaacagcgagcagggcgggcgggccuaccgccacgcgauggaggagcugccggacaccaucgagacgcugaugcuccuggcccugaucgccguccucaccggcggggugacccuguucuuccuguccggccgggggcucggcaagaccagcaucggccugcugugcgugauggccuccagcguccuccuguggauggccuccguggagccccacuggaucgcggccagcaucauccuggaguucuuccucauggugcugcugauccccgagcccgaccgccagcggaccccgcaggacaaccagcucgccuacgucgugaucgggcugcuguucaugauccucacgguggccgccaacgagaugggccugcuggagaccaccaagaaggaccucgggaucggccacgucgcgguggagaaccaccaccacgccgccaugcuggacguggaccugcaccccgccuccgccuggacccucuacgcggucgccacgaccaucaucacccccaugaugcgccacaccaucgagaacacgaccgccaacaucagccugaccgccaucgccaaccaggcggccauccugauggggcucgacaagggcuggccgaucuccaagauggacaucggcgugccccugcuggcccucgggugcuacagccaggugaacccccugacccugacggccgcgguccucaugcugguggcccacuacgccaucaucggccccgggcugcaggccaaggccacccgggaggcgcagaagcgcaccgccgccggcaucaugaagaacccgaccguggacgggaucgucgccaucgaccucgaccccgugguguacgacgccaaguucgagaagcagcugggccagaucaugcugcucauccugugcacgucccagauccugcucaugcgcaccaccugggcgcugugcgagagcaucacccuggccacgggcccccucaccacccugugggaggggucccccggcaaguucuggaacaccacgaucgccgucagcauggccaacaucuuccgggggagcuaccuggccggcgcgggccucgccuucucccugaugaagucccucgggggcgggcgccgggggaccggggcccagggcgagacccucggcgagaaguggaagcgccagcugaaccagcuguccaagagcgaguucaacaccuacaagcgguccgggaucauggagguggaccgcagcgaggccaaggagggccucaagcgcggggagacgaccaagcacgcggugucccgcggcaccgccaagcugcggugguucgucgagcgcaaccuggugaagccggaggggaaggugaucgaccugggcugcggccgcggcggguggagcuacuacugcgccgggcucaagaaggucaccgaggugaagggguacacgaagggcgggcccggccacgaggagcccauccccauggccaccuacggguggaaccuggugaagcugcacuccggcaaggacgucuucuucaucccgcccgagaagugcgacacccuccugugcgacaucggggagagcucccccaaccccaccaucgaggagggccgcacgcugcgggugcucaagaugguggagccguggcugcgcgggaaccaguucugcaucaagauccugaaccccuacaugcccagcgucguggagacccucgagcagaugcagcggaagcacggcggcaugcuggugcgcaacccccugucccggaacagcacccacgagauguacugggucuccugcgggaccggcaacaucgugagcgccgugaacaugaccucccgcaugcuccugaaccgguucacgauggcgcaccgcaagccgaccuacgagcgcgacgucgaccugggggccggcacccggcacguggccguggagcccgaggucgccaaccucgacaucaucggccagcgcaucgagaacaucaagcacgagcacaagagcaccuggcacuacgacgaggacaaccccuacaagacgugggccuaccacggguccuacgaggugaagcccagcggcagcgcguccagcauggucaacgggguggugaagcugcugaccaagccgugggacgucauccccauggugacccagaucgccaugaccgacacgacccccuucggccagcagcggguguucaaggagaaggucgacacccgcacccccaaggccaagcgggggacggcccagaucauggaggugaccgccaaguggcucuggggcuuccugucccgcaacaagaagccgcggaucugcacccgcgaggaguucacccggaaggugcgcagcaacgcggccaucggcgccgucuucguggacgagaaccaguggaacuccgccaaggaggcgguggaggacgagcgguucugggaccugguccaccgcgagcgggagcuccacaagcaggggaagugcgccacgugcguguacaacaugaugggcaagcgcgagaagaagcugggggaguucggcaaggccaaggggagccgggccaucugguacauguggcugggcgcccgcuuccucgaguucgaggcgcugggcuucaugaacgaggaccacugguucucccgggagaacagccuguccgggguggagggcgaggggcuccacaagcugggcuacauccugcgcgacaucagcaagauccccgggggcaacauguacgccgacgacaccgccggcugggacacccggaucaccgaggacgaccuccagaacgaggccaagaucacggacaucauggagcccgagcacgcccugcuggcgaaguccaucuucaagcucaccuaccagaacaaggucgugcgcgugcagcggccggccaagaacgggaccgucauggacgugaucagccgccgcgaccagcggggcuccggccaggugggcaccuacggccugaacacguucaccaacauggaggcccagcugauccgccagauggagagcgaggggaucuucucccccagcgagcucgagacccccaaccuggccggccggguccuggacuggcucgagaagcacgggguggagcgccugaagcggauggccaucuccggcgacgacugcguggucaagcccaucgacgaccgcuucgcgaccgcccugacggcccucaacgacauggggaaggugcggaaggacaucccgcagugggagcccagcaagggcuggaacgacuggcagcagguccccuucugcagccaccacuuccaccagcugaucaugaaggacggccgcgagaucgucgugcccugccggaaccaggacgagcugguggggcgcgcccgggucucccagggcgccggguggagccuccgcgagaccgcgugccugggcaaguccuacgcccagauguggcagcugauguacuuccaccggcgcgaccuccggcuggccgccaacgcgaucugcagcgccgugccgguggacuggguccccaccucccgcaccacguggagcauccacgcccaccaccaguggaugaccaccgaggacaugcuguccguguggaaccggguguggaucgaggagaaccccuggauggaggacaagacccacaucagcuccuggggcgacguccccuaccucggcaagcgcgaggaccaguggugcggcagccugaucgggcugacggcccgggccaccugggcgaccaacauccagguggccaucaaccaggugcgccgccucaucggcaacgagaacuaccuggacuacaugaccuccaugaagcgguucaagaacgagagcgacccggagggggcccugugguga

SEQ ID NO: 8435 - RNA, 9879 nt, Artificial Sequence
  derived and/or modified CDS sequence (opt1) from DENV-1__FJ410276__SS-prME
agcgugaccauguuccugaugcugaugcccaccgcccuggccuuccaccugaccacccggggcggggagccccacaugaucgugagcaagcaggagcggggcaagagccuccuguucaagaccuccgccggggugaacaugugcacccugaucgccauggaccucggcgagcugugcgaggacaccaugaccuacaagugcccccgcaucaccgagaccgagcccgacgacguggacugcuggugcaacgccacggacaccugggucaccuacgggaccugcagccagacgggcgagcaccggcgcgacaagcgguccguggcccuggcgccccacgugggccucgggcuggagacccgcaccgagaccuggaugagcuccgagggcgcguggaagcagauccagcgggucgagacgugggcccugcgccaccccggguucaccgugaucgcccucuuccuggcccacgcgaucggcaccagcaucacccagaaggggaucaucuucauccugcucaugcuggugacgcccuccauggccaugcggugcgucggcaucggcagccgcgacuucguggaggggcuguccggcgccaccuggguggacgucgugcucgagcacgggagcugcgugaccaccauggccaaggacaagcccacgcuggacaucgagcugcucaagaccgaggucaccaaccccgccgugcugcggaagcugugcaucgaggcgaagaucuccaacaccacgaccgacagccgcugcccgacccagggcgaggccacccucguggaggagcaggacgccaacuucgucugccggcgcacguucguggaccggggcugggggaacggcugcgggcuguucggcaaggggucccugaucacgugcgccaaguucaagugcgugaccaagcucgagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcugaccgacuacggggcccucacgcuggacugcagcccccgcaccggccuggacuucaacgagaugguccuccugaccaugaaggagaaguccuggcuggugcacaagcagugguuccucgaccugccccugcccuggaccagcggggccagcacgucccaggagaccuggaaccggcaggaccuccuggugaccuucaagaccgcccacgccaagaagcaggaggucguggugcugggcagccaggagggcgcgaugcacacggcccucaccggggccaccgagauccagaccuccggcacgaccaccaucuucgccgggcaccugaagugccgccugaagauggacaagcucacccugaagggcaugagcuacgucaugugcacgggguccuucaagcuggagaaggagcucgccgagacccagcacggcaccgugcuggugcagaucaaguacgagggcaccgacgcgcccugcaagauccccuuccugacgcaggacgagaagggggucacccagaacggccggcugaucaccgccaacccgaucgugaccgacaaggagaagcccgugaacaucgaggccgagccgcccuucggggagagcuacaucgucaucggcgccggcgagaaggcgcucaagcuguccugguucaagaaggggagcuccaucggcaagauguucgaggccacggcccgcggggcccggcgcauggccauccugggcgacaccgcgugggacuucgggagcaucggcggcguguucaccuccguggggaagcucguccaccagaucuucggcaccgccuacggggugcuguucagcggcguguccuggacgaugaagaucgggaucggcguccugcucaccuggcugggccugaacagccgcuccaccagccucuccaugaccugcaucgccguggggcuggugacgcuguaccucggcgucauggugcaggccgacagcgggugcgugaucaacuggaagggccgggagcugaagugcggguccggcaucuucgucaccaacgaggugcacaccuggaccgagcaguacaaguuccaggccgacagcccgaagcgccugagcgcggccaucggcaaggccugggaggagggggugugcggcauccgguccgccacccgccucgagaacaucauguggaagcagaucagcaacgagcugaaccacauccugcucgagaacgacaugaaguucacggucguggugggggacgucgccggcauccuggcgcaggggaagaagaugauccggccccagcccauggaguacaaguacuccuggaaguccuggggcaaggccaagaucaucggcgccgacgugcagaacaccaccuucaucaucgacgggcccaacaccccggagugccccgacgaccagcgcgccuggaacaucugggagguggaggacuacggcuucgggaucuucacgaccaacaucuggcugaagcuccgggacuccuacacccaggucugcgaccaccgccugaugagcgcggccaucaaggacuccaaggccgugcacgccgacaugggcuacuggaucgagagcgagaagaacgagaccuggaagcuggcccgggcguccuucaucgaggugaagacgugcaucuggcccaagagccacacccucugguccaacggcguccuggagagcgagaugaucauccccaagaucuacgggggcccgaucucccagcacaacuaccgccccggguacuucacccagaccgccggccccuggcaccuggggaagcucgagcuggacuucgaccugugcgagggcacgaccgugguggucgacgagcacugcggcaaccgggggccgagccuccgcaccaccacggugaccggcaagaucauccacgaguggugcugccgguccugcacccugccgccccugcgcuuccgcggggaggacggcugcugguacgggauggagauccgccccgugaaggagaaggaggagaaccucgucaagagcaugguguccgccggcagcggcgagguggacagcuucucccuggggcugcucugcaucagcaucaugaucgaggaggucaugcggucccgcuggagccggaagaugcugaugaccggcacgcuggccguguucuuccuccugaucauggggcagcugaccuggaacgaccucauccgccugugcaucauggugggcgccaacgcguccgaccgcauggggaugggcaccaccuaccuggcccucauggccacguucaagaugcggccgauguucgccgucggccugcuguuccgccggcucaccagccgcgaggugcugcugcucaccaucgggcugucccugguggccagcgucgagcuccccaacucccuggaggagcugggcgacgggcucgcgaugggcaucaugauccugaagcugcucaccgacuuccagagccaccagcugugggccacgcugcucucccugaccuucaucaagaccaccuucagccugcacuacgccuggaagacgauggccauggugcucuccaucgucagccuguucccccugugccucuccaccaccagccagaagaccacguggcugcccgugcugcucggcucccuggggugcaagccgcugaccauguuccucaucgcggagaacaagaucuggggccggcgcagcuggccccugaacgaggggaucauggccgugggcaucgucuccauccugcucagcagccugcugaagaacgacgugccccucgccgggccccugaucgccggcggcaugcugaucgccugcuacgugaucuccgggagcuccgcggaccucagccuggagaaggccgccgaggucuccugggaggaggaggccgagcacagcggcgccucccacaacauccugguggaggugcaggacgacgggaccaugaagaucaaggacgaggagcgggacgacacccucaccauccugcugaaggcgacgcuccuggccgucagcggcguguacccgcuguccauccccgccacccucuucgugugguacuucuggcagaagaagaagcagcgcagcgggguccugugggacacccccagcccgcccgagguggagcgggccgugcuggacgacggcaucuaccgcaucaugcagcggggccugcucgggcgcagccaggucggcguggggguguuccaggagaacgucuuccacaccauguggcacgugacgcggggcgccgugcugauguaccaggggaagcgccuggagcccuccugggcgagcgucaagaaggaccucaucuccuacggcggcggguggcggcugcagggcagcuggaacaccggggaggagguccaggugaucgccgucgagcccggcaagaaccccaagaacgugcagaccgcccccgggaccuucaagacgcccgagggcgaggugggcgccaucgcccuggacuucaagcccgggaccuccggcagccccaucgucaaccgcgaggggaagaucgugggccucuacggcaacgggguggucaccaccuccggcacguacgugagcgcgaucgcccaggcccgggccagccaggaggggccgcugcccgagaucgaggacgagguguuccgcaagcggaaccugaccaucauggaccuccaccccggcuccgggaagacccgccgguaccugccggcgaucguccgcgaggccaucaagcgcaagcugcggacccucauccuggcccccacgcgcgugguggccagcgagauggccgaggcgcugaagggcaugcccauccgguaccagaccaccgccgucaaguccgagcacaccggcaaggagaucguggaccucaugugccacgccacguucaccaugcgccugcugagccccgugcgggucccgaacuacaacaugaucaucauggacgaggcccacuucaccgaccccuccagcaucgccgcgcgcggguacaucuccacccgggugggcaugggggaggccgccgccaucuucaugacggccacgccgcccggcagcguggaggcguucccgcaguccaacgccgucauccaggacgaggagcgcgacauccccgagcggagcuggaacuccggguacgaguggaucaccgacuuccccggcaagaccgugugguucgugcccagcaucaaguccggcaacgacaucgccaacugccuccgcaagaacgggaagcgggucauccagcugagccgcaagacguucgacaccgaguaccagaagaccaagaacaacgacugggacuacguggugaccacggacaucuccgagaugggcgccaacuuccgggcggaccgcgucaucgacccgcggcgcugccugaagcccgugauccucaaggacgggcccgagcgggugauccuggccggccccaugccggucaccguggccagcgccgcccagcgccgggggcgcaucggccgcaaccacaacaaggagggcgaccaguacaucuacauggggcagccccugaacaacgacgaggaccacgcgcacuggaccgaggccaagaugcuccuggacaacaucaacacccccgagggcaucauccccgcccuguucgagccggagcgggagaaguccgccgccaucgacggggaguaccgccuccggggcgaggcgcgcaagacguucgucgagcugaugcggcgcggggaccugcccguguggcucagcuacaagguggccuccgagggcuuccaguacagcgaccggcgcuggugcuucgacggcgagcggaacaaccagguccuggaggagaacauggacguggagaucuggaccaaggagggggagcgcaagaagcugcggccccgcuggcucgacgcccggaccuacagcgacccccuggcccugcgcgaguucaaggaguucgccgcgggccggcgcuccgugagcggggaccucauccuggagaucggcaagcugccgcagcaccucacccagcgggcccagaacgcccuggacaaccuggucaugcuccacaacuccgagcagggcgggcgcgccuaccggcacgcgauggaggagcugcccgacacgaucgagacccugaugcuccuggcccugaucgccgugcucaccggcggggugacccuguucuuccugagcggccgcgggcucggcaagaccuccaucggccugcugugcgucauggccagcuccgugcuccuguggauggccagcguggagccccacuggaucgcggccuccaucauccuggaguucuuccucaugguccugcugauccccgagccggaccggcagcgcacgccccaggacaaccagcucgccuacguggugaucgggcugcuguucaugauccucaccgucgccgccaacgagaugggccugcuggagaccaccaagaaggaccucgggaucggccacguggcgguggagaaccaccaccacgccgccaugcuggacgucgaccugcaccccgccagcgccuggacgcucuacgcgguggccaccaccaucaucaccccgaugaugcgccacacgaucgagaacaccaccgccaacaucucccugaccgccaucgccaaccaggcggccauccugauggggcucgacaagggcuggcccaucagcaagauggacaucggcgugccccugcuggcccucgggugcuacucccaggucaacccccugacgcugaccgccgcggugcucaugcugguggcccacuacgccaucaucggcccggggcugcaggccaaggccacccgggaggcgcagaagcgcaccgccgccggcaucaugaagaaccccacggucgacgggaucguggccaucgaccucgaccccguggucuacgacgccaaguucgagaagcagcugggccagaucaugcugcucauccugugcaccagccagauccugcucaugcggaccaccugggcgcugugcgaguccaucacgcuggccaccggcccccucaccacccugugggaggggagcccgggcaaguucuggaacacgaccaucgccguguccauggccaacaucuuccgcgggagcuaccuggccggcgcgggccucgccuucucccugaugaagucccucgggggcgggcggcgcgggaccggggcccagggcgagacccucggcgagaaguggaagcggcagcugaaccagcugagcaaguccgaguucaacacguacaagcgcagcgggaucauggagguggaccgguccgaggccaaggagggccucaagcgcggggagaccaccaagcacgcggucagccggggcaccgccaagcugcgcugguucguggagcggaaccuggugaagcccgaggggaaggucaucgaccugggcugcggccgcgggggcugguccuacuacugcgccgggcucaagaaggugacggaggugaagggcuacaccaagggcgggcccggccacgaggagcccaucccgauggccaccuacggguggaaccuggucaagcugcacagcggcaaggacguguucuucaucccgcccgagaagugcgacacccuccugugcgacaucggggaguccagccccaacccgacgaucgaggagggccggacccugcgcgugcucaagauggucgagcccuggcugcgggggaaccaguucugcaucaagauccugaaccccuacaugcccuccgugguggagacccucgagcagaugcagcgcaagcacggcggcaugcugguccggaacccgcugagccgcaacuccacccacgagauguacugggugagcugcgggaccggcaacaucguguccgccgucaacaugacgagccgcaugcuccugaaccgguucaccauggcgcaccgcaagcccaccuacgagcgggacguggaccugggggccggcacccgccacguggccgucgagcccgagguggccaaccucgacaucaucggccagcggaucgagaacaucaagcacgagcacaaguccacguggcacuacgacgaggacaaccccuacaagaccugggccuaccacgggagcuacgaggugaagccguccggcagcgcguccagcauggucaacgggguggucaagcugcugaccaagcccugggacgugauccccauggugacccagaucgccaugacggacaccacccccuucggccagcagcgcgucuucaaggagaagguggacacccggacgccgaaggccaagcgcgggaccgcccagaucauggaggugaccgccaaguggcucuggggcuuccugagccggaacaagaagccccgcaucugcacccgggaggaguucacgcgcaagguccgguccaacgcggccaucggcgccguguucguggacgagaaccaguggaacagcgccaaggaggcggucgaggacgagcgcuucugggaccuggugcaccgggagcgcgagcuccacaagcaggggaagugcgcgaccugcguguacaacaugaugggcaagcgggagaagaagcugggggaguucggcaaggccaaggggucccgcgccaucugguacauguggcugggcgcccgguuccucgaguucgaggcgcugggcuucaugaacgaggaccacugguucagccgcgagaacucccugagcggggucgagggcgaggggcuccacaagcugggcuacauccugcgggacaucuccaagauccccgggggcaacauguacgccgacgacaccgccggcugggacacccgcaucacggaggacgaccuccagaacgaggcccgcaucaccgacaucauggagccggagcacgcccugcuggccaagagcaucuucaagcucaccuaccagaacaagguggugcggguccagcgccccgccaagaacgggaccgugauggacgugaucucccggcgcgaccagcggggcagcgggcaggucggcacguacggccugaacaccuucaccaacauggaggcccagcugauccgccagauggaguccgaggggaucuucagccccuccgagcucgagacccccaaccuggccgagcgggugcuggacuggcucgagaaguacggcguggagcgccugaagcggauggccaucagcggggacgacugcgucgugaagccgaucgacgaccgcuucgcgacggcccugaccgcccucaacgacaugggcaaggugcggaaggacaucccccagugggagcccuccaagggguggaacgacuggcagcagguccccuucugcagccaccacuuccaccagcugaucaugaaggacggccgcgagaucguggugccgugccggaaccaggacgagcuggucggccgcgcccgggugucccagggggccggcuggagccuccgcgagaccgcgugccugggcaagagcuacgcccagauguggcagcugauguacuuccaccggcgcgaccuccggcuggccgccaacgcgaucugcuccgccgugcccgucgacuggauccccaccagccgcacgaccugguccauccacgcccaccaccaguggaugaccaccgaggacaugcugagcguguggaaccgcguguggaucgaggagaaccccuggauggaggacaagacgcacaucuccagcuggggcgacgucccguaccucgggaagcgggaggaccaguggugcggcucccugaucggccugaccgcccgcgccaccugggcgaccaacauccagguggccaucaaccaggugcggcgccucaucgggaacgagaacuaccuggacuacaugaccagcaugaagcgguucaagaacgaguccgaccccgagggcgcccugugguga

SEQ ID NO: 8436 - RNA, 9879 nt, Artificial Sequence
  derived and/or modified CDS sequence (opt1) from DENV-1__FJ410278__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgagaccgagcccgacgacguggacugcuggugcaacgccacggacaccugggucaccuacgggaccugcagccagacgggcgagcaccggcgggacaagcgguccguggcccucgcgccccacgugggccuggggcuggagacccgcaccgagaccuggaugagcuccgagggcgcguggaagcagauccagcgggucgagacgugggcccuccggcaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagguggccgagacccagcacggcaccgugcugguccagaucaaguacgagggcaccgacgcgcccugcaagauccccuucagcacgcaggacgagaagggggugacccagaacggccggcugaucaccgccaacccgaucgugaccgacaaggagaagcccgucaacaucgaggccgagccgcccuucggggaguccuacaucgugaucggcgccggcgagaaggcgcugaagcucagcugguucaagaagggguccagcaucggcaagauguucgaggccacggcccgcggggcccggcgcauggccauccugggcgacaccgcgugggacuucggguccaucggcggcguguucaccagcgucgggaagcuggugcaccagaucuucggcaccgccuacggggugcuguucuccggcgucagcuggacgaugaagaucgggaucggcgugcugcugaccuggcucggccugaacucccgcagcaccucccugagcaugaccugcaucgccguggggcucaucacgcuguaccugggcgucauggugcaggccgacuccgggugcgugaucaacuggaagggccgggagcucaagugcgggagcggcaucuucgucaccaacgaggugcacaccuggaccgagcaguacaaguuccaggccgacagcccgaagcgccuguccgcggccaucggcaaggccugggaggagggggugugcggcauccggagcgccacccgccuggagaacaucauguggaagcagaucuccaacgagcucaaccacauccugcuggagaacgacaugaaguucacggucguggugggggacgucgccggcauccucgcgcaggggaagaagaugauccggccccagcccauggaguacaaguacagcuggaaguccuggggcaaggccaagaucaucggcgccgacgugcagaacaccaccuucaucaucgacgggcccaacaccccggagugccccgacgaccagcgcgccuggaacaucugggagguggaggacuacggcuucgggaucuucacgaccaacaucuggcugaagcugcgggacagcuacacccaggucugcgaccaccgccucauguccgcggccaucaaggacagcaaggccgugcacgccgacaugggcuacuggaucgaguccgagaagaacgagaccuggaagcuggcccgggcgagcuucaucgaggugaagacgugcaucuggcccaagucccacacccuguggagcaacggcguccucgaguccgagaugaucauccccaagaucuacgggggcccgaucagccagcacaacuaccgccccggguacuucacccaggccgccggccccuggcaccuggggaagcuggagcucgacuucgaccugugcgagggcaccacggugguggucgacgagcacugcggcaaccgggggccgucccugcgcaccaccaccgugacgggcaagaucauccacgaguggugcugccggagcugcacccugccgccccuccgcuuccgcggggaggacggcugcugguacgggauggagauccgccccgugaaggagaaggaggagaaccuggucaaguccauggugagcgccggcagcggcgagguggacuccuucagccucgggcugcugugcaucuccaucaugaucgaggaggucaugcggagccgcuggucccggcgcaugcucaugaccggcacccuggccguguucuuccugcucaucauggggcagcugacguggaacgaccugauccgccucugcaucauggugggcgcgaacgccagcgaccggauggggaugggcaccaccuaccuggcccugauggccaccuucaagaugcgcccgauguucgccgucggccuccuguuccggcgccugacgucccgggaggugcuccugcugaccaucgggcucagccugguggcguccgucgagcugcccaacagccucgaggagcugggcgacgggcuggccaugggcaucaugauccucaagcugcugaccgacuuccagucccaccagcucugggccacccugcugagccucacguucaucaagaccaccuucucccugcacuacgccuggaagaccauggcgauggugcugagcaucgucucccucuucccccugugccugagcacgaccucccagaagaccaccuggcuccccgugcugcugggcagccucgggugcaagccgcugacgauguuccugaucgccgagaacaagaucuggggccgccgguccuggccccucaacgaggggaucauggccgugggcaucgucagcauccugcugagcucccuccugaagaacgacgugccccuggccgggccccucaucgccggcggcaugcugaucgcgugcuacgugaucagcggguccagcgccgaccugucccucgagaaggccgccgaggucagcugggaggaggaggccgagcacuccggcgcgagccacaacauccugguggaggugcaggacgacgggaccaugaagaucaaggacgaggagcgcgacgacacccugaccauccuccugaaggccacccugcucgccgucuccggcguguacccgcugagcauccccgccacgcuguucgugugguacuucuggcagcggaagaagcagcgcuccgggguccucugggacacccccagcccgcccgagguggagcgggccgugcuggacgacggcaucuaccgcaucaugcagcggggccugcuggggcgcucccaggucggcguggggguguuccaggagaacgucuuccacaccauguggcacgugacccggggcgcggugcucauguaccaggggaagcgccuggagcccagcugggccuccgucaagaaggaccugaucagcuacggcggcggguggcggcuccagggcuccuggaacacgggggaggagguccaggugaucgccgucgagcccggcaagaaccccaagaacgugcagaccgcccccgggaccuucaagacccccgagggcgaggugggcgccaucgcgcuggacuucaagcccgggacgagcggcucccccaucgucaaccgcgaggggaagaucgugggccuguacggcaacgggguggucaccaccagcggcaccuacgugagcgccaucgcccaggccaaggcgucccaggaggggccgcuccccgagaucgaggacgagguguuccggaagcgcaaccugacgaucauggaccugcaccccggcagcgggaagacccggcgcuaccucccggccaucguccgcgaggccaucaagcggaagcugcgcacccugauccucgcccccacccgggugguggccuccgagauggcggaggcccugaagggcaugcccauccgcuaccagacgaccgccgucaagagcgagcacaccggcaaggagaucguggaccugaugugccacgccaccuucacgaugcggcuccugucccccgugcgcgucccgaacuacaacaugaucaucauggacgaggcccacuucaccgaccccagcuccaucgcggcccggggguacaucagcacccgcgugggcaugggggaggccgccgccaucuucaugaccgcgacgccgcccggcuccguggaggccuucccgcagagcaacgccgucauccaggacgaggagcgggacauccccgagcgcuccuggaacagcggguacgaguggaucaccgacuuccccggcaagaccgugugguucgugcccuccaucaagagcggcaacgacaucgccaacugccugcggaagaacgggaagcgcgucauccagcucucccggaagaccuucgacacggaguaccagaagaccaagaacaacgacugggacuacguggugaccaccgacaucagcgagaugggcgcgaacuuccgcgccgaccgggucaucgacccgcgccggugccugaagcccgugauccugaaggacgggcccgagcgcgugauccucgccggccccaugccggucacgguggccuccgccgcgcagcggcgcgggcgcaucggccggaaccacaacaaggagggcgaccaguacaucuacauggggcagccccugaacaacgacgaggaccacgcccacuggaccgaggccaagaugcugcucgacaacaucaacacccccgagggcaucauccccgcccuguucgagccggagcgcgagaaguccgccgcgaucgacggggaguaccggcugcgcggcgaggcccggaagaccuucgucgagcucaugcgccgcggggaccugcccguguggcuguccuacaagguggccagcgagggcuuccaguacagcgaccgccgguggugcuucgacggcgagcgcaacaaccagguccucgaggagaacauggacguggagaucuggacgaaggagggggagcggaagaagcugcgcccccgguggcuggacgcccgcaccuacuccgacccccucgcccugcgggaguucaaggaguucgcggccggccgccggagcguguccggggaccugauccucgagaucggcaagcugccgcagcaccugacccagcgcgcccagaacgcccucgacaaccuggucaugcugcacaacagcgagcagggcgggcgggcguaccgccacgccauggaggagcuccccgacaccaucgagacgcugaugcugcucgcccugaucgccgugcugaccggcggggugacccucuucuuccuguccggccgggggcugggcaagaccagcaucggccuccugugcgucauggccuccagcgugcugcucuggauggcguccguggagccccacuggaucgccgccagcaucauccuggaguucuuccugaugguccuccugauccccgagccggaccgccagcgcacgccccaggacaaccagcuggccuacguggugaucgggcuccuguucaugauccugacggucgccgcgaacgagaugggccuccuggagaccaccaagaaggaccuggggaucggccacguggccguggagaaccaccaccacgccgccaugcucgacgucgaccugcaccccgccuccgcguggacccuguacgccguggccacgaccaucaucaccccgaugaugcggcacaccaucgagaacacgaccgccaacaucagccucaccgccaucgcgaaccaggccgccauccugauggggcuggacaagggcuggcccaucuccaagauggacaucggcgugccccuccuggcccuggggugcuacagccaggucaacccccucacccugacggcggccgugcugaugcucguggcccacuacgccaucaucggcccggggcugcaggccaaggcgacccgcgaggcccagaagcggaccgccgccggcaucaugaagaaccccaccgucgacgggaucguggccaucgaccuggaccccguggucuacgacgcgaaguucgagaagcagcucggccagaucaugcugcugauccucugcacgucccagauccugcugaugcgcaccaccugggcccucugcgagagcaucacccuggccacgggcccccugaccacccucugggagggguccccgggcaaguucuggaacaccacgaucgccgugagcauggccaacaucuuccggggguccuaccuggcgggcgccggccuggccuucagccucaugaagucccucgggggcgggcgccgggggaccggggcccagggcgagacccugggcgagaaguggaagcgccagcucaaccagcuguccaagagcgaguucaacaccuacaagcgguccgggaucauggagguggaccgcagcgaggcgaaggagggccugaagcgcggggagacgaccaagcacgccgucucccgcggcaccgccaagcuccggugguucguggagcgcaaccuggugaagcccgaggggaaggucaucgaccugggcugcggccgcgggggcuggagcuacuacugcgccgggcugaagaaggugaccgaggugaagggcuacacgaagggcggccccggccacgaggagcccaucccgauggccaccuacggguggaaccucgucaagcugcacuccggcaaggacguguucuucaucccgcccgagaagugcgacacccugcucugcgacaucggggagagcucccccaacccgaccaucgaggagggccgcacgcugcgggugcugaagauggucgagcccuggcuccgcgggaaccaguucugcaucaagauccugaaccccuacaugcccagcgugguggagacccuggagcagaugcagcggaagcacggcggcaugcucguccgcaacccgcugucccgcaacagcacccacgagauguacuggguguccugcgggaccggcaacaucgugagcgcggucaacaugaccucccggaugcugcucaaccgcuucacgauggcccaccggaagcccaccuacgagcgcgacguggaccugggggccggcacccggcacguggccgucgagcccgagguggccaaccuggacaucaucggccagcgcaucgagaacaucaagcacgagcacaagagcaccuggcacuacgacgaggacaaccccuacaagacgugggcguaccacggguccuacgaggugaagccgagcggcuccgccagcagcauggucaacgggguggucaagcuccugaccaagcccugggacgugauccccauggugacccagaucgccaugaccgacacgacccccuucggccagcagcgggucuucaaggagaagguggacacccgcaccccgaaggccaagcgggggacggcccagaucauggaggugaccgcgaaguggcuguggggcuuccucucccgcaacaagaagccccggaucugcacccgcgaggaguucacccggaagguccgcagcaacgccgccaucggcgccguguucguggacgagaaccaguggaacuccgcgaaggaggccgucgaggacgagcgguucugggaccuggugcaccgcgagcgggagcugcacaagcaggggaagugcgccacgugcguguacaacaugaugggcaagcgcgagaagaagcucggggaguucggcaaggccaaggggagccgggccaucugguacauguggcugggcgcgcgcuuccuggaguucgaggcccucggcuucaugaacgaggaccacugguucucccgggagaacagccuguccggggucgagggcgaggggcugcacaagcucggcuacauccugcgcgacaucagcaagauccccgggggcaacauguacgccgacgacaccgccggcugggacacccgcaucaccgaggacgaccugcagaacgaggcccggaucacggacaucauggagccggagcacgcgcuccuggccaaguccaucuucaagcugaccuaccagaacaagguggugcgcguccagcggcccgccaagaacgggaccgugauggacgugaucagccgccgggaccagcgcggcuccgggcaggucggcaccuacggccucaacacguucaccaacauggaggcccagcugauccggcagauggagagcgaggggaucuucucccccagcgagcuggagacccccaaccucgccgagcgcgugcuggacuggcuggagaaguacggcguggagcggcucaagcgcauggcgaucuccggggacgacugcgucgugaagccgaucgacgaccgguucgccaccgcccugacggcccugaacgacaugggcaaggugcgcaaggacaucccccagugggagcccagcaagggguggaacgacuggcagcagguccccuucugcucccaccacuuccaccagcucaucaugaaggacggccgggagaucguggugccgugccgcaaccaggacgagcuggucggccgggcccgcgugagccagggggcgggcuggagccugcgggagaccgccugccucgggaaguccuacgcccagauguggcagcugauguacuuccaccgccgggaccugcgccucgccgcgaacgccaucugcagcgccgugcccgucgacuggauccccaccucccgcaccacguggagcauccacgcccaccaccaguggaugaccaccgaggacaugcuguccguguggaaccggguguggaucgaggagaaccccuggauggaggacaagacccacaucagcuccuggggcgacgucccguaccuggggaagcgcgaggaccaguggugcggcagccucaucggccugacggcccgggcgaccugggccaccaacauccagguggccaucaaccaggugcgccggcugaucgggaacgagaacuaccucgacuacaugaccuccaugaagcgcuucaagaacgagagcgaccccgagggcgcccugugguga

SEQ ID NO: 8437 - RNA, 9879 nt, Artificial Sequence
  derived and/or modified CDS sequence (opt1) from DENV-1__FJ410279__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgaguucugcgaggacacgaugaccuacaagugcccccgcaucaccgaggccgagcccgacgacguggacugcuggugcaacgccaccgacacgugggugaccuacgggaccugcagccagaccggcgagcaccggcgggacaagcgguccguggcccuggcgccccacgugggccucgggcuggagacgcgcaccgagaccuggaugagcuccgagggcgccuggaagcagauccagcggguggagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugcccgacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaagaucguccaguacgagaaccugaaguacagcgugaucgugaccguccacaccggcgaccagcaccagguggggaacgaguccacggagcacggcaccaccgcgaccaucacgccccaggcccccagcacggagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccagcggggccuccaccagccaggagaccuggaaccggcaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcauguccuacgucaugugcaccgggagcuucaagcuggagaaggagguggcggagacccagcacggcacggugcucguccagaucaaguacgagggcaccgacgcccccugcaagauccccuucuccacccaggacgagaagggggugacccagaacggccggcugaucacggccaacccgaucgugaccgacaaggagaagcccgucaacaucgaggccgagccgcccuucggggagagcuacaucgugaucggcgcgggcgagaaggcccugaagcuguccugguucaagaaggggagcuccaucggcaagauguucgaggccaccgcccgcggggcccggcgcauggcgauccucggcgacaccgccugggacuucgggagcaucggcggcguguucacguccgucgggaagcuggugcaccagaucuucggcaccgccuacggggugcuguucagcggcgucuccuggaccaugaagaucgggaucggcgugcuccugaccuggcugggccucaacagccgcuccacgagccuguccaugaccugcaucgccguggggcuggucacccucuaccugggcgugauggugcaggccgacagcgggugcgucaucaacuggaagggccgggagcugaagugcgggagcggcaucuucgugaccaacgaggugcacacguggaccgagcaguacaaguuccaggcggacuccccgaagcgccucagcgccgccaucggcaaggccugggaggagggggucugcggcauccgguccgccacccgccuggagaacaucauguggaagcagaucagcaacgagcugaaccacauccuccuggagaacgacaugaaguucaccgugguggucggggacguggcgggcauccuggcccaggggaagaagaugauccggccccagcccauggaguacaaguacuccuggaaguccuggggcaaggccaagaucaucggcgccgacgugcagaacaccacguucaucaucgacgggcccaacaccccggagugccccgacgaccagcgcgcguggaacaucugggaggucgaggacuacggcuucgggaucuucaccaccaacaucuggcucaagcugcgggacuccuacacccaggugugcgaccaccgccugaugagcgccgccaucaaggacuccaaggccgugcacgccgacaugggcuacuggaucgagagcgagaagaacgagaccuggaagcucgcgcgggccuccuucaucgaggucaagaccugcaucuggcccaagagccacacccugugguccaacggcgugcuggagagcgagaugaucauccccaagaucuacgggggcccgaucucccagcacaacuaccgccccggguacuucacgcagaccgccggccccuggcaccucgggaagcuggagcuggacuucgaccucugcgagggcaccaccguggucguggacgagcacugcggcaaccgggggccgagccugcgcacgaccaccgugaccggcaagaucauccacgaguggugcugccgguccugcacgcugccgccccugcgcuucaagggggaggacggcugcugguacgggauggagauccggcccgucaaggagaaggaggagaaccuggucaagagcauggugagcgccggcuccggcgaggucgacagcuucucccuggggcuccugugcaucagcaucaugaucgaggaggugaugcgcucccgguggagccgcaagaugcugaugaccggcacccucgccguguucuuccugcugaucauggggcagcucaccuggaacgaccugauccggcugugcaucauggucggcgcgaacgccuccgaccgcauggggaugggcacgaccuaccucgcccugauggccaccuucaagaugcgcccgauguucgccgugggccuccuguuccggcgccugaccagccgggaggugcugcuccugacgaucgggcugucccucgucgcgagcguggagcugcccaacucccuggaggagcucggcgacgggcuggccaugggcaucaugauccugaagcuccugaccgacuuccagagccaccagcugugggccacccuccugucccugaccuucaucaagacgaccuucagccuccacuacgccuggaagaccauggcgaugguccuguccaucgugagccuguucccccucugccuguccaccacgagccagaagaccaccuggcugcccgugcuccugggcucccuggggugcaagccgcucaccauguuccugaucgccgagaacaagaucuggggccgcaagagcuggccccugaacgaggggaucauggccgucggcaucgugagcauccuccuguccagccugcucaagaacgacgugccccuggccgggccccugaucgccggcggcaugcucaucgcgugcuacgucaucuccgggagcuccgccgaccugagccuggagaaggccgccgagguguccugggaggaggaggccgagcacagcggcgcgucccacaacauccucguggagguccaggacgacgggacgaugaagaucaaggacgaggagcgggacgacacccugaccauccugcucaaggccacccugcuggccgugagcggcguguacccgcucuccauccccgccacccuguuccugugguacuucuggcagaagaagaagcagcgcagcgggguccucugggacacgcccagcccgcccgagguggagcgggccgugcuggacgacggcaucuaccgcaucaugcagcggggccugcuggggcgcagccaggucggcguggggguguuccaggagaacgucuuccacaccauguggcacgugacccggggcgcggugcucauguaccaggggaagcgccuggagcccuccugggccagcgucaagaaggaccugaucuccuacggcggcggguggcggcuccagggcagcuggaacaccggggaggagguccaggugaucgccgucgagcccggcaagaaccccaagaacgugcagacggcccccgggaccuucaagaccuccgagggcgaggugggcgccaucgcgcuggacuucaagcccgggaccagcggcagccccaucgucaaccgcgaggggaagaucgugggccuguacggcaacgggguggucacgaccuccggcaccuacgugagcgccaucgcccaggccaaggcgucccaggaggggccccucccggagaucgaggacgagguguuccggaagcgcaaccugaccaucauggaccugcaccccggcagcgggaagacgcggcgcuaccuccccgccaucguccgggaggccaucaagcgcaagcugcggacccugauccucgccccgacccgcgugguggccuccgagauggcggaggcccugaagggcaugcccauccgcuaccagaccacggccgucaagagcgagcacaccggcaaggagaucguggaccugaugugccacgccaccuucaccaugcggcuccugucccccgugcgcguccccaacuacaacaugaucaucauggacgaggcccacuucacggacccgagcuccaucgcggcccggggguacaucagcacccgcgugggcaugggggaggccgccgccaucuucaugaccgcgacgccgcccggcuccguggaggccuucccccagagcaacgccgucauccaggacgaggagcgggacaucccggagcgcuccuggaacagcggguacgaguggaucacggacuuccccggcaagaccgugugguucgugcccuccaucaagagcggcaacgacaucgccaacugccugcggaagaacgggaagcgcgucauccagcucucccggaagaccuucgacaccgaguaccagaagacgaagaacaacgacugggacuacguggugaccaccgacaucagcgagaugggcgcgaacuuccgcgccgaccgggucaucgacccccgccggugccugaagccggugauccugaaggacgggcccgagcgcgugauccucgccggccccaugcccgucaccguggccuccgccgcgcagcggcgcgggcggaucggccgcaaccacaacaaggagggcgaccaguacaucuacauggggcagccgcugaacaacgacgaggaccacgcccacuggacggaggccaagaugcugcucgacaacaucaacacccccgagggcaucauccccgcccuguucgagcccgagcgggagaaguccgccgcgaucgacggggaguaccgccugcgcggcgaggcccggaagaccuucgucgagcucaugcgccgcggggaccugccgguguggcugagcuacaagguggccuccgagggcuuccaguacagcgaccgccgguggugcuucgacggcgagcgcaacaaccagguccucgaggagaacauggacguggagaucuggaccaaggagggggagcggaagaagcugcgcccccgguggcuggacgcccgcguguacuccgacccccucgcccugcgggaguucaaggaguucgcggccggccgccggagcgucuccggggaccugauccucgagaucggcaagcugccccagcaccugacgcagcgcgcccagaacgcccucgacaaccuggugaugcugcacaacagcgagcagggcgggcgggcguaccgccacgccauggaggagcucccggacaccaucgagacccugaugcugcucgcccugaucgccgugcugaccggcggggucacccucuucuuccuguccggccgggggcugggcaagacgagcaucggccuccugugcgugauggccuccagcgugcugcucuggauggcguccgucgagccccacuggaucgccgccagcaucauccuggaguucuuccugauggugcuccugauccccgagcccgaccgccagcggaccccgcaggacaaccagcuggccuacguggucaucgggcuccuguucaugauccugaccguggccgcgaacgagaugggccuccuggagaccacgaagaaggaccuggggaucggccacguggccgucgagaaccaccaccacgccgccaugcucgacguggaccugcaccccgccuccgcguggacccuguacgccguggccaccaccaucaucacgcccaugaugcgccacaccaucgagaacaccaccgccaacaucagccucacggccaucgcgaaccaggccgccauccugauggggcuggacaagggcuggccgaucuccaagauggacaucggcgucccccuccuggcccuggggugcuacagccaggugaacccccucacccugaccgcggccgugcugaugcucgucgcccacuacgccaucaucggccccgggcugcaggccaaggcgacccgggaggcccagaagcgcacggccgccggcaucaugaagaacccgaccguggacgggaucguggccaucgaccuggaccccgucguguacgacgcgaaguucgagaagcagcucggccagaucaugcugcugauccucugcaccucccagauccugcugaugcgcaccacgugggcccucugcgagagcaucacccuggccaccggcccccugaccacgcucugggaggggucccccggcaaguucuggaacaccaccaucgccgugagcauggccaacaucuuccgggggagcuaccuggcgggcgccggccuggccuucucccucaugaagucccucgggggcgggcgccgggggaccggggcccagggcgagacgcugggcgagaaguggaagcgccagcucaaccagcuguccaagagcgaguucaacaccuacaagcgguccgggaucauggaggucgaccgcagcgaggcgaaggagggccugaagcgcggggagaccaccaagcacgccgugucccgcggcacggccaagcuccggugguucguggagcgcaaccuggucaagccggaggggaaggugaucgaccugggcugcggccgcggcggguggagcuacuacugcgccgggcugaagaaggugaccgaggucaagggguacaccaagggcgggcccggccacgaggagcccauccccauggccaccuacggguggaaccucgugaagcugcacuccggcaaggacguguucuucaucccgcccgagaagugcgacacgcugcucugcgacaucggggagagcucccccaaccccaccaucgaggagggccgcacccugcggguccugaagaugguggagccguggcuccgcgggaaccaguucugcaucaagauccugaaccccuacaugcccagcguggucgagacccuggagcagaugcagcggaagcacggcggcaugcucgugcgcaacccccugucccggaacagcacgcacgagauguacuggguguccugcgggaccggcaacaucgucagcgcggugaacaugaccucccgcaugcugcucaaccgguucaccauggcccaccgcaagccgaccuacgagcgcgacguggaccugggggccggcacgcggcacgucgccguggagcccgagguggccaaccuggacaucaucggccagcgcaucgagaacaucaagcacgagcacaagagcaccuggcacuacgacgaggacaaccccuacaagaccugggcguaccacggguccuacgaggucaagcccagcggcagcgccuccagcauggugaacggggucgugaagcuccugaccaagccgugggacgugauccccauggucacgcagaucgccaugaccgacaccacccccuucggccagcagcggguguucaaggagaagguggacacgcgcacccccaaggccaagcgggggaccgcccagaucauggaggucaccgcgaaguggcuguggggcuuccucucccgcaacaagaagccgcggaucugcacgcgcgaggaguucacccggaaggugcgcagcaacgccgccaucggcgccguguucgucgacgagaaccaguggaacuccgcgaaggaggccguggaggacgagcgguucugggaccuggugcaccgcgagcgggagcugcacaagcaggggaagugcgcgaccugcgucuacaacaugaugggcaagcgcgagaagaagcucggggaguucggcaaggccaaggggagccgggccaucugguacauguggcugggcgcgcgcuuccuggaguucgaggcccucggcuucaugaacgaggaccacugguucucccgggagaacagccuguccgggguggagggcgaggggcugcacaagcucggcuacauccugcgcgacaucagcaagauccccgggggcaacauguacgccgacgacaccgccggcugggacacgcggaucaccgaggacgaccugcagaacgaggccaagaucaccgacaucauggagcccgagcacgcgcuccuggccaaguccaucuucaagcugaccuaccagaacaaggugguccgcgugcagcggccggccaagaacgggacggugauggacgucaucagccgccgcgaccagcggggcuccggccaggugggcaccuacggccucaacaccuucaccaacauggaggcccagcugauccgccagauggagagcgaggggaucuucucccccagcgagcuggagacgcccaaccucgccggccgggugcuggacuggcuggagaagcacggggucgagcgccucaagcggauggcgaucuccggcgacgacugcguggugaagcccaucgacgaccgcuucgccaccgcccugaccgcccugaacgacauggggaagguccggaaggacaucccgcagugggagcccagcaagggcuggaacgacuggcagcagguccccuucugcagccaccacuuccaccagcucaucaugaaggacggccgcgagaucgugguccccugccggaaccaggacgagcugguggggcgcgcccgggugucccagggcgcgggguggagccugcgcgagaccgccugccucggcaaguccuacgcccagauguggcagcugauguacuuccaccggcgcgaccugcggcucgccgcgaacgccaucugcagcgccgucccgguggacugggugcccacgucccgcaccaccuggagcauccacgcccaccaccaguggaugaccacggaggacaugcuguccgucuggaaccggguguggaucgaggagaaccccuggauggaggacaagacccacaucagcuccuggggcgacgugcccuaccugggcaagcgcgaggaccaguggugcggcagccucaucgggcugaccgcccgggcgaccugggccacgaacauccaggucgccaucaaccaggugcgccgccugaucggcaacgagaacuaccucgacuacaugaccuccaugaagcgguucaagaacgagagcgacccggagggggcccugugguga

SEQ ID NO: 8438 - RNA, 9879 nt, Artificial Sequence
  derived and/or modified CDS sequence (opt1) from DENV-1__FJ410283__SS-prME
agcgugaccaugcugcugaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgagaccgagcccgacgacguggacugcuggugcaacgccacggacaccugggugaccuacgggaccugcagccagacgggcgagcaccggcgggacaagcgguccguggcccucgcgccccacgugggccuggggcuggagacccgcaccgagaccuggaugagcuccgagggcgccuggaagcagauccagcgggucgagacgugggcccuccggcaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagcuggccgagacccagcacggcaccgugcuggugcagaucaaguacgagggcaccgacgcgcccugcaagauccccuucagcacgcaggacgagaagggggucacccagaacggccggcugaucaccgccaacccgaucgugaccgacaaggagaagcccgugaacaucgaggccgagccgcccuucggggaguccuacaucgucaucggcgccggcgagaaggcgcucaagcugagcugguucaagaagggguccagcaucggcaagauguucgaggccacggcccgcggggcccggcgcauggccauccugggcgacaccgcgugggacuucggguccaucggcggcguguucaccagcgccgggaagcucgugcaccagaucuucggcaccgccuacgggguccuguucuccggcgugagcuggacgaugaagaucgggaucggcgugcugcucaccuggcugggccugaacucccgcagcaccucccucagcaugaccugcaucgccgucgggcuggugacgcuguaccucggcgugaugguccaggccgacuccgggugcgugaucaacuggaagggccgggagcugaagugcgggagcggcaucuucgugaccaacgagguccacaccuggaccgagcaguacaaguuccaggcggacagcccgaagcgccuguccgccgccaucggcaaggccugggaggagggggugugcggcauccggagcgccacccgccucgagaacaucauguggaagcagaucuccaacgagcugaaccacauccugcucgagaacgacaugaaguucacgguggucgugggggacguggcgggcauccuggcccaggggaagaagaugauccggccccagcccauggaguacaaguacagcuggaaguccuggggcaaggccaagaucaucggcgccgacguccagaacaccaccuucaucaucgacgggcccaacaccccggagugccccgacgaccagcgcgcguggaacaucugggagguggaggacuacggcuucgggaucuucacgaccaacaucuggcugaagcuccgggacagcuacacccaggugugcgaccaccgccugauguccgccgccaucaaggacagcaaggccguccacgccgacaugggcuacuggaucgaguccgagaagaacgagaccuggaagcuggcgcgggccagcuucaucgaggugaagacgugcaucuggcccaagucccacacccucuggagcaacggcgugcuggaguccgagaugaucauccccaagaucuacgggggcccgaucagccagcacaacuaccgccccggguacuucacccagaccgccggccccuggcaccuggggaagcucgagcuggacuucgaccugugcgagggcacgaccgucgugguggacgagcacugcggcaaccgggggccgucccuccgcaccaccacggucaccggcaagaucauccacgaguggugcugccggagcugcacccugccgccccugcgcuuccgcggggaggacggcugcugguacgggauggagauccgccccgugaaggagaaggaggagaaccucgugaaguccauggucagcgccggcagcggcgagguggacuccuucagccuggggcugcucugcaucuccaucaugaucgaggaggugaugcggagccgcuggucccggaagaugcugaugaccggcacgcuggccgucuucuuccuccugaucauggggcagcugaccuggaacgaccucauccgccugugcaucauggugggcgcgaacgccagcgaccgcauggggaugggcaccaccuaccuggcccucauggccacguucaagaugcggccgauguucgccgugggccugcuguuccgccggcucaccucccgcgagguccugcugcucaccaucgggcugagccugguggcguccguggagcuccccaacagccuggaggagcugggcgacgggcucgccaugggcaucaugauccugaagcugcucaccgacuuccagucccaccagcugugggccacgcugcucagccugaccuucaucaagaccaccuucucccugcacuacgccuggaagacgauggcgaugguccucagcaucgugucccuguucccccugugccucagcaccaccucccagaagaccacguggcugcccguccugcucggcagccuggggugcaagccgcugaccauguuccucaucgccgagaacaagaucuggggccggcgcuccuggccccugaacgaggggaucauggccgugggcaucgugagcauccugcucagcucccugcugaagaacgacgucccccucgccgggccccugaucgccggcggcaugcugaucgcgugcuacgugaucagcggguccagcgccgaccucucccuggagaaggccgccgaggugagcugggaggaggaggccgagcacuccggcgcgagccacaacauccuggucgaggugcaggacgacgggaccaugaagaucaaggacgaggagcgggacgacacccucaccauccugcugaaggccacgcuccuggccguguccggcgucuacccgcugagcauccccgccacccucuucgugugguacuucuggcagaagaagaagcagcgcuccggggugcugugggacacccccagcccgcccgaggucgagcgggccgugcuggacgacggcaucuaccgcaucaugcagcggggccugcucgggcgcucccaggugggcgucgggguguuccaggagaacguguuccacaccauguggcacgucacgcggggcgcggugcugauguaccaggggaagcgccuggagcccagcugggccuccgugaagaaggaccucaucagcuacggcggcggguggcggcugcagggcuccuggaacaccggggaggagguccaggugaucgccguggagcccggcaagaaccccaagaacguccagaccgcccccgggaccuucaagacgcccgagggcgaggugggcgccaucgcgcuggacuucaagcccgggaccagcggcucccccaucgugaaccgcgaggggaagaucgucggccucuacggcaacgggguggugaccaccagcggcacguacgucagcgccaucgcccaggccaaggcgucccaggaggggccgcugcccgagaucgaggacgagguguuccggaagcgcaaccugaccaucauggaccuccaccccggcagcgggaagacccggcgcuaccugccggccaucgugcgggaggccaucaagcgcaagcugcgcacccucauccuggcccccacgcgggucguggccuccgagauggcggaggcccugaagggcaugcccauccgcuaccagaccaccgccgucaagagcgagcacaccggcaaggagaucgucgaccucaugugccacgccacguucaccaugcggcugcugucccccgugcgcgugccgaacuacaacaugaucaucauggacgaggcccacuucaccgaccccagcuccaucgcggcccggggguacaucagcacccgcgucggcaugggggaggccgccgccaucuucaugacggcgacgccgcccggcuccguggaggccuucccgcagagcaacgccgugauccaggacgaggagcgggacauccccgagcgcuccuggaacagcggguacgaguggaucaccgacuuccccggcaagaccgucugguucgugcccuccaucaagagcggcaacgacaucgccaacugccuccggaagaacgggaagcgcgugauccagcugucccggaagacguucgacaccgaguaccagaagaccaagaacaacgacugggacuacgucgugaccacggacaucagcgagaugggcgcgaacuuccgcgccgaccgggugaucgacccgcgccggugccugaagcccgucauccucaaggacgggcccgagcgcgugauccuggccggccccaugccggugaccgucgccuccgccgcgcagcggcgcgggcggaucggccgcaaccacaacaaggagggcgaccaguacaucuacauggggcagccccugaacaacgacgaggaccacgcccacuggaccgaggccaagaugcuccuggacaacaucaacacccccgagggcaucauccccgcccuguucgagccggagcgcgagaaguccgccgcgaucgacggggaguaccggcuccgcggcgaggcccggaagacguucguggagcugaugcgccgcggggaccugcccgucuggcucuccuacaagguggccagcgagggcuuccaguacagcgaccgccgguggugcuucgacggcgagcgcaacaaccaggugcuggaggagaacauggacgucgagaucuggaccaaggagggggagcggaagaagcugcgcccccgguggcucgacgcccgcaccuacuccgacccccuggcccugcgggaguucaaggaguucgcggccggccgccggagcguguccggggaccucauccuggagaucggcaagcugccgcagcaccucacccagcgcgcccagaacgcccuggacaaccuggugaugcuccacaacagcgagcagggcgggcgggcguaccgccacgccauggaggagcugcccgacacgaucgagacccugaugcuccuggcccugaucgccguccucaccggcggggugacccuguucuuccuguccggccgggggcucggcaagaccagcaucggccugcugugcgugauggccuccagcguccuccuguggauggcguccguggagccccacuggaucgccgccagcaucauccuggaguucuuccucauggugcugcugauccccgagccggaccgccagcggacgccccaggacaaccagcucgccuacgucgugaucgggcugcuguucaugauccucaccguggccgcgaacgagaugggccugcuggagaccaccaagaaggaccucgggaucggccacgucgccguggagaaccaccaccacgccgccaugcuggacguggaccugcaccccgccuccgcguggacgcucuacgccgucgccaccaccaucaucaccccgaugaugcgccacacgaucgagaacaccaccgccaacaucagccugaccgccaucgcgaaccaggccgccauccugauggggcucgacaagggcuggcccaucuccaagauggacaucggcgugccccugcuggcccucgggugcuacagccaggugaacccccugacgcugaccgcggccguccucaugcugguggcccacuacgccaucaucggcccggggcugcaggccaaggcgacccgcgaggcccagaagcggaccgccgccggcaucaugaagaaccccacgguggacgggaucgucgccaucgaccucgaccccgugguguacgacgcgaaguucgagaagcagcugggccagaucaugcugcucauccugugcaccucccagauccugcucaugcgcaccaccugggcccugugcgagagcaucacgcuggccaccggcccccucaccacccugugggagggguccccgggcaaguucuggaacacgaccaucgccgucagcauggccaacaucuuccggggguccuaccuggcgggcgccggccucgccuucagccugaugaagucccucgggggcgggcgccgggggaccggggcccagggcgagacccucggcgagaaguggaagcgccagcugaaccagcuguccaagagcgaguucaacacguacaagcgguccgggaucauggagguggaccgcagcgaggcgaaggagggccucaagcgcggggagaccaccaagcacgccgugucccgcggcaccgccaagcugcggugguucgucgagcgcaaccuggugaagcccgaggggaaggugaucgaccugggcugcggccgcggcggguggagcuacuacugcgccgggcucaagaaggucacggaggugaagggguacaccaagggcggccccggccacgaggagcccaucccgauggccaccuacggguggaaccuggugaagcugcacuccggcaaggacgucuucuucaucccgcccgagaagugcgacacccuccugugcgacaucggggagagcucccccaacccgacgaucgaggagggccgcacccugcgggugcucaagaugguggagcccuggcugcgcgggaaccaguucugcaucaagauccugaaccccuacaugcccagcgucguggagacccucgagcagaugcagcggaagcacggcggcaugcuggugcgcaacccgcugucccggaacagcacccacgagauguacugggucuccugcgggaccggcaacaucgugagcgcggugaacaugacgucccgcaugcuccugaaccgcuucaccauggcccaccggaagcccaccuacgagcgcgacgucgaccugggggccggcacccggcacguggccguggagcccgaggucgccaaccucgacaucaucggccagcgcaucgagaacaucaagcacgagcacaagagcacguggcacuacgacgaggacaaccccuacaagaccugggcguaccacggguccuacgaggugaagccgagcggcuccgccagcagcauggugaacggggucgugaagcugcugaccaagcccugggacgucauccccauggugacccagaucgccaugacggacaccacccccuucggccagcagcggguguucaaggagaaggucgacacccgcacgccgaaggccaagcgggggaccgcccagaucauggaggugaccgcgaaguggcucuggggcuuccugucccgcaacaagaagccccggaucugcacccgcgaggaguucacgcggaaggugcgcagcaacgccgccaucggcgccgucuucguggacgagaaccaguggaacuccgcgaaggaggccguggaggacgagcgguucugggaccugguccaccgcgagcgggagcuccacaagcaggggaagugcgcgaccugcguguacaacaugaugggcaagcgcgagaagaagcugggggaguucggcaaggccaaggggagccgggccaucugguacauguggcugggcgcgcgcuuccucgaguucgaggcccugggcuucaugaacgaggaccacugguucucccgggagaacagccuguccgggguggagggcgaggggcuccacaagcugggcuacauccugcgcgacaucagcaagauccccgggggcaacauguacgccgacgacaccgccggcugggacacccggaucacggaggacgaccuccagaacgaggcccgcaucaccgacaucauggagccggagcacgcgcugcuggccaaguccaucuucaagcucaccuaccagaacaaggucgugcgcgugcagcggcccgccaagaacgggaccgucauggacgugaucagccgccgggaccagcgcggcuccggccagguggggacguacggccugaacaccuucaccaacauggaggcccagcugauccggcagauggagagcgaggggaucuucucccccagcgagcucgagacccccaaccuggccgagcgcguccuggacuggcucggcaaguacgggguggagcggcugaagcgcauggcgaucuccggcgacgacugcguggucaagccgaucgacgaccgguucgccacggcccugaccgcccucaacgacauggggaaggugcgcaaggacaucccccagugggagcccagcaagggcuggaacgacuggcagcagguccccuucugcucccaccacuuccaccagcugaucaugaaggacggccgggagaucgucgugccgugccgcaaccaggacgagcugguggggcgggcccgcgucagccagggcgcgggguggagccuccgggagaccgccugccugggcaaguccuacgcccagauguggcagcugauguacuuccaccgccgggaccuccgccuggccgcgaacgccaucugcagcgccgugcccguggacuggauccccaccucccggacgaccuggagcauccacgcccaccaccaguggaugaccaccgaggacaugcuguccgucuggaaccgcguguggaucgaggagaaccccuggauggaggacaagacgcacaucagcuccuggggcgacgugccguaccucggcaagcgcgaggaccaguggugcggcagccugaucgggcugaccgcccgggcgaccugggccaccaacauccaggucgccaucaaccaggugcgccggcucaucggcaacgagaacuaccuggacuacaugaccuccaugaagcgcuucaagaacgagagcgaccccgagggggcccugugguga

SEQ ID NO: 8439 - RNA, 9879 nt, Artificial Sequence
  derived and/or modified CDS sequence (opt1) from DENV-1__FJ410284__SS-prME
agcgugaccaugcugcucaugcugaugcccaccgcccuggccuuccaccucaccacccgcggcggggagccccacaugaucgugaccaagcaggagcggggcaagagccugcuguucaagaccagcgcgggggugaacaugugcacccucaucgccauggaccugggcgagcugugcgaggacaccaugaccuacaagugcccccggaucaccgaggccgagcccgacgacguggacugcuggugcaacgccaccgacaccugggugaccuacgggaccugcagccagacgggcgagcaccggcgcgacaagcggagcguggcccucgcgccccacgugggccuggggcuggagacccgcaccgagaccuggauguccagcgagggcgccuggaagcagauccagcgggucgagacgugggcccuccgccaccccggguucaccgugaucgcccuguuccuggcgcacgccaucggcaccuccaucacccagaaggggaucaucuucauccuccugaugcuggugacgcccagcauggccaugcggugcgucggcaucggcucccgcgacuucguggaggggcucagcggcgccaccuggguggacgucgugcuggagcacggguccugcgugaccaccauggccaaggacaagcccacgcuggacaucgagcuccugaagaccgaggucaccaaccccgcggugcugcggaagcucugcaucgaggccaagaucagcaacaccacgaccgacucccgcugccccacccagggcgaggccacccugauggaggagcaggacgccaacuucgugugccggcgcacguucgucgaccggggcugggggaacggcugcgggcuguucggcaaggggagccucaucacgugcgccaaguucaagugcgugaccaagcuggagggcaagaucgugcaguacgagaaccugaaguacuccgucaucgugaccgugcacacgggcgaccagcaccaggucgggaacgagagcaccgagcacggcaccaccgcgaccaucacgccccaggcccccaccuccgagauccagcucaccgacuacggggcccugacccuggacugcagcccccgcacgggccucgacuucaacgagauggugcugcugaccaugaaggagaaguccuggcucguccacaagcagugguuccuggaccugccgcuccccuggaccagcggggccagcaccucccaggagacguggaaccggcaggaccugcuggugaccuucaagaccgcccacgcgaagaagcaggagguggucgugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgugaugugcaccggguccuucaagcucgagaaggaggucgcggagacgcagcacggcaccgugcuggugcagaucaaguacgagggcaccgacgcccccugcaagauccccuucagcacccaggacgagaagggggucauccagaacggccggcugaucacggccaacccgaucgugaccgacaaggagaagcccgugaacaucgaggccgagccgcccuucggggaguccuacaucgucaucggcgugggcgagaaggcgcugaagcucagcugguucaagaagggguccagcaucggcaagauguucgaggccaccgcccgcggggcccggcgcauggccauccugggcgacaccgcgugggacuucggguccaucggcggcguguucacgagcgucgggaagcuggugcaccagaucuucggcaccgccuacgggguccuguucuccggcgucagcuggaccaugaagaucgggaucggcgugcugcugaccuggcucggccugaacucccgcagcacgucccugagcaugaccugcaucgccguggggcucgucacccuguaccugggcgugauggugcaggccgacuccgggugcgucaucaacuggaagggccgggagcucaagugcgggagcggcaucuucgugaccaacgaggugcacacguggaccgagcaguacaaguuccaggccgacagcccgaagcgccuguccgcggccaucggcaaggccugggaggagggggucugcggcauccggagcgccacccgccuggagaacaucauguggaagcagaucuccaacgagcucaaccacauccugcuggagaacgacaugaaguucaccgugguggucggggacguggugggcauccucgcccaggggaagaagaugauccggccccagcccauggagcacaaguacagcuggaaguccuggggcaaggcgaagaucaucggcgccgacguccagaacaccacguucaucaucgacgggcccaacaccccggagugccccgacgaccagcgcgccuggaacaucugggagguggaggacuacggcuucgggaucuucaccaccaacaucuggcugaagcugcgggacagcuacacgcaggccugcgaccaccgccucauguccgcggccaucaaggacagcaaggccgugcacgccgacaugggcuacuggaucgaguccgagaagaacgagaccuggaagcuggcccgggcgagcuucaucgaggucaagaccugcaucuggcccaagucccacacccuguggagcaacggcgugcucgaguccgagauggugauccccaagaucuacgggggcccgaucagccagcacaacuaccgccccggguacuucacgcagaccgccggccccuggcaccuggggaagcuggagcucgacuucgaccugugcgagggcaccaccgucgugguggacgagcacugcggcaaccgggggccgucccugcgcacgaccaccgucaccggcaagaucauccacgaguggugcugccggagcugcacgcugccgccccuccgcuucaagggggaggacggcugcugguacgggauggagauccggcccgugaaggagaaggaggagaaccuggugaaguccauggucagcgccggcagcggcgagguggacuccuucagccucgggcugcugugcaucuccaucaugaucgaggaggugaugcgcagccgguggucccgcaagaugcucaugaccggcacccuggccgucuuccugcuccugaucauggggcagcugaccuggaacgaccucauccggcugugcaucauggugggcgccaacgcgagcgaccgcauggggaugggcacgaccuaccuggcccucauggccaccuucaagaugcgcccgauguucgccgugggccugcuguuccggcgccucaccucccgggagguccugcugcucacgaucgggcugagccugguggccuccgucgagcuccccaacagccuggaggagcugggcgacgggcucgcgaugggcaucaugauccugaagcugcucaccgacuuccagucccaccagcugugggccacccugcucagccugaccuucaucaagacgacccugucccuccacuacgccuggaagaccauggccauggugcugagcaucgugucccuguucccccucugccugagcaccacgucccagaagaccaccuggcugcccguccuccugggcagccuggggugcaagccgcucaccauguuccugaucgcggagaacaagaucuggggccgcaaguccuggccccugaacgaggggaucauggccgugggcguggucagcauccuccugagcucccugcucaagaacgacgugccccuggccgggccccugaucgccggcggcaugcucaucgccugcuacgugaucagcggguccagcgcggaccugucccuggagaaggccgccgaggucagcugggaggaggaggccgagcacuccggcgccagccacaacauccucguggaggugcaggacgacgggacgaugaagaucaaggacgaggagaaggacgacacccugaccauccugcucaaggcgacccugcuggccgucuccggcguguacccgcucagcauccccgccacccuguucgugugguacuucuggcagaagaagaagcagcgguccgggguccugugggacacgcccagcccgcccgagguggagcgcgccgugcuggacgacggcaucuaccggaucaugcagcgcggccuccuggggcggucccaggucggcguggggguguuccaggagaacgucuuccacaccauguggcacgugacccgcggcgccgugcugauguaccaggggaagcggcucgagcccagcugggcguccgucaagaaggaccugaucagcuacggcggcggguggcgccugcagggcuccuggaacaccggggaggagguccaggugaucgccgucgagcccggcaagaaccccaagaacgugcagacggcccccgggaccuucaagacccccgagggcgaggugggcgccaucgcccucgacuucaagcccgggaccagcggcucccccaucgucaaccgggaggggaagaucgugggccuguacggcaacgggguggucacgaccagcggcaccuacgugagcgcgaucgcccaggccaaggccucccaggaggggccgcugcccgagaucgaggacgagguguuccgcaagcggaaccucaccaucauggaccugcaccccggcagcgggaagacgcgccgguaccugccggcgaucguccgcgaggccaccaagcggaagcuccgcacccugauccuggcccccacccgggugguggccuccgagauggccgaggcgcucaagggcaugcccauccgcuaccagacgaccgccgucaagagcgagcacaccggcaaggagaucguggaccugaugugccacgccaccuucacgaugcgccugcucucccccgugcgggucccgaacuacaacaugaucaucauggacgaggcccacuucaccgaccccagcuccaucgccgcgcgcggguacaucagcacccgggugggcaugggggaggccgccgccaucuucaugaccgccacgccgcccggcuccguggaggcguucccgcagagcaacgccgucauccaggacgaggagcgcgacauccccgagcgguccuggaacagcggguacgaguggaucaccgacuuccccggcaagaccgugugguucgugcccuccaucaagagcggcaacgacaucgccaacugccugcgcaagaacgggaagcgggucauccagcugucccgcaagaccuucgacacggaguaccagaagaccaagaacaacgacugggacuacguggugaccaccgacaucagcgagaugggcgccaacuuccgggcggaccgcgucaucgacccgcggcgcugccucaagcccgugauccugaaggacgggcccgagcgggucauccuggccggccccaugccggugacgguggccuccgccgcccagcgccgggggcgcaucggccggaaccacaacaaggagggcgaccaguacaucuacauggggcagccccucaacaacgacgaggaccacgcgcacuggaccgaggccaagaugcugcuggacaacaucaacacccccgagggcaucauccccgcccucuucgagccggagcgcgagaaguccgccgccaucgacggggaguaccggcugcgcggcgaggcgcgcaagaccuucgucgagcugaugcggcgcggggaccuccccguguggcuguccuacaagguggccagcgagggcuuccaguacagcgaccggcgcuggugcuucgacggcgagcggaacaaccagguccuggaggagaacauggacguggagaucuggacgaaggagggggagcgcaagaagcuccggccccgcuggcuggacgcccggaccuacuccgacccccuggcccuccgcgaguucaaggaguucgccgcgggccggcgcagcguguccggggaccugauccuggagaucggcaagcucccgcagcaccugacccagcgggcccagaacgcccuggacaaccucgucaugcugcacaacagcgagcagggcgggcgcgccuaccggcacgcgauggaggagcugcccgacaccaucgagacgcucaugcugcuggcccucaucgccgugcugaccggcggggugacccuguucuuccucuccggccgcgggcugggcaagaccagcaucggccugcucugcgucauggccuccagcgugcugcuguggauggccuccguggagccccacuggaucgcggccagcaucauccucgaguucuuccugaugguccugcucauccccgagccggaccggcagcgcacgccccaggacaaccagcuggccuacguggugaucgggcuccucuucaugauccugacggucgccgccaacgagaugggccugcucgagaccaccaagaaggaccuggggaucggccacguggcgguggagaaccaccaccacgccaccaugcuggacgucgaccuccaccccgccuccgccuggacgcuguacgccguggcgaccaccaucaucaccccgaugaugcggcacacgaucgagaacaccaccgccaacaucagccugaccgccaucgccaaccaggccgcgauccucauggggcuggacaagggcuggcccaucuccaagauggacaucggcgugccccugcucgcccuggggugcuacagccaggucaacccccugacgcucaccgccgccgugcugaugcugguggcgcacuacgccaucaucggcccggggcuccaggccaaggccacccgcgaggcccagaagcggaccgcggccggcaucaugaagaaccccacggucgacgggaucguggccaucgaccuggaccccguggucuacgacgccaaguucgagaagcagcugggccagaucaugcuccugauccugugcaccucccagauccuccugaugcgcaccaccugggcccugugcgagagcaucacgcucgcgaccggcccccugaccacccugugggagggguccccgggcaaguucuggaacacgaccaucgccgugagcauggccaacaucuuccgcggguccuaccucgccggcgccggccuggcguucagccugaugaagucccucgggggcgggcggcgcggcaccggggcccagggcgagacccugggcgagaaguggaagcggcagcugaaccagcucuccaagagcgaguucaacaucuacaagcgcuccgggaucauggagguggaccggagcgaggccaaggagggccugaagcgcggggagacgacccggcacgccgucucccgcggcaccgcgaagcugcggugguucguggagcgcaaccuggugaagcccgaggggaaggucaucgaccucggcugcggccgcggcggguggagcuacuacugcgccgggcugaagaaggugaccgaggugaagggguacacgaagggcgggcccggccacgaggagcccaucccgauggccaccuacggguggaaccuggucaagcuccacuccggcaaggacguguucuucacgccgcccgagaagugcgacacccugcugugcgacaucggggagagcucccccaacccgacgaucgaggagggccgcacccuccgggugcugaagauggucgagcccuggcugcgcgggaaccaguucugcaucaagauccucaaccccuacaugcccagcgugguggagacccuggagcagaugcagcggaagcacggcggcaugcugguccgcaacccgcucucccggaacagcacccacgagauguacuggguguccugcgggaccggcaacaucgugagcgccgucaacaugacgucccgcaugcugcugaaccgguucaccauggcccaccgcaagcccaccuacgagcgcgacguggaccucggggcgggcacccggcacguggccgucgagcccgagguggccaaccuggacaucaucggccagcgcaucgagaacaucaagcacgagcacaagagcacguggcacuacgacgaggacaaccccuacaagaccugggccuaccacggguccuacgaggucaagccgagcggcuccgccagcagcauggugaacgggguggucaagcugcucaccaagcccugggacgugauccccauggugacccagaucgcgaugacggacaccacccccuucggccagcagcgggucuucaaggagaagguggacacccgcacgccgaaggccaagcgggggaccgcccagaucauggaggugaccgcccgcuggcuguggggcuuccugucccggaacaagaagccccgcaucugcacccgggaggaguucacgcgcaagguccggagcaacgccgcgaucggcgccguguucguggacgagaaccaguggaacuccgccaaggaggccgucgaggacgagcgcuucugggaccucgugcagaaggagcgggagcugcacaagcaggggaagugcgcgaccugcguguacaacaugaugggcaagcgcgagaagaagcugggggaguucggcaaggccaaggggagccgggccaucugguacauguggcucggcgcccgcuuccuggaguucgaggcccugggcuucaugaacgaggaccacugguucucccgggagaacagccucuccggggucgagggcgaggggcugcacaagcugggcuacauccuccgcgacaucagcaagauccccgggggcaacauguacgcggacgacaccgccggcugggacacccggaucacggaggacgaccugcagaacgaggccaagaucaccgacaucauggagccggagcacgcccugcucgccaccuccaucuucaagcugaccuaccagaacaagguggugcgcguccagcggcccgcgaagaacgggacggugauggacgugaucagccgccgcgaccagcggggcuccgggcaggucggcaccuacggccugaacaccuucaccaacauggaggcccagcucauccgccagauggagagcgaggggaucuuccugcccuccgagcuggagacgcccaaccucgccgagcgggugcuggacuggcuggagaagcacggcguggagcgccucaagcggauggccaucagcggggacgacugcgucgugaagccgaucgacgaccgcuucgccaccgcgcugaccgcccugaacgacaugggcaaggugcggaaggacaucccccagugggagcccuccaagggguggaacgacuggcagcagguccccuucugcagccaccacuuccaccagcucaucaugaaggacggccgcgagaucguggugccgugccggaaccaggacgagcuggucggccgcgcccgggugucccagggggccggcuggagccugcgcgagaccgccugccucggcaagagcuacgcgcagauguggcagcugauguacuuccaccggcgcgaccugcggcucgccgccaacgccaucugcuccgcggugcccgucgacugggugcccacgagccgcaccaccugguccauccacgcccaccaccaguggaugaccacggaggacaugcugagcguguggaaccgggucuggaucgaggagaaccccuggauggaggacaagacccacguguccagcuggggcgacgugccguaccuggggaagcgcgaggaccaguggugcggcucccucaucggccugaccgcccgggccaccugggccagcaacauccaggucgcgaucaaccaggugcgccgccugaucgggaacgagaacuaccucgacuacaugaccuccaugaagcgguucaagaacgagggcgaccccgagggggcccugugguga

SEQ ID NO: 8440 - RNA, 9879 nt, Artificial Sequence
  derived and/or modified CDS sequence (opt1) from DENV-1__FJ410285__SS-prME
agcgugaccaugcugcucaugcugaugcccaccgcccuggccuuccaccucaccacccgcggcggggagccgcacaugaucgugagcaagcaggagcggggcaagagccugcuguucaagaccagcgccggggugaacaugugcacccucaucgccauggaccugggcgagcugugcgaggacaccaugaccuacaagugcccccgcaucaccgagaccgagcccgacgacguggacugcuggugcaacgccaccgacaccugggugaccuacgggaccugcagccagacgggcgagcaccggcgcgacaagcggagcguggcccucgcgccccacgugggccuggggcuggagacccgcaccgagaccuggaugagcuccgagggcgccuggaagcagauccagcggguggagacgugggcccuccgccaccccggguucaccgugaucgcccuguuccuggcccacgugaucggcaccagcaucacccagaaggggaucaucuucauccuccugaugcuggucacgcccuccauggcgaugcggugcgugggcaucggcagccgcgacuucguggaggggcucuccggcgccaccugggucgacguggugcuggagcacgggagcugcgucaccaccauggccaaggacaagcccacgcuggacaucgagcuccugaagaccgaggugaccaaccccgccgugcugcggaagcucugcaucgaggccaagaucuccaacaccacgaccgacagccgcugcccgacccagggcgaggcgacccuggucgaggagcaggacgccaacuucgugugccggcgcacguucguggaccggggcugggggaacggcugcgggcuguucggcaaggggucccucaucacgugcgccaaguucaagugcgucaccaagcuggagggcaagaucgugcagcacgagaaccugaaguacagcgugaucgucaccgugcacacgggcgaccagcaccaggucgggaacgaguccaccgagcacggcaccaccgccaccaucacgccccaggcccccaccaccgagauccagcucaccgacuacggggcgcugagccuggacugcagcccccggacgggccucgacuucaacgagauggugcugcugaccaugaaggagaaguccuggcucgugcacaagcagugguuccuggaccugccgcuccccuggaccagcggggccuccaccagccaggagacguggaaccggcaggaccugcuggucaccuucaagaccgcccacgccaagaagcaggagguggugguccucggcucccaggagggcgccaugcacaccgcgcugacgggggccaccgagauccagaccagcggcaccacgaccaucuucgccgggcaccugaagugccgccucaagauggacaagcugacccugaagggcauguccuacgugaugugcaccgggagcuucaagcucgagaaggagguggccgagacgcagcacggcaccguccuggugcagaucaaguacgagggcaccgacgcccccugcaagauccccuucuccacccaggacgagaagggggugacgcagaacggccggcugaucaccgcgaacccgaucgucaccgacaaggagaagcccgugaacaucgaggccgagccgcccuucggggagagcuacaucaucaucggcgccggcgagaaggcccugaagcucuccugguucaagaaggggagcuccaucggcaagauguucgaggcgaccgcccgcggggcccggcgcauggccauccugggcgacacggccugggacuucgggagcaucggcggcguguucaccuccgucgggaagcuggugcaccagaucuucggcaccgcguacggggugcuguucagcggcgucuccuggaccaugaagaucgggaucggcgugcugcugacguggcucggccugaacagccgcuccaccagccuguccaugaccugcaucgccguggggcucgucacccuguaccugggcgugauggugcaggccgacagcgggugcgucaucaacuggaagggccgggagcucaagugcgggagcggcaucuucgugacgaacgaggugcacaccuggaccgagcaguacaaguuccaggccgacuccccgaagcgccugagcgccgcgaucggcaaggccugggaggagggggucugcggcauccgguccgccacccgccuggagaacaucauguggaagcagaucagcaacgagcucaaccacauccugcuggagaacgacaugaaguucaccgugguggucggggacguggccggcauccucgcccaggggaagaagaugauccggccccagcccauggaguacaaguacuccuggaaguccuggggcaaggcgaagaucaucggcgccgacgugcagaacacgaccuucaucaucgacgggcccaacaccccggagugccccgacgaccagcgcgccuggaacaucugggaggucgaggacuacggcuucgggaucuucaccacgaacaucuggcugaagcugcgggacuccuacacccaggugugcgaccaccgccucaugagcgccgcgaucaaggacuccaaggccgugcacgccgacaugggcuacuggaucgagagcgagaagaacgagaccuggaagcuggcccgggccuccuucaucgaggucaagaccugcaucuggcccaagagccacacgcugugguccaacggcgugcucgagagcgagaugaucauccccaagaucuacgggggcccgaucucccagcacaacuaccgccccggguacuucacccagaccgcgggccccuggcaccuggggaagcuggagcucgacuucgaccugugcgagggcaccacgguggucguggacgagcacugcggcaaccgggggccgagccugcgcaccaccaccgugacgggcaagaucauccacgaguggugcugccgguccugcacccugccgccccuccgcuuccgcggggaggacggcugcugguacgggauggagauccgccccgucaaggagaaggaggagaaccuggucaagagcauggugagcgccggcccgggcgaggucgacuccuucagccucgggcugcugugcaucuccaucaugaucgaggaggugaugcggagccgcuggucccggaagaugcucaugaccggcacccuggccguguucuuccugcucaucauggggcagcugacguggaacgaccugauccgccucugcaucauggucggcgccaacgccagcgaccgcauggggaugggcaccaccuaccuggcgcugauggccaccuucaagaugcggcccauguucgccgugggccuccuguuccgccggcugacgucccgcgaggugcuccugcugaccaucgggcucagccuggucgccuccguggagcugcccaacagccucgaggagcugggcgacgggcuggccaugggcaucaugauccucaagcugcuggcggacuuccagucccaccagcucugggccacccugcugagccucaccuucaucaagacgaccuucucccugcacuacgccuggaagaccauggccaugguccugagcaucgugucccucuucccccugugccugagcaccacgucccagaagaccaccuggcucccggugcugcugggcagccucgggugcaagccccugaccauguuccugaucgcggagaacaagaucuggggccggcgcuccuggccccucaacgaggggaucauggccgucggcaucgugagcauccugcugagcucccuccugaagaacgacgugccccuggccgggccgcucaucgccggcggcaugcugaucgccugcuacgucaucagcggguccagcgcggaccugucccucgagaaggccgccgaggugagcugggaggaggaggccgagcacuccggcgccagccacaacauccugguggagguccaggacgacgggacgaugaagaucaaggacgaggagcgggacgacacccugaccauccuccugaaggcgacccugcucgccguguccggcguguacccccugagcauccccgccacccuguucgucugguacuucuggcagaagaagaagcagcgcuccggggugcucugggacacgcccagcccgcccgagguggagcgggccguccuggacgacggcaucuaccgcaucaugcagcggggccugcuggggcgcucccaggugggcgugggggucuuccaggagaacguguuccacaccauguggcacgugacccggggcgccguccucauguaccaggggaagcgccuggagcccagcugggcguccgugaagaaggaccugaucagcuacggcggcggguggcggcuccagggcuccuggaacaccggggaggaggugcaggucaucgccguggagcccggcaagaacccgaagaacgugcagacggcccccgggaccuucaagacccccgagggcgaggucggcgccaucgcccuggacuucaagcccgggaccagcggcuccccgaucgugaaccgcgaggggaagaucgugggccuguacggcaacggggucgugacgaccagcggcaccuacgugagcgcgaucgcccaggccaaggccucccaggaggggccccuccccgagaucgaggacgaggucuuccggaagcgcaaccugaccaucauggaccugcacccgggcagcgggaagacgcggcgcuaccuccccgcgaucgugcgggaggccaucaagcgccgccugcggacccugauccucgcccccacccgcguggucgccuccgagauggccgaggcgcugaagggcaugcccauccgguaccagaccacggccgucaagagcgagcacaccggcaaggagaucguggaccugaugugccacgccaccuucaccaugcgccuccuguccccgguccgggugcccaacuacaacaugaucaucauggacgaggcccacuucacggaccccagcuccaucgccgcgcgcggguacaucagcacccgggugggcaugggggaggccgccgccaucuucaugaccgccacgccgcccggcuccgucgaggcguucccccagagcaacgccgugauccaggacgaggagcgcgacauccccgagcgguccuggaacagcggguacgaguggaucacggacuuccccggcaagaccgugugguucguccccuccaucaagagcggcaacgacaucgccaacugccugcgcaagaacgggaagcgggugauccagcucucccgcaagaccuucgacaccgaguaccagaagacgaagaacaacgacugggacuacguggucaccaccgacaucagcgagaugggcgccaacuuccgggcggaccgcgugaucgacccccggcgcugccugaagcccgugauccugaaggacgggcccgagcgggucauccucgccggcccgaugcccgugaccgucgccuccgccgcccagcgccgggggcgcaucggccgcaaccacaacaaggagggcgaccaguacaucuacauggggcagccccugaacaacgacgaggaccacgcgcacuggacggaggccaagaugcugcucgacaacaucaacacccccgagggcaucaucccggcccuguucgagcccgagcgggagaaguccgccgccaucgacggggaguaccgccugcggggcgaggcgcgcaagaccuucguggagcucaugcggcgcggggaccugcccguguggcuguccuacaaggucgccagcgagggcuuccaguacagcgaccggcgcuggugcuucgacggcgagcggaacaaccaggugcucgaggagaacauggacguggagaucuggaccaaggagggggagcgcaagaagcugcggccccgcuggcuggacgcccggacguacuccgacccgcucgcccugcgcgaguucaaggaguucgccgcgggccggcgcagcgucuccggggaccugauccucgagaucggcaagcugccccagcaccugacccagcgggcccagaacgcccucgacaaccuggugaugcugcacaacagcgagcagggcgggcgcgccuaccggcacgcgauggaggagcuccccgacaccaucgagacccugaugcugcucgcccugaucgccgugcugacgggcggggucacccucuucuuccuguccggccgcgggcugggcaagaccagcaucggccuccugugcgugauggccuccagcgugcugcucuggauggccuccgucgagccccacuggaucgcggccagcaucauccuggaguucuuccugauggugcuccugaucccggagcccgaccggcagcgcacgccccaggacaaccagcuggccuacguggucaucgggcuccuguucaugauccugaccguggccgccaacgagaugggccuccuggagacgaccaagaaggaccuggggaucggccacguggcggucgagaaccaccaccacgccgccaugcucgacguggaccugcacccggccuccgccuggacccuguacgcgguggccaccacgaucaucacccccaugaugcgccacaccaucgagaacaccacggccaacaucagccucaccgccaucgccaaccaggcggccauccugauggggcuggacaagggcuggcccaucuccaagauggacaucggcgucccccuccuggcccuggggugcuacagccaggugaacccgcucacccugaccgccgcggugcugaugcucgucgcccacuacgccaucaucggccccgggcugcaggccaaggccacgcgggaggcgcagaagcgcaccgccgccggcaucaugaagaaccccaccguggacgggaucguggccaucgaccuggaccccgucguguacgacgccaaguucgagaagcagcucggccagaucaugcugcugauccucugcaccucccagauccugcugaugcggacgaccugggcgcucugcgagagcaucacccuggccaccggcccgcugacgacccucugggaggggucccccggcaaguucuggaacaccaccaucgccgugagcauggccaacaucuuccgcggguccuaccuggccggcgcgggccuggccuucagccucaugaagucccucgggggcgggcggcgcgggacgggggcccagggcgagacccugggcgagaaguggaagcggcagcucaaccagcuguccaagagcgaguucaacaccuacaagcgcuccgggaucauggaggucgaccggagcgaggccaaggagggccugaagcgcggggagaccacgaagcacgcggugucccggggcaccgccaagcuccgcugguucguggagcggaaccuggucaagcccgaggggaaggugaucgaccugggcugcggccgcgggggcuggagcuacuacugcgccgggcugaagaaggugaccgaggucaagggcuacaccaagggcggccccggccacgaggagccgauccccauggccacguacggguggaaccucgugaagcugcacuccggcaaggacguguucuucaucccgcccgagaagugcgacacccugcucugcgacaucggggagagcuccccgaaccccaccaucgaggagggccggacccugcgcguccugaagaugguggagcccuggcuccgggggaaccaguucugcaucaagauccugaaccccuacaugccgagcguggucgagacgcuggagcagaugcagcgcaagcacggcggcaugcucgugcggaacccccugucccgcaacagcacccacgagauguacuggguguccugcgggaccggcaacaucgucagcgccgugaacaugaccucccgcaugcugcucaaccgguucaccauggcgcaccgcaagcccacguacgagcgggacguggaccugggggccggcacccgccacgucgccguggagcccgagguggccaaccuggacaucaucggccagcggaucgagaacaucaagcacgagcacaagagcaccuggcacuacgacgaggacaacccguacaagaccugggccuaccacggguccuacgaggucaagcccagcggcuccgcgagcagcauggugaacggggucgugaagcuccugacgaagcccugggacgugauccccauggucacccagaucgccaugaccgacaccacgccguucggccagcagcgcguguucaaggagaagguggacacccggacccccaaggccaagcgcgggaccgcccagaucauggaggucacggccaaguggcuguggggcuuccucucccggaacaagaagccccgcaucugcacccgggaggaguucacccgcaaggugcggagcaacgcggccaucggcgccguguucgucgacgagaaccaguggaacuccgccaaggaggcgguggaggacgagcgcuucugggaccuggugcaccgggagcgcgagcugcacaagcaggggaagugcgcgaccugcgucuacaacaugaugggcaagcgggagaagaagcucggggaguucggcaaggccaaggggagccgcgccaucugguacauguggcugggcgcccgguuccuggaguucgaggcgcucggcuucaugaacgaggaccacugguucucccgcgagaacagccuguccgggguggagggcgaggggcugcacaagcucggcuacauccugcgggacaucagcaagauccccgggggcaacauguacgccgacgacacggccggcugggacacccgcaucaccgaggacgaccugcagaacgaggcccgcaucaccgacaucauggagcccgagcacgcccuccuggcgaaguccaucuucaagcugacguaccagaacaaggugguccgggugcagcgccccgccaagaacgggaccgugauggacgucaucagccggcgcgaccagcggggcuccggccagguggggaccuacggccucaacaccuucacgaacauggaggcccagcugauccgccagauggagagcgaggggaucuucucccccagcgagcuggagaccccgaaccucgccgagcgggugcuggacuggcuggagaaguacggcgucgagcgccucaagcggauggccaucuccggggacgacugcguggugaagcccaucgacgaccgcuucgcgaccgcccugaccgcccugaacgacaugggcaagguccggaaggacaucccccagugggagcccagcaagggguggaacgacuggcagcaggucccguucugcucccaccacuuccaccagcucaucaugaaggacggccgcgagaucgugguccccugccggaaccaggacgagcuggugggccgcgcccgggugagccagggggccggcuggagccugcgcgagacggcgugccucgggaaguccuacgcccagauguggcagcugauguacuuccaccggcgcgaccugcggcucgccgccaacgcgaucugcagcgccguccccguggacuggauccccaccucccgcaccaccuggagcauccacgcccaccaccaguggaugacgaccgaggacaugcuguccguguggaaccgcgucuggaucgaggagaacccguggauggaggacaagacccacaucagcuccuggggcgacgugcccuaccuggggaagcgggaggaccaguggugcggcagccucaucggccugaccgcccgcgccacgugggcgaccaacauccagguggccaucaaccagguccggcgccugaucgggaacgagaacuaccucgacuacaugaccuccaugaagcgguucaagaacgagagcgaccccgagggcgcccugugguga

SEQ ID NO: 8441 - RNA, 9879 nt, Artificial Sequence
  derived and/or modified CDS sequence (opt1) from DENV-1__FJ410286__SS-prME
agcgugaccaugcugcucaugcugaugcccaccgcccuggccuuccaccucaccacccggggcggggagccccacaugaucgucagcaagcaggagcggggcaagagccugcuguucaagaccagcgccggggugaacaugugcacccucaucgccauggaccugggcgagcugugcgaggacacgaugaccuacaagugcccccggaucaccgaggccgagcccgacgacguggacugcuggugcaacgccaccgacacgugggucaccuacgggaccugcagccagaccggcgagcaccggcgcgagaagcgguccguggcccucgcgccccacgugggccuggggcuggagacgcgcaccgagaccuggaugagcuccgagggcgccuggaagcagauccagcgggucgagaccugggcccuccgccaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcggugcugcggaagcucugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccuccugacgugcgccaaguucaagugcgugaccaagcuggagggcaagaucguccaguacgagaaccucaaguacagcgugaucgugaccguccacaccggcgaccagcaccagguggggaacgaguccacggagcacggcaccaccgcgaccaucacgccccaggcccccacgaccgagauccagcugaccgacuacggggcccugacccucgacugcagcccccgcacgggccuggacuucaacgagaugguccugcucaccaugaaggagaaguccuggcuggugcacaagcagugguuccuggaccucccccugcccuggaccagcggggccagcaccucccaggagacguggaaccggcaggaccugcucgugaccuucaagaccgcccacgcgaagaagcaggaggucguggugcugggcagccaggagggcgccaugcacaccgcccugacgggggccaccgagauccagaccuccggcaccacgaccaucuucgccgggcaccucaagugccgccugaagauggacaagcugacccucaagggcaugagcuacgucaugugcaccggguccuucaagcuggagaaggagguggcggagacgcagcacggcaccgugcugguccagaucaaguacgagggcaccgacgcccccugcaagauccccuucagcacccaggacgggaagggcgugacgcagaacgggcggcugaucaccgccaacccgaucgugaccgacaaggagaagcccgucaacaucgaggccgagccgcccuucggcgaguccuacaucgugaucggcgcgggggagaaggcccucaagcugagcugguucaagaagggcuccagcaucgggaagauguucgaggccaccgcccgcggcgcccggcgcauggcgauccugggggacacggccugggacuucggcuccaucggcgggguguucaccagcgucggcaagcucgugcaccagaucuucgggaccgccuacggcgugcuguucuccggggucagcuggaccaugaagaucggcaucggcgugcugcucacguggcuggggcugaacucccgcagcaccucccucagcaugaccugcaucgccgugggccuggucacccuguaccucggggugauggugcaggccgacuccggcugcgucaucaacuggaaggggcgggagcugaagugcggcagcggcaucuucgugacgaacgaggugcacaccuggaccgagcaguacaaguuccaggcggacagcccgaagcgccuguccgccgccaucgggaaggccugggaggagggcgucugcgggauccggagcgccacccgccucgagaacaucauguggaagcagaucuccaacgagcugaaccacauccugcucgagaacgacaugaaguucaccgugguggucggcgacguggcggggauccuggugcagggcaagaagaugauccggccccagcccauggaguacaaguacagcuggaaguccuggggcaaggccaagaucaucggggccgacguccagaacagcacguucaucaucgacggccccaacaccccggagugccccgacgaccagcgcgccuggaacaucugggagguggaggacuacggguucggcaucuucaccaccaacaucuggcugaagcuccgggacuccuacacccaggugugcgaccaccgccugaugagcgcggccaucaaggacuccaaggccguccacgccgacaugggcuacuggaucgagagcgagaagaacgagaccuggaagcuggcccgggcguccuucaucgaggugaagaccugcaucuggcccaagagccacacccucugguccaacggggugcuggagagcgagaugaucauccccaagauccacggcgggccgaucucccagcacaacuaccgccccggcuacuucacgcagaccgccgggcccuggcaccugggcaagcucgagcuggacuucgaccugugcgagggcaccaccgucgugguggacgagcacugcgggaaccggggcccgagccuccgcacgaccaccgucaccgggaagaucauccacgaguggugcugccgguccugcacgcugccgccccugcgcuuccggggcgaggacgggugcugguacggcauggagauccgccccgugaaggagaaggaggagaaccucgugaaguccauggucagcgccggcuccggggagguggacagcuucucccugggccugcucugcaucagcaucaugaucgaggaggugaugcggucccgcuggagccggaagaugcugaugaccgggacccuggccgucuucuuccuccugaucaugggccagcugaccuggaacgaccucauccgccugugcaucauggugggggccaacgcguccgaccgcaugggcaugggcacgaccuaccuggcccucauggccaccuucaagaugcggccgauguucgccguggggcugcuguuccgccggcucaccagccgcgagguccugcugcucacgaucggccugucccugguggccagcgucgagcuccccaacucccuggaggagcugggggacggccucgcgaugggcaucaugauccugaagcugcucaccgacuuccagagcuaccagcugugggccacccugcucucccugaccuucaucaagacgaccuucagccugcacuacgccuggaagaccauggccauggugcucuccaucgugagccuguucccccugugccucuccaccacgagccagaagaccaccuggcugcccguccugcucgggucccugggcugcaagccgcugaccauguuccucaucgcggagaacaagaucugggggcgcaagagcuggccccugaacgagggcaucauggccguggggaucgugagcauccugcucuccagccugcugaagaacgacgucccccucgccggcccccugaucgccggcgggaugcugaucgccugcuacgugaucuccggcagcuccgcggaccucagccuggagaaggccgccgagguguccugggaggaggaggccgagcacagcggggccucccacaacauccuggucgaggugcaggacgacggcacgaugaagaucaaggacgaggagcgcgacgacacccucaccauccugcugaaggcgacccuccuggccgugagcggggucuacccgcuguccauccccgccacccucuucguguggcacuucuggcagaagaagaagcagcggagcggcgugcugugggacacgcccagcccgcccgaggucgagcgcgccgugcuggacgacggcaucuaccggaucaugcagcgcgggcugcucggccggagccaggugggggucggcguguuccaggagaacguguuccacaccauguggcacgucacccgcggggccgugcugauguaccagggcaagcggcuggagcccuccugggcgagcgugaagaaggaccucaucuccuacggcgggggcuggcgcuuccaggggagcuggaacaccggcgaggagguccaggugaucgccguggagcccgggaagaaccccaagaacguccagacggcccccggcaccuucaagacccccgagggcgaggugggggccaucgcccuggacuucaagcccggcaccuccgggagccccaucgugaaccgggagggcaagaucgucggccuguacgggaacggcguggugacgaccagcgggaccuacgucuccgcgaucgcccaggccaaggccagccaggagggcccgcuccccgagaucgaggacgagguguuccgcaagcggaaccugaccaucauggaccugcaccccggguccggcaagacgcgccgguaccucccggcgaucgugcgcgaggccaucaagcggaagcugcgcacccugauccucgcccccacccgcgucguggccagcgagauggccgaggcgcugaagggcaugcccauccgguaccagaccacggccgugaaguccgagcacaccgggaaggagaucgucgaccugaugugccacgccaccuucaccaugcgccuccugagccccgugcgggugccgaacuacaacaugaucaucauggacgaggcccacuucacggaccccuccagcaucgccgcgcgcggcuacaucuccacccgggucgggaugggcgaggccgccgccaucuucaugaccgccacgccgcccgggagcauggaggcguucccgcaguccaacgccgugauccaggacgaggagcgcgacauccccgagcggagcuggaacuccggcuacgaguggaucacggacuuccccggcaagaccgugugguucguccccagcaucaaggccgggaacgacaucgccaacugccugcgcaagaacggcaagcgggugauccagcucucccgcaagaccuucgacaccgaguaccagaagacgaagaacaacgacugggacuacguggucaccaccgacaucagcgagaugggggcgaacuuccgggccgaccgcgugaucgacccgcggcgcugccugaagcccgugauccugaaggacggccccgagcgggucauccucgccgggcccaugccggugaccgucgccuccgccgcgcagcgccggggccgcaucggccggaaccacaacaaggagggggaccaguacaucuacaugggccagccccugaacaacgacgaggaccacgcccacuggacggaggccaagaugcugcucgacaacaucaacacccccgaggggaucauccccgcccuguucgagccggagcgcgagaaguccgccgcgaucgacggcgaguaccgccugcgcggggaggcccgcaagaccuucguggagcucaugcggcgcggcgaccugcccguguggcuguccuacaaggucgccagcgagggcuuccaguacagcgaccggcgcuggugcuucgacggggagcggaacaaccaggugcucgaggagaacauggacguggagaucuggaccaaggagggcgagcgcaagaagcugcggccccgcuggcuggacgcccggacguacuccgacccccucgcccugcgcgaguucaaggaguucgcggccgggcggcgcagcgucuccggcgaccugauccucgagaucggcaagcugccgcagcaccugacccagcgggcccagaacgcccucgacaaccuggugaugcugcacaacagcgagcagggcgggcgcgcguaccggcacgccauggaggagcuccccgacaccaucgagacccugaugcugcucgcccugaucgccgugcugaccggcggggucacccucuucuuccuguccgggaaggggcugggcaagaccagcaucgggcuccugugcgugauggccuccagcgugcugcucuggauggcguccgucgagccccacuggaucgccgccagcaucauccuggaguucuuccugauggugcuccugauccccgagccggaccgccagcggacgccccaggacaaccagcuggccuacguggucaucggccuccuguucaugauccugaccguggccgcgaacgagauggggcuccuggagacgaccaagaaggaccugggcaucgggcacguggccgucgagaaccaccaccacgccgccaugcucgacguggaccugcaccccgccuccgcguggacccuguacgccguggccaccacgaucaucaccccgaugaugcgccacaccaucgagaacaccacggccaacaucagccucaccgccaucgcgaaccaggccgccauccugaugggccuggacaagggcuggcccaucuccaagauggacaucggggucccccuccuggcccugggcugcuacagccaggugaacccccucacccugaccgcggccgugcugaugcucgucgcccacuacgccaucaucgggccgggccugcaggccaaggcgacgcgggaggcccagaagcgcaccgccgccgggaucaugaagaaccccaccaucgacggcaucguggccaucgaccuggaccccguggucuacgacgcgaaguucgagaagcagcucggccagaucaugcugcugauccucugcaccucccagauccugcugaugcgcacgaccugggcccucugcgagagcaucacccuggccaccgggccccugacgacccucugggagggcuccccggggaaguucuggaacaccaccaucgccgugagcauggccaacaucuuccggggcuccuaccuggcgggcgccgggcuggccuucagccucaugaagucccugggcgggggccgccgggggacgggcgcccagggcgagacccugggggagaaguggaagcgccagcucaaccagcuguccaagagcgaguucaacaccuacaagcgguccggcaucauggagguggaccgcagcgaggcgaaggaggggcugaagcggggcgagaccacgaagcacgccgucucccgcgggaccgccaagcuccggugguucguggagcgcaaccuggugaagcccgagggcaaggucaucgaccugggcugcgggcggggcggguggagcuacuacugcgccggccugaagaaggugaccgaggugaagggguacaccaagggcggccccgggcacgaggagcccaucccgauggccacguacggcuggaaccucgucaagcugcacuccgggaaggacguguucuucaucccgcccgagaagugcgacacccugcucugcgacaucggcgagagcucccccaacccgaccaucgaggaggggcgcacccugcgggugcugaagauggucgagcccuggcuccgcggcaaccaguucugcaucaagauccugaaccccuacaugcccagcgugguggagacgcuggagcagaugcagcggaagcacggcgggaugcucguccgcaacccgcugucccggaacagcacccacgagauguacuggguguccugcggcaccgggaacaucgugagcgcggucaacaugaccucccgcaugcugcucaaccgguucaccauggcccaccgcaagcccacguacgagcgcgacguggaccugggcgccggcacccggcacguggccgucgagcccgagguggccaaccuggacaucaucgggcagcgcaucgagaacaucaagcacgagcacaagagcaccuggcacuacgacgaggacaaccccuacaagaccugggcguaccacggcuccuacgaggugaagccgagcggguccgccagcagcauggucaacggcguggucaagcuccugacgaagcccugggacgugauccccauggugacccagaucgccaugaccgacaccacgcccuucgggcagcagcgggucuucaaggagaagguggacacccgcaccccgaaggccaagcggggcaccgcccagaucauggaggugacggcgcgcuggcuguggggcuuccucucccggaacaagaagccccgcaucugcacccgggaggaguucacccgcaagguccggagcaacgccgccaucggggccguguucguggacgagaaccaguggaacuccgcgaaggaggccgucgaggacgaccgcuucugggaccuggugcaccgggagcgcgagcugcacaagcagggcaagugcgcgaccugcguguacaacaugauggggaagcgggagaagaagcucggcgaguucgggaaggccaagggcagccgcgccaucugguacauguggcugggcgcgcgguuccuggaguucgaggcccucggguucaugaacgaggaccacugguucucccgcgagaacagccuguccggcgucgagggggagggccugcacaagcucggguacauccugcgggacaucagcaagauccccggcggcaacauguacgccgacgacacggccgggugggacacccgcaucaccgaggacgaccugcagaacgaggccaagaucaccgacaucauggagccggagcacgcgcuccuggccaaguccaucuucaagcugacguaccagaacaagguggugcggguccagcgccccgccaagaacggcaccgugauggacgugaucagccgccgggaccagcgcggguccggccaggucggcaccuacgggcucaacaccuucacgaacauggaggcccagcugauccggcagauggagagcgagggcaucuuccugcccaacgagcucgagacccccaaccuggccgggcgcgugcuggacuggcucgagaaguacggcguggagcggcugaagcgcauggcgaucuccggggacgacugcgucgugaagccgaucgacgaccgguucgccaccgcccugaccgcccucaacgacaugggcaaggugcgcaaggacaucccccagugggagcccagcaagggcuggaacgacuggcagcagguccccuucugcucccaccacuuccaccagcugaucaugaaggacgggcgggagaucguggugccgugccgcaaccaggacgagcuggucggccgggcccgcgugagccagggggcgggcuggucccuccgggagacggccugccugggcaagagcuacgcccagauguggcagcugauguacuuccaccgccgggaccuccgccuggccgcgaacgccaucugcagcgccgugcccgucgacugggugcccaccucccggaccaccuggagcauccacgcccaccaccaguggaugacgaccgaggacaugcuguccguguggaaccgcgucuggaucgaggagaaccccuggauggaggacaagacccggaucagcuccugggaggacgugccguaccucggcaagcgcgaggaccaguggugcggcagccugaucgggcugaccgcccgcgcgacgugggccaccaacauccagguggccaucaaccagguccggcgccucaucggcaacgagaacuacuccgacuacaugaccagcaugaagcgguucaagaacgaguccgagcccgagggggcccugugguga

SEQ ID NO: 8442 - RNA, 9879 nt, Artificial Sequence
  derived and/or modified CDS sequence (opt1) from DENV-1__FJ461339__SS-prME
agcgugaccaugcugcugaugcugaugcccaccgcccuggccuuccaccucaccacccggggcggggagccccacaugaucgugagcaagcaggagcggggcaagagccugcuguucaagaccuccgcgggggugaacaugugcacccucaucgccauggaccugggcgaguucugcgaggacaccaugaccuacaagugcccccgcaucaccgaggccgagcccgacgacguggacugcuggugcaacgccaccgacacgugggugaccuacgggaccugcagccagaccggcgagcaccggcgggacaagcgguccguggcccuggcgccccacgugggccucgggcuggagacgcgcaccgagaccuggaugagcuccgagggcgccuggaagcagauccagcgggucgagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugccccacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaagaucguccaguacgagaaccugaaguacagcgugaucgugaccguccacaccggcgaccagcaccagguggggaacgaguccacggagcacggcaccaccgcgaccaucacgccccaggcccccagcacggagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccagcggggccuccaccagccaggagaccuggaaccggcaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcauguccuacgucaugugcaccgggagcuucaagcuggagaaggagguggcggagacccagcacggcacggugcucguccagaucaaguacgagggcaccgacgcccccugcaagauccccuucuccacccaggacgagaagggggugacccagaacggccggcugaucacggccaaccccaucgugaccgacaaggagaagcccgucaacaucgaggccgagccgcccuucggggagagcuacaucgugaucggcgcgggcgagaaggcccugaagcuguccugguucaagaaggggagcuccaucggcaagauguucgaggccaccgcccgcggggcccggcgcauggcgauccucggcgacaccgccugggacuucgggagcaucggcggcguguucacguccgucgggaagcuggugcaccagaucuucggcaccgccuacggggugcuguucagcggcgucuccuggaccaugaagaucgggaucggcgugcuccugaccuggcugggccucaacagccgcuccacgagccuguccaugaccugcaucgccguggggcuggucacccucuaccugggcgugauggugcaggccgacagcgggugcgucaucaacuggaagggccgggagcugaagugcgggagcggcaucuucgugaccaacgaggugcacacguggaccgagcaguacaaguuccaggcggacuccccgaagcgccucagcgccgccaucggcaaggccugggaggagggggucugcggcauccgguccgccacccgccuggagaacaucauguggaagcagaucagcaacgagcugaaccacauccuccuggagaacgacaugaagcugaccgugguggucggggacguggcgggcauccucgcccaggggaagaagaugauccggccccagcccauggaguacaaguacuccuggaaguccuggggcaaggccaagaucaucggcgccgacgugcagaacaccacguucaucaucgacgggcccaacaccccggagugccccgacgaccagcgcgcguggaacaucugggaggucgaggacuacggcuucgggaucuucaccaccaacaucuggcugaagcugcgggacucccacacccaggugugcgaccaccgccucaugagcgccgccaucaaggacuccaaggccgugcacgccgacaugggcuacuggaucgagagcgagaagaacgagaccuggaagcuggcgcgggccuccuucaucgaggucaagaccugcaucuggcccaagagccacacccugugguccaacggcgugcucgagagcgagaugaucauccccaagaucuacgggggcccgaucucccagcacaacuaccgccccggguacuucacgcagaccgccggccccuggcaccuggggaagcuggagcucgacuucgaccugugcgagggcaccaccguggucguggacgagcacugcggcaaccgggggccgagccugcgcacgaccaccgugaccggcaagaucauccacgaguggugcugccgguccugcacgcugccgccccuccgcuucaagggggaggacggcugcugguacgggauggagauccggcccgucaaggagaaggaggagaaccuggucaagagcauggugagcgccggcuccggcgaggucgacagcuucucccucgggcugcugugcaucagcaucaugaucgaggaggugaugcgcucccgguggagccgcaagaugcucaugaccggcacccuggccguguucuuccugcucaucauggggcagcugaccuggaacgaccugauccggcucugcaucauggucggcgcgaacgccuccgaccgcauggggaugggcacgaccuaccuggcccugauggccaccuucaagaugcgcccgauguucgccgugggccuccuguuccggcgccugaccagccgggaggugcuccugcugacgaucgggcucucccuggucgcgagcguggagcugcccaacucccucgaggagcugggcgacgggcuggccaugggcaucaugauccucaagcugcugaccgacuuccagccccaccagcucugggccacccugcugagccucaccuucauccgcacgaccuucucccugcacuacgccuggaagaccauggcgaugguccugagcaucgugucccucuucccccugugccugagcaccacgucccagaagaccaccuggcucccggugcugcugggcagccucgggugcaagccccugaccauguuccugaucgccgagaacaagaucuggggccggaaguccuggccccucaacgaggggaucauggccgucggcaucgugagcauccugcugagcucccuccugaagaacgacgugccccuggccgggccgcucaucgccggcggcaugcugaucgcgugcuacgucaucagcggguccagcgccgaccugucccucgagaaggccgccgaggugagcugggaggaggaggccgagcacuccggcgcgagccacaacauccugguggagguccaggacgacgggacgaugaagaucaaggacgaggagcgcgacgacacccugaccauccuccugaaggccacccugcucgccguguccggcguguacccccugagcauccccgccacccuguucgucugguacuucuggcagaagaagaagcagcgguccggggugcucugggacacgcccagcccgcccgagguggagcgcgccguccuggacgacggcaucuaccggaucaugcagcgcggccugcuggggcggucccaggugggcgugggggucuuccaggagaacguguuccacaccauguggcacgugacccgcggcgcgguccucauguaccaggggaagcggcuggagcccagcugggccuccgugaagaaggaccugaucagcuacggcggcggguggcgccuccagggcuccuggaacaccggggaggaggugcaggucaucgccguggagcccggcaagaacccgaagaacgugcagacggcccccgggaccuucaagaccagcgagggcgaggucggcgccaucgcgcuggacuucaagcccgggaccuccggcagccccaucgugaaccgggaggggaagaucgugggccuguacggcaacggggucgugacgaccagcggcaccuacguguccgccaucgcccaggccaaggcgagccaggaggggccgcuccccgagaucgaggacgaggucuuccgcaagcggaaccugaccaucauggaccugcaccccggcuccgggaagacgcgccgguaccucccggccaucgugcgcgaggccaucaagcggcgccugcgcacccugauccucgcccccacccggguggucgccagcgagauggcggaggcccugaagggcaugcccauccgcuaccagaccacggccgugaaguccgagcacaccggcaaggagaucguggaccugaugugccacgccaccuucaccaugcggcuccugagccccguccgcgugccgaacuacaacaugaucaucauggacgaggcccacuucacggaccccuccagcaucgcggcccggggguacaucuccacccgcgugggcaugggggaggccgccgccaucuucaugaccgcgacgccgcccggcagcgucgaggccuucccgcaguccaacgccgugauccaggacgaggagcgggacauccccgagcgcagcuggaacuccggguacgaguggaucacggacuuccccggcaagaccgugugguucguccccagcaucaaguccggcaacgacaucgccaacugccugcggaagaacgggaagcgcgugauccagcucagccggaagaccuucgacaccgaguaccagaagacgaagaacaacgacugggacuacguggucaccaccgacaucuccgagaugggcgcgaacuuccgcgccgaccgggugaucgacccgcgccggugccugaagcccgugauccugaaggacgggcccgagcgcgucauccucgccggccccaugccggugaccgucgccagcgccgcgcagcggcgcgggcggaucggccgcaaccacaacaaggagggcgaccaguacaucuacauggggcagccccugaacaacgacgaggaccacgcccacuggacggaggccaagaugcugcucgacaacaucaacacccccgagggcaucauccccgcccuguucgagccggagcgcgagaaguccgccgcgaucgacggggaguaccggcugcgcggcgaggcccggaagaccuucguggagcucaugcgccgcggggaccugcccguguggcugagcuacaaggucgccagcgagggcuuccaguacuccgaccgccgguggugcuucgacggcgagcgcaacaaccaggugcucgaggagaacauggacguggagaucuggaccaaggagggggagcggaagaagcugcgcccccgguggcuggacgcccgcacguacagcgacccccucgcccugcgggaguucaaggaguucgcggccggccgccgguccgucagcggggaccugauccucgagaucggcaagcugccgcagcaccugacccagcgcgcccagaacgcccucgacaaccuggugaugcugcacaacuccgagcagggcgggcgggcguaccgccacgccauggaggagcuccccgacaccaucgagacccugaugcugcucgcccugaucgccgugcugacgggcggggucacccucuucuuccugagcggccgggggcugggcaagaccuccaucggccuccugugcgugaucgccagcuccgugcugcucuggauggcgagcgucgagccccacuggaucgccgccuccaucauccuggaguucuuccugauggugcuccugauccccgagccggaccgccagcggacgccccaggacaaccagcuggccuacguggucaucgggcuccuguucaugauccugaccguggccgcgaacgagaugggccuccuggagacgaccaagaaggaccuggggaucggccacguggccgucgagaaccaccaccacgccgccaugcucgacguggaccugcaccccgccagcgcguggacccuguacgccguggccaccacgaucaucaccccgaugaugcgccacaccaucgagaacaccacggccaacaucucccucaccgccaucgcgaaccaggccgccauccugauggggcuggacaagggcuggcccaucagcaagauggacaucggcgucccccuccuggcccuggggugcuacucccaggugaacccccucacccugaccgcggccgugcugaugcucgucgcccacuacgccaucaucggcccggggcugcaggccaaggcgacgcgcgaggcccagaagcggaccgccgccggcaucaugaagaaccccaccguggacgggaucguggccaucgaccuggaccccgucguguacgacgcgaaguucgagaagcagcucggccagaucaugcugcugauccucugcaccagccagauccugcugaugcgcacgaccugggcccucugcgaguccaucacccuggccaccggcccccugacgacccucugggaggggagcccgggcaaguucuggaacaccaccaucgccguguccauggccaacaucuuccgggggagcuaccuggcgggcgucggccuggccuucagccucaugaagucccucgggggcgggcgccgggggacgggggcccagggcgagacccugggcgagaaguggaagcgccagcucaaccagcugagcaaguccgaguucaacaccuacaagcggagcgggaucauggagguggaccgcuccgaggccaaggagggccugaagcgcggggagaccacgaagcacgcggugagccgcggcaccgccaagcuccggugguucgucgagcgcaaccuggugaagcccgaggggaaggugaucgaccugggcugcggccgcggcgggugguccuacuacugcgccgggcugaagaaggucaccgaggugaagggguacaccaagggcgggcccggccacgaggagcccaucccgauggccacguacggguggaaccucgugaagcugcacagcggcaaggacgucuucuucaucccgcccgagaagugcgacacccugcucugcgacaucggggaguccagccccaacccgaccaucgaggagggccgcacccugcgggugcugaagaugguggagcccuggcuccgcgggaaccaguucugcaucaagauccugaaccccuacaugcccuccgucguggagacgcuggagcagaugcagcggaagcacggcggcaugcucgugcgcaacccgcugagccggaacuccacccacgagauguacugggucagcugcgggaccggcaacaucguguccgccgugaacaugaccagccgcaugcugcucaaccgcuucaccauggcgcaccggaagcccacguacgagcgcgacgucgaccugggggccggcacccggcacguggccguggagcccgaggucgccaaccuggacaucaucggccagcgcaucgagaacaucaagcacgagcacaaguccaccuggcacuacgacgaggacaaccccuacaagaccugggccuaccacgggagcuacgaggugaagccguccggcagcgcgagcuccauggucaacgggguggugaagcuccugacgaagcccugggacgucauccccauggugacccagaucgccaugaccgacaccacgcccuucggccagcagcggguguucaaggagaaggucgacacccgcaccccgaaggccaagcgggggaccgcccagaucauggaggugacggccaaguggcuguggggcuuccucagccgcaacaagaagccccggaucugcacccgcgaggaguucacccggaaggugcgcuccaacgcggccaucggcgccgucuucguggacgagaaccaguggaacagcgccaaggaggcgguggaggacgagcgguucugggaccugguccaccgcgagcgggagcugcacaagcaggggaagugcgcgaccugcguguacaacaugaugggcaagcgcgagaagaagcucggggaguucggcaaggccaaggggucccgggccaucugguacauguggcugggcgcccgcuuccuggaguucgaggcgcucggcuucaugaacgaggaccacugguucagccgggagaacucccugagcgggguggagggcgaggggcugcacaagcucggcuacauccugcgcgacaucuccaagauccccgggggcaacauguacgccgacgacacggccggcugggacacccggaucaccgaggacgaccugcagaacgaggccaagaucaccgacaucauggagccggagcacgcccuccuggccaagagcaucuucaagcugacguaccagaacaaggucgugcgcgugcagcgccccgccaagaacgggaccgucauggacgugaucucccggcgcgaccagcggggcagcggccaggugggcaccuacggccucaacaccuucacgaacauggaggcccagcugauccgccagauggaguccgaggggaucuucagccccuccgagcuggagaccagcaaccucgccggccggguccuggacuggcuggagaagcacgggguggagcgccucaagcggauggccaucuccggcgacgacugcguggucaagcccaucgacgaccgcuucgcgaccgcccugaccgcccugaacgacauggggaaggugcggaaggacaucccgcagugggagcccagcaagggcuggaacgacuggcagcagguccccuucugcagccaccacuuccaccagcucaucaugaaggacggccgcgagaucgucgugcccugccggaaccaggacgagcugguggggcgcgcccgggucucccagggcgccggguggagccugcgcgagacggcgugccucggcaaguccuacgcccagauguggcagcugauguacuuccaccggcgcgaccugcggcucgccgccaacgcgaucugcagcgccgugccgguggacuggguccccaccucccgcaccaccuggagcauccacgcccaccaccaguggaugacgaccgaggacaugcuguccguguggaaccggguguggaucgaggagaaccccuggauggaggacaagacccacgucagcuccuggggcgacgugcccuaccugggcaagcgcgaggaccaguggugcggcagccucaucgggcugaccgcccgcgccacgugggcgaccaacauccagguggccaucaaccagguccggcgccugcucggcaacgagaacuaccuggacuacaugaccuccaugaagcgguucaagaacgagagcgacccggagggggcccugugguga

SEQ ID NO: 8443 - RNA, 9879 nt, Artificial Sequence
  derived and/or modified CDS sequence (opt1) from DENV-1__FJ882515__SS-prME
agcgugaccaugcugcucaugcugaugcccaccgcccuggccuuccaccucaccacccggggcggggagccccacaugaucgugaccaagcaggagcggggcaagagccugcuguucaagaccagcgccggggugaacaugugcacccucaucgccauggaccugggcgagcugugcgaggacaccaugaccuacaagugcccccggaucaccgaggccgagcccgacgacguggacugcuggugcaacgccacggacaccugggucaccuacgggaccugcagccagacgggcgagcaccggcgcgacaagcggagcguggcccucgcgccccacgugggccuggggcuggagacccgcaccgagaccuggauguccagcgagggcgccuggaagcagauccagcgggucgagacgugggcccuccgccaccccggguucaccgugaucgcccuguuccuggcgcacgccaucggcaccuccaucacccagaaggggaucaucuucauccuccugaugcuggugacgcccagcauggccaugcggugcgucggcaucggcucccgcgacuucguggaggggcucagcggcgccaccuggguggacgucgugcuggagcacggguccugcgugaccaccauggccaaggacaagcccacgcuggacaucgagcuccugaagaccgaggucaccaaccccgcggugcugcggaagcucugcaucgaggccaagaucagcaacaccacgaccgacucccgcugccccacccagggcgaggccacccugauggaggagcaggacgccaacuucgugugccggcgcacguucgucgaccggggcugggggaacggcugcgggcuguucggcaaggggagccucaucacgugcgccaaguucaagugcgugaccaagcuggagggcaagaucgugcaguacgagaaccugaaguacuccgucaucgugaccgugcacacgggcgaccagcaccaggucgggaacgagagcaccgagcacggcaccaccgcgaccaucacgccccaggcccccaccuccgagauccagcucaccgacuacggggcccugacccuggacugcagcccccgcacgggccucgacuucaacgagauggugcugcugaccaugaaggagaaguccuggcucguccacaagcagugguuccuggaccugccgcuccccuggaccagcggggccagcaccucccaggagacguggaaccggcaggaccugcuggugaccuucaagaccgcccacgcgaagaagcaggagguggucgugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgugaugugcaccggguccuucaagcucgagaaggaggucgcggagacgcagcacggcaccgugcuggugcagaucaaguacgagggcaccgacgcccccugcaagauccccuucagcacccaggacgagaagggggucacgcagaacggccggcugaucaccgccaacccgaucgugaccgacaaggagaagcccgugaacaucgaggccgagccgcccuucggggaguccuacaucgucaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcaucgggaagcuggugcaccagaucuucggcaccgccuacgggguccucuucuccggcgugagcuggaccaugaagaucgggaucggcgugcugcugacguggcucggccugaacucccgcagcaccucccugagcaugaccugcaucgccgucgggcucgugacccuguaccugggcgugaugguccaggccgacuccgggugcgugaucaacuggaagggccgggagcucaagugcgggagcggcaucuucgugacgaacgagguccacaccuggaccgagcaguacaaguuccaggcggacagcccgaagcgccuguccgccgccaucggcaaggccugggaggagggggugugcggcauccggagcgccacccgccuggagaacaucauguggaagcagaucuccaacgagcucaaccacauccugcuggagaacgacaugaaguucaccguggucgugggggacguggucggcauccucgcgcaggggaagaagaugauccggccccagcccauggagcacaaguacagcuggaaguccuggggcaaggccaagaucaucggcgccgacgugcagaacacgaccuucaucaucgacgggcccaacaccccggagugccccgacgaccagcgcgccuggaacaucugggagguggaggacuacggcuucgggaucuucaccacgaacaucuggcugaagaugcgggacagcuacacccaggucugcgaccaccgccugauguccgcggccaucaaggacagcaaggccgugcacgccgacaugggcuacuggaucgaguccgagaagaacgagaccuggaagcucgcccgggcgagcuucaucgaggugaagaccugcaucuggcccaagucccacacgcuguggagcaacggcguccuggaguccgagaugaucauccccaagaucuacgggggcccgaucagccagcacaacuaccgccccggguacuucacccagaccgccggccccuggcaccucgggaagcuggagcuggacuucgaccucugcgagggcaccacggugguggucgacgagcacugcggcaaccgggggccgucccugcgcaccaccaccgugacgggcaagaucauccacgaguggugcugccggagcugcacccugccgccccugcgcuucaagggggaggacggcugcugguacgggauggagauccggcccgugaaggagaaggaggagaaccuggucaaguccauggugagcgccggcagcggcgagguggacuccuucagccuggggcuccugugcaucuccaucaugaucgaggaggucaugcgcagccgguggucccgcaagaugcugaugaccggcacccucgccguguuccugcugcucaucauggggcagcugacguggaacgaccugauccggcucugcaucauggugggcgccaacgcgagcgaccgcauggggaugggcaccaccuaccuggcccugauggccaccuucaagaugcgcccgauguucgccgucgggcuccuguuccggcgccugacgucccgggaggugcuccugcugaccaucgggcucagccugguggccuccgucgagcugcccaacagccucgaggagcugggcgacgggcuggcgaugggcaucaugauccucaagcugcugaccgacuuccagucccaccagcucugggccacccugcugagccucacguucaucaagaccacccugucccugcacuacgccuggaagaccauggccauggugcucagcaucgucucccugaucccccugugccucagcacgaccucccagaagaccaccuggcugcccgugcugcucggcagccuggggugcaagccgcugacgauguuccucaucgcggagaacaagaucuggggccgcaaguccuggccccugaacgaggggaucauggccgugggcgucgugagcauccugcucagcucccugcugaagaacgacgugccccucgccgggccccugaucgccggcggcaugcugaucgccugcuacgucaucagcggguccagcgcggaccucucccuggagaaggccgccgaggugagcugggaggaggaggccgagcacuccggcgccagccacaacauccugguggagguccaggacgacgggaccaugaagaucaaggacgaggagcgggacgacacccucaccauccugcugaaggcgacccuccuggccguguccggcguguacccgcugagcauccccgccacccucuucgucugguacuucuggcagaagaagaagcagcgcuccggggugcugugggacacccccagcccgcccgagguggagcgggccguccuggacgacggcaucuaccgcaucaugcagcggggccugcucgggcgcucccaggugggcgugggggucuuccaggagaacguguuccacaccauguggcacgugacccggggcgccguccugauguaccaggggaagcgccuggagcccagcugggcguccgugaagaaggaccucaucagcuacggcggcggguggcggcugcagggcuccuggaacacgggggaggaggugcaggucaucgccguggagcccggcaagaaccccaagaacgugcagaccgcccccgggaccuucaagacccccgagggcgaggucggcgccaucgcccuggacuucaagcccgggacgagcggcucccccaucgugaaccgcgaggggaagaucgugggccucuacggcaacggggucgugaccaccagcggcaccuacgugagcgcgaucgcccaggccaaggccucccaggaggggccgcugcccgagaucgaggacgaggucuuccggaagcgcaaccugacgaucauggaccuccaccccggcagcgggaagacccggcgcuaccugccggcgaucgugcgggaggccaucaagcgcaagcugcggacccucauccuggcccccacccgcguggucgccuccgagauggccgaggcgcugaagggcaugcccauccgcuaccagacgaccgccgucaagagcgagcacaccggcaaggagaucguggaccucaugugccacgccaccuucacgaugcggcugcugucccccguccgcgugccgaacuacaacaugaucaucauggacgaggcccacuucaccgaccccagcuccaucgccgcgcggggguacaucagcacccgcgugggcaugggggaggccgccgccaucuucaugaccgccacgccgcccggcuccgucgaggcguucccgcagagcaacgccgugauccaggacgaggagcgggacauccccgagcgcuccuggaacagcggguacgaguggaucaccgacuuccccggcaagaccgugugguucguccccuccaucaagagcggcaacgacaucgccaacugccuccggaagaacgggaagcgcgugauccagcugucccggaagaccuucgacacggaguaccagaagaccaagaacaacgacugggacuacguggucaccaccgacaucagcgagaugggcgccaacuuccgcgcggaccgggugaucgacccgcgccggugccugaagcccgugauccucaaggacgggcccgagcgcgucauccuggccggccccaugccggugacggucgccuccgccgcccagcggcgcgggcggaucggccgcaaccacaacaaggagggcgaccaguacaucuacauggggcagccccugaacaacgacgaggaccacgcgcacuggaccgaggccaagaugcuccuggacaacaucaacacccccgagggcaucauccccgcccuguucgagccggagcgggagaaguccgccgccaucgacggggaguaccgccuccgcggcgaggcgcggaagaccuucguggagcugaugcgccgcggggaccugcccguguggcucuccuacaaggucgccagcgagggcuuccaguacagcgaccgccgguggugcuucgacggcgagcgcaacaaccaggugcuggaggagaacauggacguggagaucuggacgaaggagggggagcggaagaagcugcgcccccgguggcucgacgcccgcaccuacuccgacccccuggcccugcgggaguucaaggaguucgccgcgggccgccggagcgucuccggggaccucauccuggagaucggcaagcugccgcagcaccucacccagcgcgcccagaacgcccuggacaaccuggugaugcuccacaacagcgagcagggcgggcgggccuaccgccacgcgauggaggagcugcccgacaccaucgagacgcugaugcuccuggcccugaucgccgugcucaccggcggggucacccuguucuuccuguccggccgggggcucggcaagaccagcaucggccugcugugcgugauggccuccagcgugcuccuguggauggccuccgucgagccccacuggaucgcggccagcaucauccuggaguucuuccucauggugcugcugauccccgagccggaccgccagcggacgccccaggacaaccagcucgccuacguggucaucgggcugcuguucaugauccucacgguggccgccaacgagaugggccugcuggagaccaccaagaaggaccucgggaucggccacguggcggucgagaaccaccaccacgccaccaugcuggacguggaccugcaccccgccuccgccuggacgcucuacgccguggcgaccaccaucaucaccccgaugaugcgccacacgaucgagaacaccaccgccaacaucagccugaccgccaucgccaaccaggccgcgauccugauggggcucgacaagggcuggcccaucuccaagauggacaucggcgucccccugcuggcccucgggugcuacagccaggugaacccccugacgcugaccgccgccgugcucaugcuggucgcgcacuacgccaucaucggcccggggcugcaggccaaggccacccgggaggcccagaagcgcaccgcggccggcaucaugaagaaccccacgguggacgggaucguggccaucgaccucgaccccgucguguacgacgccaaguucgagaagcagcugggccagaucaugcugcucauccugugcaccucccagauccugcucaugcgcaccaccugggcccugugcgagagcaucacgcuggcgaccggcccccucaccacccugugggagggguccccgggcaaguucuggaacacgaccaucgccgugagcauggccaacaucuuccggggguccuaccuggccggcgccggccucgcguucagccugaugaagucccucgggggcgggcgccgggggaccggggcccagggcgagacccucggcgagaaguggaagcgccagcugaaccagcuguccaagagcgaguucaacaucuacaagcgguccgggaucauggaggucgaccgcagcgaggccaaggagggccucaagcgcggggagacgacccgccacgccgugucccggggcaccgcgaagcugcgcugguucguggagcggaaccuggucaagcccgaggggaaggugaucgaccugggcugcggccgcgggggcuggagcuacuacugcgccgggcucaagaaggugaccgaggucaagggcuacacgaagggcgggcccggccacgaggagcccaucccgauggccaccuacggguggaaccuggugaagcugcacuccggcaaggacguguucuucacgccgcccgagaagugcgacacccuccugugcgacaucggggagagcucccccaacccgacgaucgaggagggccggacccugcgcguccucaagaugguggagcccuggcugcgggggaaccaguucugcaucaagauccugaaccccuacaugcccagcguggucgagacccucgagcagaugcagcgcaagcacggcggcaugcuggugcggaacccgcugucccgcaacagcacccacgagauguacuggguguccugcgggaccggcaacaucgucagcgccgugaacaugacgucccggaugcuccugaaccgcuucaccauggcccaccgcaagcccaccuacgagaaggacguggaccugggggcgggcacccggcacgucgccguggagcccgagguggccaaccucgacaucaucggccagcgcaucgagaacaucaagcacgagcacaagagcacguggcacuacgacgaggacaaccccuacaagaccugggccuaccacggguccuacgaggucaagccgagcggcuccgccagcagcauggugaacggggucgugaagcugcugaccaagcccugggacgugauccccauggucacccagaucgcgaugacggacaccacccccuucggccagcagcggguguucaaggagaagguggacacccgcacgccgaaggccaagcgggggaccguccagaucauggaggugaccgcccgcuggcucuggggcuuccugucccggaacaagaagccccgcaucugcacccgggaggaguucacgcgcaaggugcggagcaacgccgccaucggcgcggucuucguggacgagaaccaguggaacuccgccaaggaggccguggaggacgagcgcuucugggaccugguccagaaggagcgggagcuccacaagcaggggaagugcgcgaccugcguguacaacaugaugggcaagcgcgagaagaagcugggggaguucggcaaggcgaaggggagccgggccaucugguacauguggcugggcgcccgcuuccucgaguucgaggcccugggcuucaugaacgaggaccacugguucucccgggagaacagccuguccgggguggagggcgaggggcuccacaagcugggcuacauccugcgcgacaucagcaagauccccgggggcaacauguacgccgacgacaccgcgggcugggacacccggaucacggaggacgaccuccagaacgaggccaagaucaccgacaucauggagccggagcacgcccugcuggccaccuccaucuucaagcucaccuaccagaacaaggucgugcgcgugcagcggcccgccaagaacgggacggucauggacgugaucagccgccgcgaccagcggggcuccggccaggugggcaccuacggccugaacaccuucaccaacauggaggcgcagcugauccgccagauggagagcgaggggaucuuccuccccuccgagcuggagacgcccaaccuggccgagcggguccucgacuggcuggagaaguacggcguggagcgccugaagcggauggccaucagcggggacgacugcguggucaagccgaucgacgaccgcuucgccaccgcccucaccgcgcugaacgacaugggcaaggugcggaaggacaucccccagugggagcccuccaagggguggaacgacuggccccaggugccgcacugcagccaccacuuccaccagcugaucaugaaggacggccgcgagaucgucgugcccugccggaaccaggacgagcucgugggccgcgcccgggucucccagggggccggcuggagccugcgcgagaccgccugccugggcaagagcuacgcccagauguggcagcucauguacuuccaccggcgcgaccugcggcuggcggccaacgccaucugcuccgccgugcccguggacuggguccccacgagccgcaccaccugguccauccacgcgcaccaccaguggaugaccacggaggacaugcucagcguguggaaccggguguggaucgaggagaacccguggauggaggacaagacccacgucuccagcuggggcgacgugcccuaccuggggaagcgcgaggaccaguggugcggcucccugaucggccucaccgcccgggccaccugggccagcaacauccagguggccaucaaccagguccgccgccugaucgggaacgagaacuaccuggacuacaugaccuccaugaagcgguucaagaacgaggacgaccccgagggcgcgcucugguga

SEQ ID NO: 8444 - RNA, 9879 nt, Artificial Sequence
  derived and/or modified CDS sequence (opt1) from DENV-1__FJ882517__SS-prME
agcgugaccaugcugcucaugcugaugcccaccgcccuggccuuccaccucacgacccggggcggggagccccacaugaucgugagcaagcaggagcggggcaagagccugcuguucaagaccagcgcgggggugaacaugugcacccucaucgccauggaccugggcgaguucugcgaggacacgaugaccuacaagugcccccgcaucaccgaggccgagcccgacgacguggacugcuggugcaacgccaccgacacgugggugaccuacgggaccugcagccagaccggcgagcaccggcgggacaagcgguccguggcccuggcgccccacgugggccucgggcuggagacgcgcaccgagaccuggaugagcuccgagggcgccuggaagcagauccagcggguggagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugcccgacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaagaccguccaguacgagaaccugaaguacagcgugaucgugaccguccacacgggcgaccagcaccagguggggaacgaguccaccgagcacggcaccaccgcgaccaucacgccccaggcccccagcaccgagauccagcugaccgacuacggggcccucacccuggacugcagcccccggacgggccuggacuucaacgagaugguccuccugaccaugaaggagaaguccuggcuggugcacaagcagugguuccucgaccugccgcugcccuggaccagcggggccuccaccagccaggagacguggaaccggaaggaccuccuggugaccuucaagaccgcccacgcgaagaagcaggaggucguggugcugggcucccaggagggcgccaugcacaccgcccucacgggggccaccgagauccagaccagcggcaccacgaccaucuucgccgggcaccugaagugccgccugaagauggacaagcucacccugaagggcauguccuacgucaugugcaccgggagcuucaagcuggagaaggagguggcggagacgcagcacggcaccgugcucguccagaucaaguacgagggcaccgacgcccccugcaagauccccuucuccacccaggacgagaagggggugacgcagaacggccggcugaucaccgccaacccgaucgugaccgacaaggagaagcccgucaacaucgaggccgagccgcccuucggggagagcuacaucgugaucggcgcgggcgaggaggcccugaagcuguccugguucaagaaggggagcuccaucggcaagauguucgaggccaccgcccgcggggcccggcgcauggcgauccucggcgacacggccugggacuucgggagcaucggcggcguguucaccuccgucgggaagcuggugcaccagaucuucggcaccgccuacggggugcuguucagcggcgucuccuggaccaugaagaucgggaucggcgugcuccugacguggcugggccucaacagccgcuccaccagccuguccaugaccugcaucgccguggggcuggucacccucuaccugggcgugauggugcaggccgacagcgggugcgucaucaacuggaagggccgggagcugaagugcgggagcggcaucuucgugacgaacgaggugcacaccuggaccgagcaguacaaguuccaggcggacuccccgaagcgccucagcgccgccaucggcaaggccugggaggagggggucugcggcauccgguccgccacccgccuggagaacaucauguggaagcagaucagcaacgagcugaaccacauccuccuggagaacgacaugaaguucaccgugguggucggggacguggcgggcauccuggcccaggggaagaagaugauccggccccagcccauggaguacaaguacuccuggaaguccuggggcaaggccaagaucaucggcgccgacgugcagaacacgaccuucaucaucgacgggcccaacaccccggagugccccgacgaccagcgcgcguggaacaucugggaggucgaggacuacggcuucgggaucuucaccacgaacaucuggcucaagcugcgggacuccuacacccaggugugcgaccaccgccugaugagcgccgccaucaaggacuccaaggccgugcacgccgacaugggcuacuggaucgagagcgagaagaacgagaccuggaagcucgcgcgggccuccuucaucgaggucaagaccugcaucuggcccaagagccacacgcugugguccaacggcgugcuggagagcgagaugaucauccccaagaucuacgggggcccgaucucccagcacaacuaccgccccggguacuucacccagaccgccggccccuggcaccucgggaagcuggagcuggacuucgaccucugcgagggcaccacgguggucguggacgagcacugcggcaaccgggggccgagccugcgcaccaccaccgugacgggcaagaucauccacgaguggugcugccgguccugcacccugccgccccugcgcuucaagggggaggacggcugcugguacgggauggagauccggcccgucaaggagaaggaggagaaccuggucaagagcauggugagcgccggcuccggcgaggucgacagcuucucccuggggcuccugugcaucagcaucaugaucgaggaggugaugcgcucccgguggagccgcaagaugcugaugaccggcacccucgccguguucuuccugcugaucauggggcagcucacguggaacgaccugauccggcugugcaucauggucggcgcgaacgccuccgaccgcauggggaugggcaccaccuaccucgcccugauggugaccuucaagaugcgcccgauguucgccguggggcuccuguuccggcgccugacgagccgggagguccugcuccugaccaucgggcugucccucguggccagcgucgagcugcccaacucccuggaggagcucggcgacgggcuggcgaugggcaucaugauccugaagcuccugaccgacuuccagagccaccagcugugggccacccuccugucccugacguucaucaagaccaccuucagccuccacuacgccuggaagaccauggccauggugcuguccaucgugagccuguucccccucugccuguccacgaccagccagaagaccaccuggcugcccguccuccugggcucccuggggugcaagccgcucacgauguuccugaucgcggagaacaagaucuggggccgcaagagcuggccccugaacgaggggaucauggccgugggcaucgugagcauccuccuguccagccugcucaagaacgacgucccccuggccgggccccugaucgccggcggcaugcucaucgccugcuacgugaucuccgggagcuccgcggaccugagccuggagaaggccgccgagguguccugggaggaggaggccgagcacagcggcgccucccacaacauccucgucgaggugcaggacgacgggaccaugaagaucaaggacgaggagcgggacgacacccugaccauccugcucaaggcgacccugcuggccgugagcggcgucuacccgcucuccauccccgccacgcuguucgugugguacuucuggcagaagaagaagcagcgcagcggggugcugugggacacccccagcccgcccgaggucgagcgggccgugcucgacgacggcaucuaccgcaucaugcagcggggccugcuggggcgcagccaggugggcgucgggguguuccaggagaacguguuccacaccauguggcacgucacccggggcgccgugcugauguaccaggggaagcgccucgagcccuccugggcgagcgugaagaaggaccugaucuccuacggcggcggguggcggcugcagggcagcuggaacacgggggaggagguccaggugaucgccguggagcccggcaagaaccccaagaacguccagaccgcccccgggaccuucaagaccuccgagggcgaggugggcgccaucgcccucgacuucaagcccgggacgagcggcagccccaucgugaaccgcgaggggaagaucgucggccuguacggcaacgggguggugaccaccuccggcaccuacgucagcgcgaucgcccaggccaaggccucccaggaggggccccugccggagaucgaggacgagguguuccggaagcgcaaccucacgaucauggaccugcaccccggcagcgggaagacccggcgcuaccugcccgcgaucgugcgggaggccaucaagcgcaagcuccggacccugauccuggccccgacccgcgucguggccuccgagauggccgaggcgcucaagggcaugcccauccgcuaccagacgaccgccgucaagagcgagcacaccggcaaggagaucgucgaccugaugugccacgccaccuucacgaugcggcugcucucccccgugcgcgugcccaacuacaacaugaucaucauggacgaggcccacuucaccgacccgagcuccaucgccgcgcggggguacaucagcacccgcgucggcaugggggaggccgccgccaucuucaugaccgccacgccgcccggcuccguggaggcguucccccagagcaacgccgugauccaggacgaggagcgggacaucccggagcgcuccuggaacagcggguacgaguggaucaccgacuuccccggcaagaccgucugguucgugcccuccaucaagagcggcaacgacaucgccaacugccugcggaagaacgggaagcgcgugauccagcugucccggaagaccuucgacacggaguaccagaagaccaagaacaacgacugggacuacgucgugaccaccgacaucagcgagaugggcgccaacuuccgcgcggaccgggugaucgacccccgccggugccucaagccggucauccugaaggacgggcccgagcgcgugauccuggccggccccaugcccgucacgguggccuccgccgcccagcggcgcgggcggaucggccgcaaccacaacaaggagggcgaccaguacaucuacauggggcagccgcucaacaacgacgaggaccacgcgcacuggaccgaggccaagaugcugcuggacaacaucaacacccccgagggcaucauccccgcccucuucgagcccgagcgggagaaguccgccgccaucgacggggaguaccgccugcgcggcgaggcgcggaagaccuucguggagcugaugcgccgcggggaccucccggucuggcugagcuacaagguggccuccgagggcuuccaguacagcgaccgccgguggugcuucgacggcgagcgcaacaaccaggugcuggaggagaacauggacgucgagaucuggacgaaggagggggagcggaagaagcuccgcccccgguggcuggacgcccgcaccuacuccgacccccuggcccuccgggaguucaaggaguucgccgcgggccgccggagcguguccggggaccugauccuggagaucggcaagcucccccagcaccugacccagcgcgcccagaacgcccuggacaaccucgugaugcugcacaacagcgagcagggcgggcgggccuaccgccacgcgauggaggagcugccggacaccaucgagacgcucaugcugcuggcccucaucgccguccugaccggcggggugacccuguucuuccucuccggccgggggcugggcaagaccagcaucggccugcucugcgugauggccuccagcguccugcuguggauggccuccguggagccccacuggaucgcggccagcaucauccucgaguucuuccugauggugcugcucauccccgagcccgaccgccagcggaccccgcaggacaaccagcuggccuacgucgugaucgggcuccucuucaugauccugacgguggccgccaacgagaugggccugcucgagaccaccaagaaggaccuggggaucggccacgucgcgguggagaaccaccaccacgccgccaugcuggacguggaccuccaccccgccuccgccuggacccuguacgcggucgccacgaccaucaucacccccaugaugcgccacaccaucgagaacacgaccgccaacaucagccugaccgccaucgccaaccaggcggccauccucauggggcuggacaagggcuggccgaucuccaagauggacaucggcgugccccugcucgcccuggggugcuacagccaggugaacccccugacccucacggccgcgguccugaugcugguggcccacuacgccaucaucggccccgggcuccaggccaaggccacccgggaggcgcagaagcgcaccgccgccggcaucaugaagaacccgaccguggacgggaucgucgccaucgaccuggaccccgugguguacgacacgaaguucgagaagcagcugggccagaucaugcuccugauccugugcaccucccagauccuccugaugcgcaccaccugggcccugugcgagagcaucacgcucgcgaccggcccccugaccacccugugggaggggucccccggcaaguucuggaacacgaccaucgccgucagcauggccaacaucuuccgggggagcuaccucgccggcgccggccuggcguucucccugaugaagucccucgggggcgggcgccggggcaccggggcccagggcgagacccugggcgagaaguggaagcgccagcugaaccagcucuccaagagcgaguucaacacguacaagcgguccgggaucauggagguggaccgcagcgaggccaaggagggccugaagcgcggggagaccaccaagcacgccgugucccgcggcaccgcgaagcugcggugguucgucgagcgcaaccucgugaagccggaggggaaggugaucgaccugggcugcggccgcggcggguggagcuacuacugcgccgggcugaagaaggucacggaggugaagggguacaccaagggcgggcccggccacgaggagcccauccccauggccaccuacggguggaaccuggugaagcuccacuccggcaaggacgucuucuucaucccgcccgagaagugcgacacccugcugugcgacaucggggagagcucccccaaccccacgaucgaggagggccgcacccuccgggugcugaagaugguggagccguggcugcgcgggaaccaguucugcaucaagauccucaaccccuacaugcccagcgucguggagacccuggagcagaugcagcggaagcacggcggcaugcuggugcgcaacccccucucccggaacagcacccacgagauguacugggucuccugcgggaccggcaacaucgugagcgccgugaacaugacgucccgcaugcugcugaaccgguucaccauggcccaccgcaagccgaccuacgagcgcgacgucgaccucggggcgggcacccggcacguggccguggagcccgaggucgccaaccuggacaucaucggccagcgcaucgagaacaucaagcacgagcacaagagcacguggcacuacgacgaggacaaccccuacaagaccugggccuaccacggguccuacgaggugaagcccagcggcagcgccuccagcauggucaacgggguggugaagcugcucaccaagccgugggacgucauccccauggugacccagaucgcgaugacggacaccacccccuucggccagcagcggguguucaaggagaaggucgacacccgcacgcccaaggccaagcgggggaccgcccagaucauggaggugaccgccaaguggcuguggggcuuccugucccgcaacaagaagccgcggaucugcacccgcgaggaguucacgcggaaggugcgcagcaacgccgcgaucggcgccgucuucguggacgagaaccaguggaacuccgccaaggaggccguggaggacgagcgguucugggaccucguccaccgcgagcgggagcugcacaagcaggggaagugcgcgaccugcguguacaacaugaugggcaagcgcgagaagaagcugggggaguucggcaaggccaaggggagccgggccaucugguacauguggcucggcgcccgcuuccuggaguucgaggcccugggcuucaugaacgaggaccacugguucucccgggagaacagccucuccgggguggagggcgaggggcugcacaagcugggcuacauccuccgcgacaucagcaagauccccgggggcaacauguacgcggacgacaccgccggcugggacacccggaucacggaggacgaccugcagaacgaggccaagaucaccgacaucauggagcccgagcacgcccugcucgccaaguccaucuucaagcugaccuaccagaacaaggucgugcgcgugcagcggccggcgaagaacgggaccgucauggacgugaucagccgccgcgaccagcggggcuccggccaggugggcacguacggccugaacaccuucaccaacauggaggcccagcucauccgccagauggagagcgaggggaucuucucccccagcgagcuggagacccccaaccuggccggccggguccucgacuggcuggagaagcacgggguggagcgccugaagcggauggccaucuccggcgacgacugcguggucaagcccaucgacgaccgcuucgccacggcgcucaccgcccugaacgacauggggaaggugcggaaggacaucccgcagugggagcccagcaagggcuggaacgacuggcagcagguccccuucugcagccaccacuuccaccagcugaucaugaaggacggccgcgagaucgucgugcccugccggaaccaggacgagcucguggggcgcgcccgggucucccagggcgccggguggagccugcgcgagaccgccugccugggcaaguccuacgcgcagauguggcagcucauguacuuccaccggcgcgaccugcggcuggccgccaacgccaucugcagcgcggugccgguggacuggguccccaccucccgcacgaccuggagcauccacgcccaccaccaguggaugaccaccgaggacaugcucuccguguggaaccggguguggaucgaggagaaccccuggauggaggacaagacgcacaucagcuccuggggcgacguccccuaccugggcaagcgcgaggaccaguggugcggcagccugaucgggcucaccgcccgggccaccugggccaccaacauccagguggcgaucaaccaggugcgccgccugaucggcaacgagaacuaccuggacuacaugaccuccaugaagcgguucaagaacgagagcgacccggagggggcccucugguga

SEQ ID NO: 8445 - RNA, 9879 nt, Artificial Sequence
  derived and/or modified CDS sequence (opt1) from DENV-1__JQ287661__SS-prME
agcgugaccaugcugcucaugcugaugcccaccgcccuggccuuccaccucaccacccggggcggggagccccacaugaucgugaccaagcaggagcggggcaagagccugcuguucaagaccagcgccggggugaacaugugcacccucaucgccauggaccugggcgagcugugcgaggacaccaugaccuacaagugcccccggaucaccgaggccgagcccgacgacguggacugcuggugcaacgccacggacaccugggucaccuacgggaccugcagccagacgggcgagcaccggcgcgacaagcggagcguggcccucgcgccccacgugggccuggggcuggagacccgcaccgagaccuggauguccagcgagggcgccuggaagcagauccagcgggucgagacgugggcccuccgccaccccggguucaccgugaucgcccuguuccuggcgcacgccaucggcaccuccaucacccagaaggggaucaucuucauccuccugaugcuggugacgcccagcauggccaugcggugcgucggcaucggcucccgcgacuucguggaggggcucagcggcgccaccuggguggacgucgugcuggagcacggguccugcgugaccaccauggccaaggacaagcccacgcuggacaucgagcuccugaagaccgaggucaccaaccccgcggugcugcggaagcucugcaucgaggccaagaucagcaacaccacgaccgacucccgcugccccacccagggcgaggccacccugauggaggagcaggacgccaacuucgugugccggcgcacguucgucgaccggggcugggggaacggcugcgggcuguucggcaaggggagccucaucacgugcgccaaguucaagugcgugaccaagcuggagggcaagaucgugcaguacgagaaccugaaguacuccgucaucgugaccgugcacacgggcgaccagcaccaggucgggaacgagagcaccgagcacggcaccaccgcgaccaucacgccccaggcccccaccuccgagauccagcucaccgacuacggggcccugacccuggacugcagcccccgcacgggccucgacuucaacgagauggugcugcugaccaugaaggagaaguccuggcucguccacaagcagugguuccuggaccugccgcuccccuggaccagcggggccagcaccucccaggagacguggaaccggcaggaccugcuggugaccuucaagaccgcccacgcgaagaagcaggagguggucgugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgugaugugcaccggguccuucaagcucgagaaggaggucgcggagacgcagcacggcaccgugcuggugcagaucaaguacgagggcaccgacgcccccugcaagauccccuucagcacccaggacgagaagggggucacgcagaacggccggcugaucaccgccaacccgaucgugaccgacaaggagaagcccgugaacaucgaggccgagccgcccuucggggaguccuacaucgucaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcaucgggaagcuggugcaccagaucuucggcaccgccuacgggguccucuucuccggcgugagcuggaccaugaagaucgggaucggcgugcugcugacguggcucggccugaacucccgcagcaccucccugagcaugaccugcaucgccgucgggcucgugacccuguaccugggcgugaugguccaggccgacuccgggugcgugaucaacuggaagggccgggagcucaagugcgggagcggcaucuucgugacgaacgagguccacaccuggaccgagcaguacaaguuccaggcggacagcccgaagcgccuguccgccgccaucggcaaggccugggaggagggggugugcggcauccggagcgccacccgccuggagaacgugauguggaagcagaucuccaacgagcucaaccacauccugcuggagaacgacaugaaguucaccgucguggugggggacgucgugggcauccucgcgcaggggaagaagaugauccggccccagcccauggagcacaaguacagcuggaaguccuggggcaaggccaagaucaucggcgccgacgugcagaacacgaccuucaucaucgacgggcccaacaccccggagugccccgacgaccagcgcgccuggaacaucugggaggucgaggacuacggcuucgggaucuucaccacgaacaucuggcugaagaugcgggacagcuacacccaggugugcgaccaccgccugauguccgcggccaucaaggacagcaaggccgugcacgccgacaugggcuacuggaucgaguccgagaagaacgagaccuggaagcucgcccgggcgagcuucaucgaggucaagaccugcaucuggcccaagucccacacgcuguggagcaacggcgugcuggaguccgagaugaucauccccaagaucuacgggggcccgaucagccagcacaacuaccgccccggguacuucacccagaccgccggccccuggcaccucgggaagcuggagcuggacuucgaccucugcgagggcaccacgguggucguggacgagcacugcggcaaccgggggccgucccugcgcaccaccaccgugacgggcaagaucauccacgaguggugcugccggagcugcacccugccgccccugcgcuucaagggggaggacggcugcugguacgggauggagauccggcccgucaaggagaaggaggagaaccuggugaaguccauggugagcgccggcagcggcgaggucgacuccuucagccuggggcuccugugcaucuccaucaugaucgaggaggugaugcgcagccgguggucccgcaagaugcugaugaccggcacccucgccguguuccugcugcucaucauggggcagcugacguggaacgaccugauccggcucugcaucauggucggcgccaacgcgagcgaccgcauggggaugggcaccaccuaccuggcccugauggccaccuucaagaugcgcccgauguucgccgugggccuccuguuccggcgccugacgucccgggaggugcuccugcugaccaucgggcucagccuggucgccuccguggagcugcccaacagccucgaggagcugggcgacgggcuggcgaugggcaucaugauccucaagcugcugaccgacuuccagucccaccagcucugggccacccugcugagccucacguucaucaagaccacccugucccugcacuacgccuggaagaccauggccaugguccucagcaucgugucccugaucccccugugccucagcacgaccucccagaagaccaccuggcugcccgugcugcucggcagccuggggugcaagccgcugacgauguuccucaucgcggagaacaagaucuggggccgcaaguccuggccccugaacgaggggaucauggccgucggcguggugagcauccugcucagcucccugcugaagaacgacgucccccucgccgggccccugaucgccggcggcaugcugaucgccugcuacgugaucagcggguccagcgcggaccucucccuggagaaggccgccgaggugagcugggaggaggaggccgagcacuccggcgccagccacaacauccuggucgaggugcaggacgacgggaccaugaagaucaaggacgaggagcgggacgacacccucaccauccugcugaaggcgacccuccuggccguguccggcgucuacccgcugagcauccccgccacccucuucgugugguacuucuggcagaagaagaagcagcgcuccggggugcugugggacacccccagcccgcccgaggucgagcgggccgugcuggacgacggcaucuaccgcaucaugcagcggggccugcucgggcgcucccaggugggcgucgggguguuccaggagaacguguuccacaccauguggcacgucacccggggcgccgugcugauguaccaggggaagcgccuggagcccagcugggcguccgugaagaaggaccucaucagcuacggcggcggguggcggcugcagggcuccuggaacacgggggaggagguccaggugaucgccguggagcccggcaagaaccccaagaacguccagaccgcccccgggaccuucaagacccccgagggcgaggugggcgccaucgcccuggacuucaagcccgggacgagcggcucccccaucgugaaccgcgaggggaagaucgucggccucuacggcaacgggguggugaccaccagcggcaccuacgucagcgcgaucgcccaggccaaggccucccaggaggggccgcugcccgagaucgaggacgagguguuccggaagcgcaaccugacgaucauggaccuccaccccggcagcgggaagacccggcgcuaccugccggcgaucgugcgggaggccaucaagcgcaagcugcggacccucauccuggcccccacccgcgucguggccuccgagauggccgaggcgcugaagggcaugcccauccgcuaccagacgaccgccgucaagagcgagcacaccggcaaggagaucgucgaccucaugugccacgccaccuucacgaugcggcugcugucccccgugcgcgugccgaacuacaacaugaucaucauggacgaggcccacuucaccgaccccagcuccaucgccgcgcggggguacaucagcacccgcgucggcaugggggaggccgccgccaucuucaugaccgccacgccgcccggcuccguggaggcguucccgcagagcaacgccgugauccaggacgaggagcgggacauccccgagcgcuccuggaacagcggguacgaguggaucaccgacuuccccggcaagaccgucugguucgugcccuccaucaagagcggcaacgacaucgccaacugccuccggaagaacgggaagcgcgugauccagcugucccggaagaccuucgacacggaguaccagaagaccaagaacaacgacugggacuacgucgugaccaccgacaucagcgagaugggcgccaacuuccgcgcggaccgggugaucgacccgcgccggugccugaagcccgucauccucaaggacgggcccgagcgcgugauccuggccggccccaugccggucacgguggccuccgccgcccagcggcgcgggcggaucggccgcaaccacaacaaggagggcgaccaguacaucuacauggggcagccccugaacaacgacgaggaccacgcgcacuggaccgaggccaagaugcuccuggacaacaucaacacccccgagggcaucauccccgcccuguucgagccggagcgggagaaguccgccgccaucgacggggaguaccgccuccgcggcgaggcgcggaagaccuucguggagcugaugcgccgcggggaccugcccgucuggcucuccuacaagguggccagcgagggcuuccaguacagcgaccgccgguggugcuucgacggcgagcgcaacaaccaggugcuggaggagaacauggacgucgagaucuggacgaaggagggggagcggaagaagcugcgcccccgguggcucgacgcccgcaccuacuccgacccccuggcccugcgggaguucaaggaguucgccgcgggccgccggagcguguccggggaccucauccuggagaucggcaagcugccgcagcaccucacccagcgcgcccagaacgcccuggacaaccuggugaugcuccacaacagcgagcagggcgggcgggccuaccgccacgcgauggaggagcugcccgacaccaucgagacgcugaugcuccuggcccugaucgccguccucaccggcggggugacccuguucuuccuguccggccgggggcucggcaagaccagcaucggccugcugugcgugauggccuccagcguccuccuguggauggccuccguggagccccacuggaucgcggccagcaucauccuggaguucuuccucauggugcugcugauccccgagccggaccgccagcggacgccccaggacaaccagcucgccuacgucgugaucgggcugcuguucaugauccucacgguggccgccaacgagaugggccugcuggagaccaccaagaaggaccucgggaucggccacgucgcgguggagaaccaccaccacgccaccaugcuggacguggaccugcaccccgccuccgccuggacgcucuacgccgucgcgaccaccaucaucaccccgaugaugcgccacacgaucgagaacaccaccgccaacaucagccugaccgccaucgccaaccaggccgcgauccugauggggcucgacaagggcuggcccaucuccaagauggacaucggcgugccccugcuggcccucgggugcuacagccaggugaacccccugacgcugaccgccgccguccucaugcugguggcgcacuacgccaucaucggcccggggcugcaggccaaggccacccgggaggcccagaagcgcaccgcggccggcaucaugaagaaccccacgguggacgggaucgucgccaucgaccucgaccccgugguguacgacgccaaguucgagaagcagcugggccagaucaugcugcucauccugugcaccucccagauccugcucaugcgcaccaccugggcccugugcgagagcaucacgcuggcgaccggcccccucaccacccugugggagggguccccgggcaaguucuggaacacgaccaucgccgucagcauggccaacaucuuccggggguccuaccuggccggcgccggccucgcguucagccugaugaagucccucgggggcgggcgccgggggaccggggcccagggcgagacccucggcgagaaguggaagcgccagcugaaccagcuguccaagagcgaguucaacaucuacaagcgguccgggaucauggagguggaccgcagcgaggccaaggagggccucaagcgcggggagacgacccgccacgccgugucccggggcaccgcgaagcugcgcugguucgucgagcggaaccuggugaagcccgaggggaaggugaucgaccugggcugcggccgcgggggcuggagcuacuacugcgccgggcucaagaaggucaccgaggugaagggcuacacgaagggcgggcccggccacgaggagcccaucccgauggccaccuacggguggaaccuggugaagcugcacuccggcaaggacgucuucuucacgccgcccgagaagugcgacacccuccugugcgacaucggggagagcucccccaacccgacgaucgaggagggccggacccugcgcgugcucaagaugguggagcccuggcugcgggggaaccaguucugcaucaagauccugaaccccuacaugcccagcgucguggagacccucgagcagaugcagcgcaagcacggcggcaugcuggugcggaacccgcugucccgcaacagcacccacgagauguacugggucuccugcgggaccggcaacaucgugagcgccgugaacaugacgucccggaugcuccugaaccgcuucaccauggcccaccgcaagcccaccuacgagaaggacgucgaccugggggcgggcacccggcacguggccguggagcccgaggucgccaaccucgacaucaucggccagcgcaucgagaacaucaagcacgagcacaagagcacguggcacuacgacgaggacaaccccuacaagaccugggccuaccacggguccuacgaggugaagccgagcggcuccgccagcagcauggucaacgggguggugaagcugcugaccaagcccugggacgucauccccauggugacccagaucgcgaugacggacaccacccccuucggccagcagcggguguucaaggagaaggucgacacccgcacgccgaaggccaagcgggggaccgugcagaucauggaggugaccgcccgcuggcucuggggcuuccugucccggaacaagaagccccgcaucugcacccgggaggaguucacgcgcaagguccggagcaacgccgccaucggcgcgguguucguggacgagaaccaguggaacuccgccaaggaggccgucgaggacgagcgcuucugggaccuggugaagaaggagcgggagcuccacaagcaggggaagugcgcgaccugcguguacaacaugaugggcaagcgcgagaagaagcugggggaguucggcaaggcgaaggggagccgggccaucugguacauguggcugggcgcccgcuuccucgaguucgaggcccugggcuucaugaacgaggaccacugguucucccgggagaacagccuguccggggucgagggcgaggggcuccacaagcugggcuacauccugcgcgacaucagcaagauccccgggggcaacauguacgccgacgacaccgcgggcugggacacccggaucacggaggacgaccuccagaacgaggccaagaucaccgacaucauggagccggagcacgcccugcuggccaccuccaucuucaagcucaccuaccagaacaagguggugcgcguccagcggcccgccaagaacgggacggugauggacgugaucagccgccgcgaccagcggggcuccgggcaggucggcaccuacggccugaacaccuucaccaacauggaggcgcagcugauccgccagauggagagcgaggggaucuuccuccccuccgagcuggagacgcccaaccuggccgagcgggugcucgacuggcuggagaaguacggcguggagcgccugaagcggauggccaucagcggggacgacugcgucgugaagccgaucgacgaccgcuucgccaccgcccucaccgcgcugaacgacaugggcaaggugcggaaggacaucccccagugggagcccuccaagggguggaacgacuggcagcagguccccuucugcagccaccacuuccaccagcugaucaugaaggacggccgcgagaucguggugccgugccggaaccaggacgagcucgucggccgcgcccgggugucccagggggccggcuggagccugcgcgagaccgccugccugggcaagagcuacgcccagauguggcagcucauguacuuccaccggcgcgaccugcggcuggcggccaacgccaucugcuccgccgugcccgucgacugggugcccacgagccgcaccaccugguccauccacgcgcaccaccaguggaugaccacggaggacaugcucagcguguggaaccgggucuggaucgaggagaaccccuggauggaggacaagacccacguguccagcuggggcgacgugccguaccuggggaagcgcgaggaccaguggugcggcucccugaucggccucaccgcccgggccaccugggccagcaacauccaggucgccaucaaccaggugcgccgccugaucgggaacgagaacuaccuggacuacaugaccuccaugaagcgguucaagaacgagggcgaccccgagggggcgcucugguga

SEQ ID NO: 8446 - RNA, 9879 nt, Artificial Sequence
  derived and/or modified CDS sequence (opt1) from DENV-1__FJ882518__SS-prME
agcgugaccaugcugcucaugcugaugcccaccgcccuggccuuccaccucaccacccggggcggggagccccacaugaucgugaccaagcaggagcggggcaagucccugcuguucaagaccagcgcgggggugaacaugugcacccucaucgccauggaccugggcgagcugugcgaggacaccaugaccuacaagugcccccggaucaccgaggccgagcccgacgacguggacugcuggugcaacgccaccgacaccugggugaccuacgggaccugcucccagacgggcgagcaccggcgcgacaagcggagcguggcccucgcgccccacgugggccuggggcuggagacccgcaccgagaccuggauguccagcgagggcgccuggaagcagauccagcgggucgagacgugggcccuccgccaccccggguucaccgugaucgcccuguuccuggcgcacgccaucggcaccuccaucacccagaaggggaucaucuucauccuccugaugcuggugacgcccagcauggccaugcggugcgucggcaucggcucccgcgacuucguggaggggcucagcggcgccaccuggguggacgucgugcuggagcacggguccugcgugaccaccauggccaaggacaagcccacgcuggacaucgagcuccugaagaccgaggucaccaaccccgcggugcugcggaagcucugcaucgaggccaagaucagcaacaccacgaccgacucccgcugccccacccagggcgaggccacccugauggaggagcaggacgccaacuucgugugccggcgcacguucgucgaccggggcugggggaacggcugcgggcuguucggcaaggggagccucaucacgugcgccaaguucaagugcgugaccaagcuggagggcaagaucgugcaguacgagaaccugaaguacuccgucaucgugaccgugcacacgggcgaccagcaccaggucgggaacgagagcaccgagcacggcaccaccgcgaccaucacgccccaggcccccaccuccgagauccagcucaccgacuacggggcccugacccuggacugcagcccccgcacgggccucgacuucaacgagauggugcugcugaccaugaaggagaaguccuggcucguccacaagcagugguuccuggaccugccgcuccccuggaccagcggggccagcaccucccaggagacguggaaccggcaggaccugcuggugaccuucaagaccgcccacgcgaagaagcaggagguggucgugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgugaugugcaccggguccuucaagcucgagaaggaggucgcggagacgcagcacggcaccgugcuggugcagaucaaguacgagggcaccgacgcccccugcaagauccccuucagcacccaggacgagaagggggucacgcagaacggccggcugaucaccgccaacccgaucgugaccgacaaggagaagcccgugaacaucgaggccgagccgcccuucggggaguccuacaucgucaucggcgcgggcgagaaggcccugaagcucagcugguucaagaagggguccagcaucggcaagauguucgaggccaccgcccgcggggcccggcgcauggcgauccugggcgacacggccugggacuucggguccgugggcggcguguucaccagcgucgggaagcuggugcaccagaucuucggcaccgccuacgggguccuguucuccggcgucagcuggaccaugaagaucgggaucggcgugcugcugacguggcucggccugaacucccgcagcaccucccugagcaugaccugcaucgccguggggcucgucacccuguaccugggcgugauggugcaggccgacuccgggugcgucaucaacuggaagggccgggagcucaagugcgggagcggcaucuucgugacgaacgaggugcacaccuggaccgagcaguacaaguuccaggcggacagcccgaagcgccuguccgccgccaucggcaaggccugggaggagggggucugcggcauccggagcgccacccgccuggagaacaucauguggaagcagaucuccaacgagcucaaccacauccugcuggagaacgacaugaaguucaccgugguggucggggacguggugggcauccucgcgcaggggaagaagaugauccggccccagcccauggagcacaaguacagcuggaaguccuggggcaaggccaagaucaucggcgccgacguccagaacacgaccuucaucaucgacgggcccagcaccccggagugccccgacgaccagcgcgccuggaacaucugggagguggaggacuacggcuucgggaucuucaccacgaacaucuggcugaagcugcgggacuccuacacccaggugugcgaccaccgccucaugagcgcggccaucaaggacuccaaggccguccacgccgacaugggcuacuggaucgagagcgagaagaacgagaccuggaagcuggcccgggcguccuucaucgaggugaagaccugcaucuggcccaagagccacacgcugugguccaacggcgugcucgagagcgagaugaucauccccaagaucuacgggggcccgaucucccagcacaacuaccgccccggguacuucacccagaccgccggccccuggcaccuggggaagcuggagcucgacuucgaccugugcgagggcaccacggucgugguggacgagcacugcggcaaccgggggccgagccugcgcaccaccaccgucacgggcaagaucauccacgaguggugcugccgguccugcacccugccgccccuccgcuucaagggggaggacggcugcugguacgggauggagauccggcccgugaaggagaaggaggagaaccuggugaaguccauggucagcgccggcuccggcgagguggacagcuucucccucgggcugcugugcaucagcaucaugaucgaggaggugaugcgcucccgguggagccgcaagaugcucaugaccggcacccuggccgucuuccugcuccugaucauggggcagcugacguggaacgaccucauccggcugugcaucauggugggcgccaacgcguccgaccgcauggggaugggcaccaccuaccuggcccucauggccaccuucaagaugcgcccgauguucgccgugggccugcuguuccggcgccucacgagccgggagguccugcugcucaccaucgggcugucccugguggccagcgucgagcuccccaacucccuggaggagcugggcgacgggcucgcgaugggcaucaugauccugaagcugcucaccgacuuccagagccaccagcugugggccacccugcucucccugacguucaucaagaccacccugagccuccacuacgccuggaagaccauggccauggugcuguccaucgcgagccuguucccccucugccuguccacgaccagccagaagaccaccuggcugcccgugcuccugggcucccuggggugcaagccgcucacgauguuccugaucaccgagaccaagaucuggggccgcaagagcuggccccugaacgaggggaucauggccgucggcguggugagcauccuccuguccagccugcucaagaacgacgucccccuggccgggccccugaucgccggcggcaugcucaucgccugcuacgugaucuccgggagcuccgcggaccugagccuggagaaggccgccgagguguccugggaggaggaggccgagcacagcggcgccucccacaacauccucgucguggugcaggacgacgggaccaugaagaucaaggacgaggagcgggacgacacccugacgauccugcucaaggcgacccugcuggccgucagcggcguguacccgcucuccauccccgccacccuguucgugugguacuucuggcagaagaagaagcagcgcagcgggguccugugggacacccccagcccgcccgagguggagcgggccgugcuggacgacggcaucuaccgcaucaugcagcggggccuccuggggcgcagccaggucggcguggggguguuccaggagaacgucuuccacacgauguggcacgugacccggggcgccgugcugauguaccaggggaagcgccucgagcccuccugggcgagcgucaagaaggaccugaucuccuacggcggcggguggcggcugcagggcagcuggaacaccggggaggagguccaggugaucgccgucgagcccggcaagaaccccaagaacgugcagaccgcccccgggacguucaagacccccgagggcgaggugggcgccaucgcccucgacuucaagcccgggaccuccggcagccccaucgucaaccgcgaggggaagaucgugggccuguacggcaacgggguggucaccacgagcggcaccuacguguccgcgaucgcccaggccaaggccagccaggaggggccgcugcccgagaucgaggacgagguguuccggaagcgcaaccucaccaucauggaccugcaccccggcuccgggaagacccggcgcuaccugccggcgaucguccgggaggccaucaagcgcaagcuccggacgcugauccuggcccccacccgcgugguggccagcgagauggccgaggcgcucaagggcaugcccauccgcuaccagaccaccgccgucaaguccgagcacacgggcaaggagaucguggaccugaugugccacgccaccuucaccaugcggcugcucagccccgugcgcgucccgaacuacaacaugaucaucauggacgaggcccacuucaccgaccccuccagcaucgccgcgcggggguacaucuccacgcgcgugggcaugggggaggccgccgccaucuucaugaccgccacgccgcccggcagcguggaggcguucccgcaguccaacgccgucauccaggacgaggagcgggacauccccgagcgcagcuggaacuccggguacgaguggaucaccgacuuccccggcaagacggugugguucgugcccagcaucaaguccggcaacgacaucgccaacugccugcggaagaacgggaagcgcgucauccagcugagccggaagaccuucgacaccgaguaccagaagaccaagaacaacgacugggacuacguggugacgaccgacaucuccgagaugggcgccaacuuccgcgcggaccgggucaucgacccgcgccggugccucaagcccgugauccugaaggacgggcccgagcgcgucauccuggccggccccaugccggugaccguggccagcgccgcccagcggcgcgggcggaucggccgcaaccacaacaaggagggcgaccaguacaucuacauggggcagccccucaacaacgacgaggaccacgcgcacuggaccgaggccaagaugcugcuggacaacaucaacacgcccgagggcaucauccccgcccucuucgagccggagcgggagaaguccgccgccaucgacggggaguaccgccugcgcggcgaggcgcggaagaccuucgucgagcugaugcgccgcggggaccuccccguguggcugagcuacaagguggccagcgagggcuuccaguacuccgaccgccgguggugcuucgacggcgagcgcaacaaccagguccuggaggagaacauggacguggagaucuggaccaaggagggggagcggaagaagcuccgcccccgguggcuggacgcccgcaccuacagcgacccccuggcccuccgggaguucaaggaguucgccgcgggccgccgguccgugagcggggaccugauccuggagaucggcaagcucccgcagcaccugacgcagcgcgcccagaacgcccuggacaaccucgucaugcugcacaacuccgagcagggcgggcgggccuaccgccacgcgauggaggagcugcccgacaccaucgagacccucaugcugcuggcccucaucgccgugcugaccggcggggugacccuguucuuccucagcggccgggggcugggcaagacguccaucggccugcucugcgucauggccagcuccgugcugcuguggauggccagcguggagccccacuggaucgcggccuccaucauccucgaguucuuccugaugguccugcucauccccgagccggaccgccagcggacgccccaggacaaccagcuggccuacguggugaucgggcuccucuucaugauccugaccgucgccgccaacgagaugggccugcucgagaccacgaagaaggaccuggggaucggccacguggcgguggagaaccaccaccacgccaccaugcuggacgucgaccuccaccccgccagcgccuggacccuguacgccguggcgaccacgaucaucaccccgaugaugcgccacaccaucgagaacaccacggccaacaucucccugaccgccaucgccaaccaggccgcgauccucauggggcuggacaagggcuggcccaucagcaagauggacaucggcgugccccugcucgcccuggggugcuacucccaggucaacccccugacccucaccgccgccgugcugaugcugguggcgcacuacgccaucaucggcccggggcuccaggccaaggccacgcgggaggcccagaagcgcaccgcggccggcaucaugaagaaccccaccgucgacgggaucguggccaucgaccuggaccccguggucuacgacgccaaguucgagaagcagcugggccagaucaugcuccugauccugugcaccagccagauccuccugaugcgcacgaccugggcccugugcgaguccaucacccucgcgaccggcccccugacgacccugugggaggggagcccgggcaaguucuggaacaccaccaucgccguguccauggccaacaucuuccgggggagcuaccucgccggcgccggccuggcguucagccugaugaagucccucgggggcgggcgccggggcacgggggcccagggcgagacccugggcgagaaguggaagcgccagcugaaccagcucagcaaguccgaguucaacaucuacaagcggagcgggaucauggagguggaccgcuccgaggccaaggagggccugaagcgcggggagaccacccgccacgccgucagccggggcacggcgaagcugcgcugguucguggagcggaaccuggugaagcccgaggggaaggucaucgaccucggcugcggccgcgggggcugguccuacuacugcgccgggcugaagaaggugaccgaggugaagggcuacaccaagggcgggcccggccacgaggagcccaucccgauggccaccuacggguggaaccuggucaagcuccacagcggcaaggacguguucuucacgccgcccgagaagugcgacacccugcugugcgacaucggggaguccagccccaacccgaccaucgaggagggccggacccuccgcgugcugaagauggucgagcccuggcugcgggggaaccaguucugcaucaagauccucaaccccuacaugcccuccgugguggagacccuggagcagaugcagcgcaagcacggcggcaugcugguccggaacccgcucagccgcaacuccacgcacgagauguacugggugagcugcgggaccggcaacaucguguccgccgucaacaugaccagccggaugcugcugaaccgcuucaccauggcccaccgcaagcccacguacgagcgggacguggaccucggggcgggcacccgccacguggccgucgagcccgagguggccaaccuggacaucaucggccagcggaucgagaacaucaagcacgagcacaaguccaccuggcacuacgacgaggacaaccccuacaagaccugggccuaccacgggagcuacgaggucaagccguccggcagcgccagcuccauggugaacgggguggucaagcugcucacgaagcccugggacgugauccccauggugacccagaucgcgaugaccgacaccacgcccuucggccagcagcgcgucuucaaggagaagguggacacccggaccccgaaggccaagcgcgggaccgcccagaucauggaggugacggcccgguggcuguggggcuuccugagccgcaacaagaagccccggaucugcacccgcgaggaguucacccggaagguccgcuccaacgccgcgaucggcgccguguucguggacgagaaccaguggaacagcgccaaggaggccgucgaggacgagcgguucugggaccucgugcagaaggagcgcgagcugcacaagcaggggaagugcgcgaccugcguguacaacaugaugggcaagcgggagaagaagcugggggaguucggcaaggccaaggggucccgcgccaucugguacauguggcucggcgcccgguuccuggaguucgaggcccugggcuucaugaacgaggaccacugguucagccgcgagaacucccucagcggggucgagggcgaggggcugcacaagcugggcuacauccuccgggacaucuccaagauccccgggggcaacauguacgcggacgacacggccggcugggacacccgcaucaccgaggacgaccugcagaacgaggccaagaucaccgacaucauggagccggagcacgcccugcucgccacgagcaucuucaagcugaccuaccagaacaagguggugcggguccagcgccccgcgaagaacgggaccgugauggacgugaucucccgccgggaccagcgcggcagcgggcaggucggcaccuacggccugaacacguucaccaacauggaggcccagcucauccggcagauggaguccgaggggaucuuccugcccagcgagcuggagacccccaaccucgccgagcgcgugcuggacuggcuggagaaguacggcguggagcggcucaagcgcauggccaucuccggggacgacugcgucgugaagccgaucgacgaccgguucgccaccgcgcugacggcccugaacgacaugggcaaggugcgcaaggacaucccccagugggagcccagcaagggguggaacgacuggcagcagguccccuucugcucccaccacuuccaccagcucaucaugaaggacggccgggagaucguggugccgugccgcaaccaggacgagcuggucggccgggcccgcgugagccagggggccggcuggagccugcgggagaccgccugccucgggaaguccuacgcgcagauguggcagcugauguacuuccaccgccgggaccugcgccucgccgccaacgccaucugcagcgcggugcccgucgacugggugcccaccucccggaccacguggagcauccacgcccaccaccaguggaugaccaccgaggacaugcuguccguguggaaccgcgucuggaucgaggagaaccccuggauggaggacaagacccacgugagcuccuggggcgacgugccguaccuggggaagcgggaggaccaguggugcggcagccucaucggccugaccgcccgcgccacgugggccuccaacauccaggucgcgaucaaccaggugcgccggcugaucgggaacgagaacuaccucgacuacaugaccagcaugaagcgcuucaagaacgagggcgaccccgagggggcccugugguga

SEQ ID NO: 8447 - RNA, 9879 nt, Artificial Sequence
  derived and/or modified CDS sequence (opt1) from DENV-1__FJ882519__SS-prME
agcgugaccaugcugcucaugcugaugcccaccgcccuggccuuccaccucacgacccggggcggggagccccacaugaucgugagcaagcaggagcggggcaagagccugcuguucaagaccagcgccggggugaacaugugcacccucaucgccauggaccugggcgaguucugcgaggacaccaugaccuacaagugcccccgcaucaccgaggccgagcccgacgacguggacugcuggugcaacgccaccgacacgugggugaccuacgggaccugcagccagaccggcgagcaccggcgggacaagcgguccguggcccuggcgccccacgugggccucgggcuggagacgcgcaccgagaccuggaugagcuccgagggcgccuggaagcagauccagcggguggagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugcccgacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaagaucguccaguacgagaaccugaaguacagcgugaucgugaccguccacaccggcgaccagcaccagguggggaacgaguccacggagcacggcaccaccgcgaccaucacgccccaggcccccagcacggagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccagcggggccuccaccagccaggagaccuggaaccggaaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcauguccuacgucaugugcaccgggagcuucaagcuggagaaggagguggcggagacccagcacggcacggugcucguccagaucaaguacgagggcaccgacgcccccugcaagauccccuucuccacccaggacgagaagggggugacccagaacggccggcugaucacggccaacccgaucgugaccgacaaggagaagcccgucaacaucgaggccgagccgcccuucggggagagcuacaucgugaucggcgcgggcgagaaggcccugaagcuguccugguucaagaaggggagcuccaucggcaagauguucgaggccaccgcccgcggggcccggcgcauggcgauccucggcgacaccgccugggacuucgggagcaucggcggcguguucacguccgucgggaagcuggugcaccagaucuucggcaccgccuacggggugcuguucagcggcgucuccuggaccaugaagaucgggaucggcgugcuccugaccuggcugggccucaacagccgcuccacgagccuguccaugaccugcaucgccguggggcuggucacccucuaccugggcgugauggugcaggccgacagcgggugcgucaucaacuggaagggccgggagcugaagugcgggagcggcaucuucgugaccaacgaggugcacacguggaccgagcaguacaaguuccaggcggacuccccgaagcgccucagcgccgccaucggcaaggccugggaggagggggucugcggcauccgguccgccacccgccuggagaacaucauguggaagcagaucagcaacgagcugaaccacauccuccuggagaacgacaugaaguucaccgugguggucggggacguggcgggcauccuggcccaggggaagaagaugauccggccccagcccauggaguacaaguacuccuggaaguccuggggcaaggccaagaucaucggcgccgacgugcagaacaccacguucaucaucgacgggcccaacaccccggagugccccgacgaccagcgcgcguggaacaucugggaggucgaggacuacggcuucgggaucuucaccaccaacaucuggcucaagcugcgggacuccuacacccaggugugcgaccaccgccugaugagcgccgccaucaaggacuccaaggccgugcacgccgacaugggcuacuggaucgagagcgagaagaacgagaccuggaagcucgcgcgggccuccuucaucgaggucaagaccugcaucuggcccaagagccacacccugugguccaacggcgugcuggagagcgagaugaucauccccaagaucuacgggggcccgaucucccagcacaacuaccgccccggguacuucacgcagaccgccggccccuggcaccucgggaagcuggagcuggacuucgaccucugcgagggcaccaccguggucguggacgagcacugcggcaaccgggggccgagccugcgcacgaccaccgugaccggcaagaucauccacgaguggugcugccgguccugcacgcugccgccccugcgcuucaagggggaggacggcugcugguacgggauggagauccggcccgucaaggagaaggaggagaaccuggucaagagcauggugagcgccggcuccggcgaggucgacagcuucucccuggggcuccugugcaucagcaucaugaucgaggaggugaugcgcucccgguggagccgcaagaugcugaugaccggcacccucgccguguucuuccugcugaucauggggcagcucaccuggaacgaccugauccggcugugcaucauggucggcgcgaacgccuccgaccgcauggggaugggcacgaccuaccucgcccugauggccaccuucaagaugcgcccgauguucgccguggggcuccuguuccggcgccugaccagccgggaggugcugcuccugacgaucgggcugucccucgucgcgagcguggagcugcccaacucccuggaggagcucggcgacgggcuggccaugggcaucaugauccugaagcuccugaccgacuuccagagccaccagcugugggccacccuccugucccugaccuucaucaagacgaccuucagccuccacuacgccuggaagaccauggcgaugguccuguccaucgugagccuguucccccucugccuguccaccacgagccagaagaccaccuggcugcccgugcuccugggcucccuggggugcaagccgcucaccauguuccugaucgccgagaacaagaucuggggccgcaagagcuggccccugaacgaggggaucauggccgucggcaucgugagcauccuccuguccagccugcucaagaacgacgugccccuggccgggccccugaucgccggcggcaugcucaucgcgugcuacgucaucuccgggagcuccgccgaccugagccuggagaaggccgccgagguguccugggaggaggaggccgagcacagcggcgcgucccacaacauccucguggagguccaggacgacgggacgaugaagaucaaggacgaggagcgggacgacacccugaccauccugcucaaggccacccugcuggccgugagcggcguguacccgcucuccauccccgccacccuguucgucugguacuucuggcagaagaagaagcagcgcagcggggugcugugggacacgcccagcccgcccgagguggagcgggccguccucgacgacggcaucuaccgcaucaugcagcggggccugcuggggcgcagccaggugggcgugggggucuuccaggagaacguguuccacaccauguggcacgugacccggggcgcgguccugauguaccaggggaagcgccucgagcccuccugggccagcgugaagaaggaccugaucuccuacggcggcggguggcggcugcagggcagcuggaacaccggggaggaggugcaggucaucgccguggagcccggcaagaaccccaagaacgugcagacggcccccgggaccuucaagaccuccgagggcgaggucggcgccaucgcgcucgacuucaagcccgggaccagcggcagccccaucgugaaccgcgaggggaagaucgugggccuguacggcaacggggucgugacgaccuccggcaccuacgugagcgccaucgcccaggccaaggcgucccaggaggggccccugccggagaucgaggacgaggucuuccggaagcgcaaccucaccaucauggaccugcaccccggcagcgggaagacgcggcgcuaccugcccgccaucgugcgggaggccaucaagcgcaagcuccggacccugauccuggccccgacccgcguggucgccuccgagauggcggaggcccucaagggcaugcccauccgcuaccagaccacggccgucaagagcgagcacaccggcaaggagaucguggaccugaugugccacgccaccuucaccaugcggcugcucucccccguccgcgugcccaacuacaacaugaucaucauggacgaggcccacuucacggacccgagcuccaucgcggcccggggguacaucagcacccgcgugggcaugggggaggccgccgccaucuucaugaccgcgacgccgcccggcuccgucgaggccuucccccagagcaacgccgugauccaggacgaggagcgggacaucccggagcgcuccuggaacagcggguacgaguggaucacggacuuccccggcaagaccgugugguucguccccuccaucaagagcggcaacgacaucgccaacugccugcggaagaacgggaagcgcgugauccagcugucccggaagaccuucgacaccgaguaccagaagacgaagaacaacgacugggacuacguggucaccaccgacaucagcgagaugggcgcgaacuuccgcgccgaccgggugaucgacccccgccggugccucaagccggugauccugaaggacgggcccgagcgcgucauccuggccggccccaugcccgugaccgucgccuccgccgcgcagcggcgcgggcggaucggccgcaaccacaacaaggagggcgaccaguacaucuacauggggcagccgcucaacaacgacgaggaccacgcccacuggacggaggccaagaugcugcuggacaacaucaacacccccgagggcaucauccccgcccucuucgagcccgagcgggagaaguccgccgcgaucgacggggaguaccgccugcgcggcgaggcccggaagaccuucguggagcugaugcgccgcggggaccucccgguguggcugagcuacaaggucgccuccgagggcuuccaguacagcgaccgccgguggugcuucgacggcgagcgcaacaaccaggugcuggaggagaacauggacguggagaucuggaccaaggagggggagcggaagaagcuccgcccccgguggcuggacgcccgcacguacuccgacccccuggcccuccgggaguucaaggaguucgcggccggccgccggagcgucuccggggaccugauccuggagaucggcaagcucccccagcaccugacccagcgcgcccagaacgcccuggacaaccucgugaugcugcacaacagcgagcagggcgggcgggcguaccgccacgccauggaggagcugccggacaccaucgagacccucaugcugcuggcccucaucgccgugcugacgggcggggucacccuguucuuccucuccggccgggggcugggcaagaccagcaucggccugcucugcgugauggccuccagcgugcugcuguggauggcguccgucgagccccacuggaucgccgccagcaucauccucgaguucuuccugauggugcugcucauccccgagcccgaccgccagcggaccccgcaggacaaccagcuggccuacguggucaucgggcuccucuucaugauccugaccguggccgcgaacgagaugggccugcucgagacgaccaagaaggaccuggggaucggccacguggccgucgagaaccaccaccacgccgccaugcuggacguggaccuccaccccgccuccgcguggacccuguacgccguggccaccacgaucaucacccccaugaugcgccacaccaucgagaacaccacggccaacaucagccugaccgccaucgcgaaccaggccgccauccucauggggcuggacaagggcuggccgaucuccaagauggacaucggcgucccccugcucgcccuggggugcuacagccaggugaacccccugacccucaccgcggccgugcugaugcuggucgcccacuacgccaucaucggccccgggcuccaggccaaggcgacgcgggaggcccagaagcgcaccgccgccggcaucaugaagaacccgaccguggacgggaucguggccaucgaccuggaccccgucguguacgacgcgaaguucgagaagcagcugggccagaucaugcuccugauccugugcaccucccagauccuccugaugcgcacgaccugggcccugugcgagagcaucacccucgccaccggcccccugacgacccugugggaggggucccccggcaaguucuggaacaccaccaucgccgugagcauggccaacaucuuccgggggagcuaccucgcgggcgccggccuggccuucucccugaugaagucccucgggggcgggcgccggggcacgggggcccagggcgagacccugggcgagaaguggaagcgccagcugaaccagcucuccaagagcgaguucaacaccuacaagcgguccgggaucauggaggucgaccgcagcgaggcgaaggagggccugaagcgcggggagaccacgaagcacgccgugucccgcggcaccgccaagcugcggugguucguggagcgcaaccucgucaagccggaggggaaggugaucgaccugggcugcggccgcggcggguggagcuacuacugcgccgggcugaagaaggugaccgaggucaagggguacaccaagggcgggcccggccacgaggagcccauccccauggccacguacggguggaaccuggugaagcuccacuccggcaaggacguguucuucaucccgcccgagaagugcgacacccugcugugcgacaucggggagagcucccccaaccccaccaucgaggagggccgcacccuccggguccugaagaugguggagccguggcugcgcgggaaccaguucugcaucaagauccucaaccccuacaugcccagcguggucgagacgcuggagcagaugcagcggcgccacggcggcaugcuggugcggaacccccucucccgcaacagcacccacgagauguacuggguguccugcgggaccggcaacaucgucagcgcggugaacaugaccucccggaugcugcugaaccgcuucaccauggcccaccgcaagccgacguacgagcgggacguggaccucggggccggcacccgccacgucgccguggagcccgagguggccaaccuggacaucaucggccagcggaucgagaacaucaagcacgagcacaagagcaccuggcacuacgacgaggacaaccccuacaagaccugggcguaccacggguccuacgaggucaagcccagcggcagcgccuccagcauggugaacggggucgugaagcugcucacgaagccgugggacgugauccccauggucacccagaucgccaugaccgacaccacgcccuucggccagcagcgcguguucaaggagaagguggacacccggacccccaaggccaagcgcgggaccgcccagaucauggaggucacggcgaaguggcuguggggcuuccugucccggaacaagaagccgcgcaucugcacccgggaggaguucacccgcaaggugcggagcaacgccgccaucggcgccguguucgucgacgagaaccaguggaacuccgcgaaggaggccguggaggacgagcgcuucugggaccucgugcaccgggagcgcgagcugcacaagcaggggaagugcgcgaccugcgucuacaacaugaugggcaagcgggagaagaagcugggggaguucggcaaggccaaggggagccgcgccaucugguacauguggcucggcgcgcgguuccuggaguucgaggcccugggcuucaugaacgaggaccacugguucucccgcgagaacagccucuccgggguggagggcgaggggcugcacaagcugggcuacauccuccgggacaucagcaagauccccgggggcaacauguacgccgacgacacggccggcugggacacccgcaucaccgaggacgaccugcagaacgaggccaagaucaccgacaucauggagcccgagcacgcgcugcucgccaaguccaucuucaagcugacguaccagaacaaggugguccgggugcagcgcccggccaagaacgggaccgugauggacgucaucagccgccgggaccagcgcggcuccggccaggugggcaccuacggccugaacaccuucacgaacauggaggcccagcucauccggcagauggagagcgaggggaucuucucccccagcgagcuggagacccccaaccuggccggccgcgugcucgacuggcuggagaagcacggggucgagcggcugaagcgcauggcgaucuccggcgacgacugcguggugaagcccaucgacgaccgguucgccaccgcccucaccgcccugaacgacauggggaagguccgcaaggacaucccgcagugggagcccagcaagggcuggaacgacuggcagcagguccccuucugcagccaccacuuccaccagcugaucaugaaggacggccgggagaucgugguccccugccgcaaccaggacgagcucguggggcgggcccgcgugucccagggcgcgggguggagccugcgggagacggccugccugggcaaguccuacgcccagauguggcagcucauguacuuccaccgccgggaccugcgccuggccgcgaacgccaucugcagcgccgucccgguggacugggugcccaccucccggaccaccuggagcauccacgcccaccaccaguggaugacgaccgaggacaugcucuccgucuggaaccgcguguggaucgaggagaaccccuggauggaggacaagacccacaucagcuccuggggcgacgugcccuaccugggcaagcgggaggaccaguggugcggcagccugaucgggcucaccgcccgcgcgacgugggccaccaacauccaggucgccaucaaccaggugcgccggcugaucggcaacgagaacuaccuggacuacaugaccuccaugaagcgcuucaagaacgagagcgacccggagggggcccucugguga

SEQ ID NO: 8448 - RNA, 9879 nt, Artificial Sequence
  derived and/or modified CDS sequence (opt1) from DENV-1__FJ882520__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgagguggagcccgacgacguggacugcuggugcaacaccaccgacaccugggugaccuacgggaccugcagccagacgggcgagcaccggcgcgacaagcggagcguggcccucgcgccccacgucggccuggggcuggagacccgggccgagaccuggaugagcuccgagggcgcguggaagcagauccagaagguggagaccugggcccuccggcaccccggguucacggugaucgcccuguuccuggcccacgcgaucggcaccagcaucacccagaaggggaucaucuucauccuccugaugcuggucacccccuccauggccaugcgcugcgugggcaucggcagccgggacuucguggaggggcucuccggcgccacgugggucgacguggugcuggagcacgggagcugcgucaccaccauggccaaggacaagcccacccuggacaucgagcuccugaagacggaggugaccaaccccgccgugcugcgcaagcucugcaucgaggcgaagaucuccaacaccaccacggacagccggugcccgacccagggcgaggccacccuggucgaggagcaggacgccaacuucgugugccgccggaccuucguggaccgcggcugggggaacggcugcgggcuguucggcaaggggucccucaucacgugcgccaaguucaagugcgucaccaagcuggagggcaagaucgugcaguacgagaaccugaaguacagcgugaucgucaccgugcacaccggcgaccagcaccaggucgggaacgaguccacggagcacggcaccaccgccaccaucacgccccaggcgcccacgagcgagauccagcucaccgacuacggggcccugacccuggacugcagcccccggaccggccucgacuucaacgagauggugcugcugacgaugaaggagaaguccuggcucgugcacaagcagugguuccuggaccugccccuccccuggaccagcggggccuccaccagccaggagaccuggaaccgccaggaccugcuggucacguucaagaccgcccacgccaagaagcaggagguggugguccucggcucccaggagggcgcgaugcacaccgcccugaccggggccacggagauccagaccagcggcaccaccacgaucuucgccgggcaccugaagugccggcucaagauggacaagcugacccugaagggcauguccuacgugaugugcaccgggagcuucaagcucgagaaggagguggccgagacccagcacggcacgguccuggugcagaucaaguacgagggcaccgacgcgcccugcaagauccccuucuccacccaggacgagaagggggugacccagaacggccgccugaucacggccaacccgaucgucaccgacaaggagaagcccgugaacaucgaggccgagccgcccuucggggagagcuacaucgugaucggcgccggcgagaaggcgcugaagcucuccugguucaagaaggggagcuccaucggcaagauguucgaggccaccgcccgcggggcccgccggauggccauccugggcgacaccgcgugggacuucgggagcaucggcggcgucuucacguccguggggaagcuggugcaccagaucuucggcaccgccuacgggguccucuucagcggcguguccuggaccaugaagaucgggaucggcgugcugcugaccuggcucggccugaacagccgcuccacgagccuguccaugaccugcaucgccgucgggcucgugacccuguaccugggcgugaugguccaggccgacagcgggugcgugaucaacuggaagggccgcgagcucaagugcgggagcggcaucuucgugaccaacgagguccacacguggaccgagcaguacaaguuccaggccgacuccccgaagcggcugagcgcggccaucggcaaggccugggaggagggggugugcggcauccgcuccgccacccggcuggagaacaucauguggcgccagaucagcaacgagcucaaccacauccugcuggagaacgacaugaaguucaccguggucgugggggacguggucggcauccucgcccaggggaagaagaugauccggccccagcccauggagcacaaguacuccuggaaguccuggggcaaggcgaagaucaucggcgccgacgugcagaacaccacguucaucaucgacgggcccaacaccccggagugccccgacgaccagcgcgccuggaacaucugggagguggaggacuacggcuucgggaucuucaccaccaacaucuggcugaagcugcgggacuccuacacgcaggucugcgaccaccgccucaugagcgccgcgaucaaggacuccaaggccgugcacgccgacaugggcuacuggaucgagagcgagaagaacgagaccuggaagcuggcccgggccuccuucaucgaggugaagaccugcaucuggcccaagagccacacccugugguccaacggcguccucgagagcgagaugaucauccccaagaucuacgggggcccgaucucccagcacaacuaccgccccggguacuucacgcagaccgcgggccccuggcaccuggggaagcuggagcucgacuucgaccugugcgagggcaccaccgugguggucgacgagcacugcggcaaccgggggccgagccugcgcacgaccaccgugaccggcaagaucauccacgaguggugcugccgguccugcacgcugccgccccuccgcuucaagggggaggacggcugcugguacgggauggagauccggcccgugaaggagaaggaggagaaccuggucaagagcauggugagcgccggcuccggcgagguggacagcuucucccucgggcugcugugcaucagcaucaugaucgaggaggucaugcgcucccgguggagccgcaagaugcucaugaccggcacccuggccguguucuuccugcucaucauggggcagcugaccuggaacgaccugauccgguccugcaucauggugggcgccaacgccagcgaccgcauggggaugggcacgaccuaccucgcgcugauggccaccuucaagaugcgcccgauguucgccgucggccugcuguuccggcgccugaccucccgggaggugcugcuccugacgaucgggcugagccucgucgccuccguggagcugcccaacagccuggaggagcucggcgacgggcuggccaugggcaucaugauccugaagcuccugaccgacuuccaguccuaccagcugugggcgacccuccugagccugaccuucaucaagacgaccuucucccuccacuacgccuggaagaccauggccauggugcugagcaucgucucccugcucccccugugccugagcaccacgucccagaagaccaccuggcuccccgugcugcugggcagccucgggugcaagccgcugaccauguuccugaucgccgagaacaagaucuggggccgcaagagcuggccccucaacgaggggaucauggcggugggcaucgucuccauccugcugagcucccuccugaagaacgacgugccccuggccgggccccucaucgccggcggcaugcugaucgccugcuacgugaucagcggguccagcgccgaccugucccucgagaaggcggccgaggucagcugggaggaggaggccgagcacuccggcgccagccacaacauccugguggaggugcaggacgacgggacgaugaagaucaaggacgaggagcgggacgacacccugaccauccuccugaaggccacccugcucgcggucuccggcguguacccgcugagcauccccgccacccuguucgugugguacuucuggcagaagaagaagcagcgcuccgggguccucugggacacgcccagcccgcccgagguggagcgggccgugcuggacgacggcaucuaccgcaucaugcagcggggccugcuggggcgcucccaggucggcguggggguguuccaggagaacgucuuccacaccauguggcacgugacccggggcgccgugcucauguaccaggggaagcgccuggagcccagcugggccuccgucaagaaggaccugaucagcuacggcggcggguggcggcuccagggcuccuggaacaccggggaggagguccaggugaucgcggucgagcccggcaagaaccccaagaacgugcagacggcccccgggaccuucaagacccccgagggcgaggugggcgccaucgcccuggacuucaagcccgggaccagcggcagccccaucgucaaccgcgaggggaagaucgugggccuguacggcaacgggguggucacgaccuccggcaccuacgugagcgccaucgcgcaggccaaggccucccaggaggggccgcuccccgagaucgaggacgagguguuccggaagcgcaaccugaccaucauggaccugcaccccggcagcgggaagacgcggcgcuaccucccggccaucguccgggaggcgaucaagcgcaagcugcggacccugauccucgcccccacccgcgugguggccuccgagauggccgaggcccugaagggcaugcccauccgcuaccagaccacggcggucaagagcgagcacaccggccgggagaucguggaccugaugugccacgccaccuucaccaugcgccuccugucccccgugcgggucccgaacuacaacaugaucaucauggacgaggcccacuucacggaccccagcuccaucgccgcccgcggguacaucagcacccgggugggcaugggggaggcggccgccaucuucaugaccgccacgccgcccggcuccguggaggccuucccgcagagcaacgcggucauccaggacgaggagcgcgacauccccgagcgguccuggaacagcggguacgaguggaucacggacuuccccggcaagaccgugugguucgugcccuccaucaagagcggcaacgacaucgccaacugccugcgcaagaacgggaagcgggucauccagcucucccgcaagaccuucgacaccgaguaccagaagacgaagaacaacgacugggacuacguggugaccaccgacaucagcgagaugggcgccaacuuccgggccgaccgcgucaucgacccgcggcgcugccugaagcccgugauccugaaggacgggcccgagcgggucauccucgcgggccccaugccggugaccguggccuccgccgcccagcgccgggggcgcaucggccggaaccacaacaaggagggcgaccaguacaucuacauggggcagccccugaacaacgacgaggaccacgcccacuggacggaggcgaagaugcugcucgacaacaucaacacccccgagggcaucauccccgcccuguucgagccggagcgcgagaaguccgccgccaucgacggggaguaccgccugcggggcgaggcccgcaagaccuucgucgagcucaugcggcgcggggaccugcccguguggcugagcuacaagguggcguccgagggcuuccaguacagcgaccggcgcuggugcuucgacggcgagcggaacaaccagguccucgaggagaacauggacguggagaucuggaccaaggagggggagcgcaagaagcugcggccccgcuggcuggacgcccggacguacuccgacccccucgcccugcgcgaguucaaggaguucgccgccggccggcgcagcguguccggggaccugauccucgagaucggcaagcugccgcagcaccugacccagcgggcgcagaacgcccucgacaaccuggucaugcugcacaacagcgagcagggcgggcgcgccuaccggcacgccauggaggagcuccccgacaccaucgagacccugaugcugcucgcgcugaucgccgugcugacgggcggggugacccucuucuuccuguccggccgcgggcugggcaagaccagcaucggccuccugugcgucauggccuccagcgcccugcucuggauggccuccguggagccccacuggaucgcggccagcaucauccuggaguucuuccugauggugcuccugauccccgagccggaccggcagcgcacgccccaggacaaccagcuggccuacgucgugaucgggcuccuguucaugauccugaccguggccgccaacgagaugggccuccuggagacgaccaagaaggaccuggggaucggccacgucgcgguggagaaccaccaccacgccaccaugcucgacguggaccugcaccccgccuccgccuggacccuguacgccgucgcgacgaccaucaucaccccgaugaugcggcacaccaucgagaacacgaccgccaacaucagccucaccgccaucgccaaccaggccgcgauccugauggggcuggacaagggcuggcccaucuccaagauggacaucggcgugccccuccuggcccuggggugcuacagccaggugaacccccucacccugacggccgccguccugaugcucguggcgcacuacgccaucaucggcccggggcugcaggccaaggccacccgcgaggcccagaagcgcaccgcggccggcaucaugaagaaccccaccguggacgggaucgucgccaucgaccuggaccccgugguguacgacgccaaguucgagaagcagcucggccagaucaugcugcugauccucugcacgucccagauccugcugaugcggaccaccugggcccucugcgagagcaucacccuggcgacgggcccccugaccacccucugggagggguccccgggcaaguucuggaacaccacgaucgccgucagcauggccaacaucuuccgcgggagcuaccuggccggcgccggccuggcguucucccucaugaagucccucgggggcgggcggcgcgggaccggggcccagggcgagacccugggcgagaaguggaagcggcagcucaaccagcuguccaagagcgaguucaacaccuacaagcgcuccgggaucauggagguggaccggagcgaggccaaggagggccugcgccgcggggagacgaccaagcacgccgugucccgcggcaccgcgaagcuccggugguucgucgagcgcaaccuggugaagcccgaggggaaggugaucgaccugggcugcggccgcggcggguggagcuacuacugcgccgggcugaagaaggucaccgaggugaagggguacacgaagggcgggcccggccacgaggagcccaucccgauggccaccuacggguggaaccucgugaagcugcacuccggcaaggacgucuucuucaucccgcccgagaagugcgacacccugcucugcgacaucggggagagcucccccaacccgaccaucgaggagggccgcacgcugcgggugcugaagaugguggagcccuggcuccgcgggaaccaguucugcaucaagauccugaaccccuacaugcccagcgucguggagacccuggagcagaugcagcggaagcacggcggcaugcucgugcgcaacccgcugucccggaacagcacccacgagauguacugggucuccugcgggaccggcaacaucgugagcgccgugaacaugaccucccgcaugcugcucaaccgcuucacgauggcccaccggaagcccaccuacgagcgcgacgucgaccugggggcgggcacccggcacguggccguggagcccgaggucgccaaccuggacaucaucggccagcgcaucgagaacaucaagcacgagcacaagagcaccuggcacuacgacgaggacaaccccuacaagacgugggccuaccacggguccuacgaggugaagccgagcggcagcgccuccagcauggucaacgggguggugaagcuccugaccaagcccugggacgucauccccauggugacccagaucgcgaugaccgacacgacccccuucggccagcagcggguguucaaggagaaggucgacacccgcaccccgaaggccaagcgggggacggcccagaucauggaggugaccgcccgcuggcuguggggcuuccucucccggaacaagaagccccgcaucugcacccgggaggaguucacccgcaaggugcggagcaacgccgcgaucggcgccgucuucguggacgagaaccaguggaacuccgccaaggaggccguggaggacgagcgcuucugggaccugguccaccgggagcgcgagcugcacaagcaggggaagugcgcgacgugcguguacaacaugaugggcaagcgggagaagaagcucggggaguucggcaaggccaaggggagccgcgccaucugguacauguggcugggcgcccgguuccuggaguucgaggcccucggcuucaugaacgaggaccacugguucucccgcgagaacagccuguccgggguggagggcgaggggcugcacaagcucggcuacauccugcgggacaucagcaagauccccgggggcaacauguacgcggacgacaccgccggcugggacacccgcaucaccgaggacgaccugcagaacgaggccaagaucacggacaucauggagccggagcacgcccuccuggccaccuccaucuucaagcugaccuaccagaacaaggucgugcgcgugcagcggcccgcgcgcaacgggaccgucauggacgugaucagccggcgcgaccagcggggcuccggccaggugggcacguacggccucaacaccuucaccaacauggaggcccagcugauccgccagauggagagcgaggggaucuucucccccagcgagcuggagacccccaaccucgccgagcggguccuggacuggcuggagaagcacggcguggagcgccucaagcggauggccaucuccggggacgacugcguggucaagccgaucgacgaccgcuucgccacggcgcugagcgcccugaacgacaugggcaaggugcggaaggacaucccccagugggagcccagcaagggguggaacgacuggcagcagguccccuucugcucccaccacuuccaccagcucaucaugaaggacggccgcgagaucgucgugccgugccggaaccaggacgagcuggugggccgcgcccgggucagccagggggccggcuggucccugcgcgagaccgccugccucggcaagagcuacgcgcagauguggcagcugauguacuuccaccggcgcgaccugcggcucgccgccaacgccaucugcuccgcggugcccguggacuggguccccaccagccgcaccacgugguccauccacgcccaccaccaguggaugaccaccgaggacaugcugagcguguggaaccgcguguggaucgaggagaaccccuggauggaggacaagacccacaucuccagcuggggcgacgucccguaccuggggaagcgggaggaccaguggugcggcucccucaucggccugacggcccgcgccaccugggccaccaacauccagguggcgaucaaccaggugcggcgccugaucgggaacgagaacuaccucgacuacaugaccagcaugaagcgguucaagaacgaguccgaccccgagggcgcccugugguga

SEQ ID NO: 8449 - RNA, 9879 nt, Artificial Sequence
  derived and/or modified CDS sequence (opt1) from DENV-1__FJ882523__SS-prME
agcgugaccaugcugcucaugcugaugcccaccgcccuggccuuccaccucaccacccggggcggggagccccacaugaucgugaccaagcaggagcggggcaagagccugcuguucaagaccagcgcgggggugaacaugugcacccucaucgccauggaccugggcgagcugugcgaggacaccaugaccuacaagugcccccggaucaccgaggccgagcccgacgacguggacugcuggugcaacgccaccgacaccugggugaccuacgggaccugcagccagacgggcgagcaccggcgcgacaagcggagcguggcccucgcgccccacgugggccuggggcuggagacccgcaccgagaccuggauguccagcgagggcgccuggaagcagauccagcgggucgagacgugggcccuccgccaccccggguucaccgugaucgcccuguuccuggcgcacgccaucggcaccuccaucacccagaaggggaucaucuucauccuccugaugcuggugacgcccagcauggccaugcggugcgucggcaucggcucccgcgacuucguggaggggcucagcggcgccaccuggguggacgucgugcuggagcacggguccugcgugaccaccauggccaaggacaagcccacgcuggacaucgagcuccugaagaccgaggucaccaaccccgcggugcugcggaagcucugcaucgaggccaagaucagcaacaccacgaccgacucccgcugccccacccagggcgaggccacccugauggaggagcaggacgccaacuucgugugccggcgcacguucgucgaccggggcugggggaacggcugcgggcuguucggcaaggggagccucaucacgugcgccaaguucaagugcgugaccaagcuggagggcaagaucgugcaguacgagaaccugaaguacuccgucaucgugaccgugcacacgggcgaccagcaccaggucgggaacgagagcaccgagcacggcaccaccgcgaccaucacgccccaggcccccaccuccgagauccagcucaccgacuacggggcccugacccuggacugcagcccccgcacgggccucgacuucaacgagauggugcugcugaccaugaaggagaaguccuggcucguccacaagcagugguuccuggaccugccgcuccccuggaccagcggggccagcaccucccaggagacguggaaccggcaggaccugcuggugaccuucaagaccgcccacgcgaagaagcaggagguggucgugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgugaugugcaccggguccuucaagcucgagaaggaggucgcggagacgcagcacggcaccgugcuggugcagaucaaguacgagggcaccgacgcccccugcaagauccccuucagcacccaggacgagaagggggucacgcagaacggccggcugaucaccgccaacccgaucgugaccgacgaggagaagcccgugaacaucgaggccgagccgcccuucggggaguccuacaucgucaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcguggggaagcugguccaccagaucuucggcaccgccuacgggguccuguucuccggcgugagcuggaccaugaagaucgggaucggcguccugcugacguggcucggccugaacucccgcagcaccucccugagcaugaccugcaucgccguggggcucgugacccuguaccugggcgucauggugcaggccgacuccgggugcgugaucaacuggaagggccgggagcucaagugcgggagcggcaucuucgucacgaacgaggugcacaccuggaccgagcaguacaaguuccaggcggacagcccgaagcgccuguccgccgccaucggcaaggccugggaggagggggugugcggcauccggagcgccacccgccuggagaacaucauguggaagcagaucuccaacgagcucaaccacauccugcuggagaacgacaugaaguucaccgucguggugggggacgucgugggcauccucgcgcaggggaagaagaugauccggccccagcccauggagcacaaguacagcuggaaguccuggggcaaggccaagaucaucggcgccgacgugcagaacacgaccuucaucaucgacgggcccaacaccccggagugccccgacgaccagcgcgccuggaacaucugggaggucgaggacuacggcuucgggaucuucaccacgaacaucuggcugaagcugcgggacagcuacacccaggugugcgaccaccgccucauguccgcggccaucaaggacagcaaggccgugcacgccgacaugggcuacuggaucgaguccgagaagaacgagaccuggaagcuggcccgggcgagcuucaucgaggucaagaccugcaucuggcccaagucccacacgcuguggagcaacggcgugcucgaguccgagaugaucauccccaagaucuacgggggcccgaucagccagcacaacuaccgccccggguacuucacccagaccgccggccccuggcaccuggggaagcuggagcucgacuucgaccugugcgagggcaccacgguggucguggacgagcacugcggcaaccgggggccgucccugcgcaccaccaccgugacgggcaagaucauccacgaguggugcugccggagcugcacccugccgccccuccgcuucaagggggaggacggcugcugguacgggauggagauccggcccgucaaggagaaggaggagaaccuggugaaguccauggugagcgccggcagcggcgaggucgacuccuucagccucgggcugcugugcaucuccaucaugaucgaggaggugaugcgcagccgguggucccgcaagaugcucaugaccggcacccuggccguguuccugcuccugaucauggggcagcugacguggaacgaccucauccggcugugcaucauggucggcgccaacgcgagcgaccgcauggggaugggcaccaccuaccuggcccucauggccaccuucaagaugcgcccgauguucgccguggggcugcuguuccggcgccucacgucccgggaggugcugcugcucaccaucgggcugagccuggucgccuccguggagcuccccaacagccuggaggagcugggcgacgggcucgcgaugggcaucaugauccugaagcugcucaccgacuuccagucccaccagcugugggccacccugcucagccugacguucaucaagaccacccugucccuccacuacgccuggaagaccauggccaugguccugagcaucgugucccuguucccccucugccugagcacgaccucccagaagaccaccuggcugcccgugcuccugggcagccuggggugcaagccgcucacgauguuccugaucgcggagaacaagaucuggggccgcaaguccuggccccugaacgaggggaucauggccgucggcguggugagcauccuccugagcucccugcucaagaacgacgucccccuggccgggccccugaucgccggcggcaugcucaucgccugcuacgugaucagcggguccagcgcggaccugucccuggagaaggccgccgaggugagcugggaggaggaggccgagcacuccggcgccagccacaacauccucgucgaggugcaggacgacgggaccaugaagaucaaggacgaggagcgggacgacacccugaccauccugcucaaggcgacccugcuggccguguccggcgucuacccgcucagcauccccgccacgcuguucgugugguacuucuggcagaagaagaagcagcgcuccggggugcugugggacacccccagcccgcccgaggucgagcgggccgugcuggacgacggcaucuaccgcaucaugcagcggggccuccuggggcgcucccaggugggcgucgggguguuccaggagaacguguuccacaccauguggcacgucacccggggcgccgugcugauguaccaggggaagcgccucgagcccagcugggcguccgugaagaaggaccugaucagcuacggcggcggguggcggcugcagggcuccuggaacacgggggaggagguccaggugaucgccguggagcccggcaagaaccccaagaacguccagaccgcccccgggaccuucaagacccccgagggcgaggugggcgccaucgcccucgacuucaagcccgggacgagcggcucccccaucgugaaccgcgaggggaagaucgucggccuguacggcaacgggguggugaccaccagcggcaccuacgucagcgcgaucgcccaggccaaggccucccaggaggggccgcugcccgagaucgaggacgagguguuccggaagcgcaaccucacgaucauggaccugcaccccggcagcgggaagacccggcgcuaccugccggcgaucgugcgggaggccaucaagcgcaagcuccggacccugauccuggcccccacccgcgucguggccuccgagauggccgaggcgcucaagggcaugcccauccgcuaccagacgaccgccgucaagagcgagcacaccggcaaggagaucgucgaccugaugugccacgccaccuucacgaugcggcugcucucccccgugcgcgugccgaacuacaacaugaucaucauggacgaggcccacuucaccgaccccagcuccaucgccgcgcggggguacaucagcacccgcgucggcaugggggaggccgccgccaucuucaugaccgccacgccgcccggcuccguggaggcguucccgcagagcaacgccgugauccaggacgaggagcgggacauccccgagcgcuccuggaacagcggguacgaguggaucaccgacuuccccggcaagaccgucugguucgugcccuccaucaagagcggcaacgacaucgccaacugccugcggaagaacgggaagcgcgugauccagcugucccggaagaccuucgacacggaguaccagaagaccaagaacaacgacugggacuacgucgugaccaccgacaucagcgagaugggcgccaacuuccgcgcggaccgggugaucgacccgcgccggugccucaagcccgucauccugaaggacgggcccgagcgcgugauccuggccggccccaugccggucacgguggccuccgccgcccagcggcgcgggcggaucggccgcaaccacaacaaggagggcgaccaguacaucuacauggggcagccccucaacaacgacgaggaccacgcgcacuggaccgaggccaagaugcugcuggacaacaucaacacccccgagggcaucauccccgcccucuucgagccggagcgggagaaguccgccgccaucgacggggaguaccgccugcgcggcgaggcgcggaagaccuucguggagcugaugcgccgcggggaccuccccgucuggcuguccuacaagguggccagcgagggcuuccaguacagcgaccgccgguggugcuucgacggcgagcgcaacaaccaggugcuggaggagaacauggacgucgagaucuggacgaaggagggggagcggaagaagcuccgcccccgguggcuggacgcccgcaccuacuccgacccccuggcccuccgggaguucaaggaguucgccgcgggccgccggagcguguccggggaccugauccuggagaucggcaagcucccgcagcaccugacccagcgcgcccagaacgcccuggacaaccucgugaugcugcacaacagcgagcagggcgggcgggccuaccgccacgcgauggaggagcugcccgacaccaucgagacgcucaugcugcuggcccucaucgccguccugaccggcggggugacccuguucuuccucuccggccgggggcugggcaagaccagcaucggccugcucugcgugauggccuccagcguccugcuguggauggccuccguggagccccacuggaucgcggccagcaucauccucgaguucuuccugauggugcugcucauccccgagccggaccgccagcggacgccccaggacaaccagcuggccuacgucgugaucgggcuccucuucaugauccugacgguggccgccaacgagaugggccugcucgagaccaccaagaaggaccuggggaucggccacgucgcgguggagaaccaccaccacgccaccaugcuggacguggaccuccaccccgccuccgccuggacgcuguacgccgucgcgaccaccaucaucaccccgaugaugcgccacacgaucgagaacaccaccgccaacaucagccugaccgccaucgccaaccaggccgcgauccucauggggcuggacaagggcuggcccaucuccaagauggacaucggcgugccccugcucgcccuggggugcuacagccaggugaacccccugacgcucaccgccgccguccugaugcugguggcgcacuacgccaucaucggcccggggcuccaggccaaggccacccgggaggcccagaagcgcaccgcggccggcaucaugaagaaccccacgguggacgggaucgucgccaucgaccuggaccccgugguguacgacgccaaguucgagaagcagcugggccagaucaugcuccugauccugugcaccucccagauccuccugaugcgcaccaccugggcccugugcgagagcaucacgcucgcgaccggcccccugaccacccugugggagggguccccgggcaaguucuggaacacgaccaucgccgucagcauggccaacaucuuccggggguccuaccucgccggcgccggccuggcguucagccugaugaagucccucgggggcgggcgccggggcaccggggcccagggcgagacccugggcgagaaguggaagcgccagcugaaccagcucuccaagagcgaguucaacaucuacaagcgguccgggaucauggagguggaccgcagcgaggccaaggagggccugaagcgcggggagacgacccgccacgccgugucccggggcaccgcgaagcugcgcugguucgucgagcggaaccuggugaagcccgaggggaaggugaucgaccucggcugcggccgcgggggcuggagcuacuacugcgccgggcugaagaaggucaccgaggugaagggcuacacgaagggcgggcccggccacgaggagcccaucccgauggccaccuacggguggaaccuggugaagcuccacuccggcaaggacgucuucuucacgccgcccgagaagugcgacacccugcugugcgacaucggggagagcucccccaacccgacgaucgaggagggccggacccuccgcgugcugaagaugguggagcccuggcugcgggggaaccaguucugcaucaagauccucaaccccuacaugcccagcgucguggagacccuggagcagaugcagcgcaagcacggcggcaugcuggugcggaacccgcucucccgcaacagcacccacgagauguacugggucuccugcgggaccggcaacaucgugagcgccgugaacaugacgucccggaugcugcugaaccgcuucaccauggcccaccgcaagcccaccuacgagcgggacgucgaccucggggcgggcacccgccacguggccguggagcccgaggucgccaaccuggacaucaucggccagcggaucgagaacaucaagcacgagcacaagagcacguggcacuacgacgaggacaaccccuacaagaccugggccuaccacggguccuacgaggugaagccgagcggcuccgccagcagcauggucaacgggguggugaagcugcucaccaagcccugggacgucauccccauggugacccagaucgcgaugacggacaccacccccuucggccagcagcgcguguucaaggagaaggucgacacccggacgccgaaggccaagcgcgggaccgcccagaucauggaggugaccgcccgguggcuguggggcuuccugucccgcaacaagaagccccggaucugcacccgcgaggaguucacgcggaaggugcgcagcaacgccgcgaucggcgccgucuucguggacgagaaccaguggaacuccgccaaggaggccguggaggacgagcgguucugggaccucguccagaaggagcgcgagcugcacaagcaggggaagugcgcgaccugcguguacaacaugaugggcaagcgggagaagaagcugggggaguucggcaaggccaaggggagccgcgccaucugguacauguggcucggcgcccgguuccuggaguucgaggcccugggcuucaugaacgaggaccacugguucucccgcgagaacagccucuccgggguggagggcgaggggcugcacaagcugggcuacauccuccgggacaucagcaagauccccgggggcaacauguacgcggacgacaccgccggcugggacacccgcaucacggaggacgaccugcagaacgaggccaagaucaccgacaucauggagccggagcacgcccugcucgccaccuccaucuucaagcugaccuaccagaacaaggucgugcgggugcagcgccccgcgaagaacgggacggucauggacgugaucagccgccgggaccagcgcggcuccggccaggugggcaccuacggccugaacaccuucaccaacauggaggcccagcucauccggcagauggagagcgaggggaucuucucccccagcgagcuggagauccccaaccuggccgagcgcguccucgacuggcuggagaaguacggcguggagcggcugaagcgcauggccaucuccggggacgacugcguggucaagccgaucgacgaccgguucgccacggcgcucaccgcccugaacgacaugggcaaggugcgcaaggacgugccccagugggagcccagcaagggguggaacgacuggcagcagguccccuucugcucccaccacuuccaccagcugaucaugaaggacggccgggagaucguggugccgugccgcaaccaggacgagcucgucggccgggcccgcgugagccagggggccggcuggagccugcgggagaccgccugccuggggaaguccuacgcgcagauguggcagcucauguacuuccaccgccgggaccugcgccuggccgccaacgccaucugcagcgcggugcccgucgacugggugcccaccucccggacgaccuggagcauccacgcccaccaccaguggaugaccaccgaggacaugcucuccguguggaaccgcgucuggaucgaggagaaccccuggauggaggacaagacgcacgugagcuccuggggcgacgugccguaccuggggaagcgggaggaccaguggugcggcagccugaucggccucaccgcccgcgccaccugggccuccaacauccaggucgcgaucaaccaggugcgccggcugaucgggaacgagaacuaccuggacuacaugaccagcaugaagcgcuucaagaacgagggcgaccccgagggggcccucugguga

SEQ ID NO: 8450 - RNA, 9879 nt, Artificial Sequence
  derived and/or modified CDS sequence (opt1) from DENV-1__FJ882524__SS-prME
agcgugaccaugcugcucaugcugaugcccaccgcccuggccuuccaccucaccacccggggcggggagccccacaugaucgugaccaagcaggagcggggcaagagccugcuguucaagaccagcgcgggggugaacaugugcacccucaucgccauggaccugggcgagcugugcgaggacaccaugaccuacaagugcccccggaucaccgaggccgagcccgacgacguggacugcuggugcaacgccacggacaccugggugaccuacgggaccugcagccagacgggcgagcaccggcgcgacaagcggagcguggcccucgcgccccacgugggccuggggcuggagacccgcaccgagaccuggauguccagcgagggcgccuggaagcagauccagcgggucgagacgugggcccuccgccaccccggguucaccgugaucgcccuguuccuggcgcacgccaucggcaccuccaucacccagaaggggaucaucuucauccuccugaugcuggugacgcccagcauggccaugcggugcgucggcaucggcucccgcgacuucguggaggggcucagcggcgccaccuggguggacgucgugcuggagcacggguccugcgugaccaccauggccaaggacaagcccacgcuggacaucgagcuccugaagaccgaggucaccaaccccgcggugcugcggaagcucugcaucgaggccaagaucagcaacaccacgaccgacucccgcugccccacccagggcgaggccacccugauggaggagcaggacgccaacuacgugugccggcgcacguucgucgaccggggcugggggaacggcugcgggcuguucggcaaggggagccucaucacgugcgccaaguucaagugcgugaccaagcuggagggcaagaucgugcaguacgagaaccugaaguacuccgucaucgugaccgugcacacgggcgaccagcaccaggucgggaacgagagcaccgagcacggcaccaccgcgaccaucacgccccaggcccccaccuccgagauccagcucaccgacuacggggcccugacccuggacugcagcccccgcacgggccucgacuucaacgagauggugcugcugaccaugaaggagaaguccuggcucguccacaagcagugguuccuggaccugccgcuccccuggaccagcggggccagcaccucccaggagacguggaaccggcaggaccugcuggugaccuucaagaccgcccacgcgaagaagcaggagguggucgugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgugaugugcaccggguccuucaagcucgagaaggaggucgcggagacgcagcacggcaccgugcuggugcagaucaaguacgagggcaccgacgcccccugcaagauccccuucagcacccaggacgagaagggggucacgcagaacggccggcugaucaccgccaacccgaucgugaccgacaaggagaagcccgugaacaucgaggccgagccgcccuucggggaguccuacaucgucaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcguggggaagcugguccaccagaucuucggcaccgccuacgggguccuguucuccggcgugagcuggaccaugaagaucgggaucggcguccugcugacguggcucggccugaacucccgcagcaccucccugagcaugaccugcaucgccguggggcucgugacccuguaccugggcgucauggugcaggccgacuccgggugcgugaucaacuggaagggccgggagcucaagugcgggagcggcaucuucgucacgaacgaggugcacaccuggaccgagcaguacaaguuccaggcggacagcccgaagcgccuguccgccgccaucggcaaggccugggaggagggggugugcggcauccggagcgccacccgccuggagaacaucauguggaagcagaucuccaacgagcucaaccacauccugcuggagaacgacaugaaguucaccgucguggugggggacgucgugggcauccucgcgcaggggaagaagaugauccggccccagcccauggagcacaaguacagcuggaaguccuggggcaaggccaagaucaucggcgccgacgugcagaacacgaccuucaucaucgacgggcccaacaccccggagugccccgacgaccagcgcgccuggaacaucugggaggucgaggacuacggcuucgggaucuucaccacgaacaucuggcugaagcugcgggacagcuacacccaggugugcgaccaccgccucauguccgcggccaucaaggacagcaaggccgugcacgccgacaugggcuacuggaucgaguccgagaagaacgagaccuggaagcuggcccgggcgagcuucaucgaggucaagaccugcaucuggcccaagucccacacgcuguggagcaacggcgugcucgaguccgagaugaucauccccaagaucuacgggggcccgaucagccagcacaacuaccgccccggguacuucacccagaccgccggccccuggcaccuggggaagcuggagcucgacuucgaccugugcgagggcaccacgguggucguggacgagcacugcggcaaccgggggccgucccugcgcaccaccaccgugacgggcaagaucauccacgaguggugcugccggagcugcacccugccgccccuccgcuucaagggggaggacggcugcugguacgggauggagauccggcccgucaaggagaaggaggagaaccuggugaaguccauggugagcgccggcagcggcgaggucgacuccuucagccucgggcugcugugcaucuccaucaugaucgaggaggugaugcgcagccgguggucccgcaagaugcucaugaccggcacccuggccguguuccugcuccugaucauggggcagcugacguggaacgaccucauccggcugugcaucauggucggcgccaacgcgagcgaccgcauggggaugggcaccaccuaccuggcccucauggccaccuucaagaugcgcccgauguucgccguggggcugcuguuccggcgccucacgucccgggaggugcugcugcucaccaucgggcugagccuggucgccuccguggagcuccccaacagccuggaggagcugggcgacgggcucgcgaugggcaucaugauccugaagcugcucaccgacuuccagucccaccagcugugggccacccugcucagccugacguucaucaagaccacccugucccuccacuacgccuggaagaccauggccaugguccugagcaucgugucccuguucccccucugccugagcacgaccucccagaagaccaccuggcugcccgugcuccugggcagccuggggugcaagccgcucacgauguuccugaucgcggagaacaagaucuggggccgcaaguccuggccccugaacgaggggaucauggccgucggcguggugagcauccuccugagcucccugcucaagaacgacgucccccuggccgggccccugaucgccggcggcaugcucaucgccugcuacgugaucagcggguccagcgcggaccugucccuggagaaggccgccgaggugagcugggaggaggaggccgagcacuccggcgccagccacaacauccucgucgaggugcaggacgacgggaccaugaagaucaaggacgaggagcgggacgacacccugaccauccugcucaaggcgacccugcuggccguguccggcgucuacccgcucagcauccccgccacgcuguucgugugguacuucuggcagaagaagaagcagcgcuccggggugcugugggacacccccagcccgcccgaggucgagcgggccgugcuggacgacggcaucuaccgcaucaugcagcggggccuccuggggcgcucccaggugggcgucgggguguuccaggagaacguguuccacaccauguggcacgucacccggggcgccgugcugauguaccaggggaagcgccucgagcccagcugggcguccgugaagaaggaccugaucagcuacggcggcggguggcggcugcagggcuccuggaacacgggggaggagguccaggugaucgccguggagcccggcaagaaccccaagaacguccagaccgcccccgggaccuucaagacccccgagggcgaggugggcgccaucgcccucgacuucaagcccgggacgagcggcucccccaucgugaaccgcgaggggaagaucgucggccuguacggcaacgggguggugaccaccagcggcaccuacgucagcgcgaucgcccaggccaaggccucccaggaggggccgcugcccgagaucgaggacgagguguuccggaagcgcaaccucacgaucauggaccugcaccccggcagcgggaagacccggcgcuaccugccggcgaucgugcgggaggccaucaagcgcaagcuccggacccugauccuggcccccacccgcgucguggccuccgagauggccgaggcgcucaagggcaugcccauccgcuaccagacgaccgccgucaagagcgagcacaccggcaaggagaucgucgaccugaugugccacgccaccuucacgaugcggcugcucucccccgugcgcgugccgaacuacaacaugaucaucauggacgaggcccacuucaccgaccccagcuccaucgccgcgcggggguacaucagcacccgcgucggcaugggggaggccgccgccaucuucaugaccgccacgccgcccggcuccguggaggcguucccgcagagcaacgccgugauccaggacgaggagcgggacauccccgagcgcuccuggaacagcggguacgaguggaucaccgacuuccccggcaagaccgucugguucgugcccuccaucaagagcggcaacgacaucgccaacugccugcggaagaacgggaagcgcgugauccagcugucccggaagaccuucgacacggaguaccagaagaccaagaacaacgacugggacuacgucgugaccaccgacaucagcgagaugggcgccaacuuccgcgcggaccgggugaucgacccgcgccggugccucaagcccgucauccugaaggacgggcccgagcgcgugauccuggccggccccaugccggucacgguggccuccgccgcccagcggcgcgggcggaucggccgcaaccacaacaaggagggcgaccaguacaucuacauggggcagccccucaacaacgacgaggaccacgcgcacuggaccgaggccaagaugcugcuggacaacaucaacacccccgagggcaucauccccgcccucuucgagccggagcgggagaaguccgccgccaucgacggggaguaccgccugcgcggcgaggcgcggaagaccuucguggagcugaugcgccgcggggaccuccccgucuggcuguccuacaagguggccagcgagggcuuccaguacagcgaccgccgguggugcuucgacggcgagcgcaacaaccaggugcuggaggagaacauggacgucgagaucuggacgaaggagggggagcggaagaagcuccgcccccgguggcuggacgcccgcaccuacuccgacccccuggcccuccgggaguucaaggaguucgccgcgggccgccggagcguguccggggaccugauccuggagaucggcaagcucccgcagcaccugacccagcgcgcccagaacgcccuggacaaccucgugaugcugcacaacagcgagcagggcgggcgggccuaccgccacgcgauggaggagcugcccgacaccaucgagacgcucaugcugcuggcccucaucgccguccugaccggcggggugacccuguucuuccucuccggccgggggcugggcaagaccagcaucggccugcucugcgugaccgccuccagcguccugcuguggauggccuccguggagccccacuggaucgcggccagcaucauccucgaguucuuccugauggugcugcucauccccgagccggaccgccagcggacgccccaggacaaccagcuggccuacgucgugaucgggcuccucuucaugauccugaccguggccgccaacgagaugggccugcucgagaccaccaagaaggaccuggggaucggccacgucgcgguggagaaccaccaccacgccacgaugcuggacguggaccuccaccccgccuccgccuggacccuguacgccgucgcgaccaccaucaucacgccgaugaugcgccacaccaucgagaacaccaccgccaacaucagccugacggccaucgccaaccaggccgcgauccucauggggcuggacaagggcuggcccaucuccaagauggacaucggcgugccccugcucgcccuggggugcuacagccaggugaacccccugacccucaccgccgccguccugaugcugguggcgcacuacgccaucaucggcccggggcuccaggccaaggccacccgggaggcccagaagcgcacggcggccggcaucaugaagaaccccaccguggacgggaucgucgccaucgaccuggaccccgugguguacgacgccaaguucgagaagcagcugggccagaucaugcuccugauccugugcaccucccagauccuccugaugcgcaccacgugggcccugugcgagagcaucacccucgcgaccggcccccugaccacgcugugggagggguccccgggcaaguucuggaacaccaccaucgccgucagcauggccaacaucuuccggggguccuaccucgccggcgccggccuggcguucagccugaugaagucccucgggggcgggcgccggggcaccggggcccagggcgagacgcugggcgagaaguggaagcgccagcugaaccagcucuccaagagcgaguucaacaucuacaagcgguccgggaucauggagguggaccgcagcgaggccaaggagggccugaagcgcggggagaccacccgccacgccgugucccggggcaccgcgaagcugcgcugguucgucgagcggaaccuggugaagcccgaggggaaggugaucgaccucggcugcggccgcgggggcuggagcuacuacugcgccgggcugaagaaggucacggaggugaagggcuacaccaagggcgggcccggccacgaggagcccaucccgauggccaccuacggguggaaccuggugaagcuccacuccggcaaggacgucuucuucacgccgcccgagaagugcgacacgcugcugugcgacaucggggagagcucccccaacccgaccaucgaggagggccggacccuccgcgugcugaagaugguggagcccuggcugcgggggaaccaguucugcaucaagauccucaaccccuacaugcccagcgucguggagacccuggagcagaugcagcgcaagcacggcggcaugcuggugcggaacccgcucucccgcaacagcacccacgagauguacugggucuccugcgggacgggcaacaucgugagcgccgugaacaugaccucccggaugcugcugaaccgcuucaccauggcccaccgcaagcccaccuacgagcgggacgucgaccucggggcgggcacgcgccacguggccguggagcccgaggucgccaaccuggacaucaucggccagcggaucgagaacaucaagcacgagcacaagagcaccuggcacuacgacgaggacaaccccuacaagaccugggccuaccacggguccuacgaggugaagccgagcggcuccgccagcagcauggucaacgggguggugaagcugcucaccaagcccugggacgucauccccauggugacgcagaucgcgaugaccgacaccacccccuucggccagcagcgcguguucaaggagaaggucgacacgcggaccccgaaggccaagcgcgggaccgcccagaucauggaggugaccgcccgguggcuguggggcuuccugucccgcaacaagaagccccggaucugcacgcgcgaggaguucacccggaaggugcgcagcaacgccgcgaucggcgccgucuucguggacgagaaccaguggaacuccgccaaggaggccguggaggacgagcgguucugggaccucguccagaaggagcgcgagcugcacaagcaggggaagugcgcgaccugcguguacaacaugaugggcaagcgggagaagaagcugggggaguucggcaaggccaaggggagccgcgccaucugguacauguggcucggcgcccgguuccuggaguucgaggcccugggcuucaugaacgaggaccacugguucucccgcgagaacagccucuccgggguggagggcgaggggcugcacaagcugggcuacauccuccgggacaucagcaagauccccgggggcaacauguacgcggacgacaccgccggcugggacacgcgcaucaccgaggacgaccugcagaacgaggccaagaucaccgacaucauggagccggagcacgcccugcucgccaccuccaucuucaagcugacguaccagaacaaggucgugcgggugcagcgccccgcgaagaacgggaccgucauggacgugaucagccgccgggaccagcgcggcuccggccaggugggcaccuacggccugaacaccuucacgaacauggaggcccagcucauccggcagauggagagcgaggggaucuucucccccagcgagcuggagauccccaaccuggccgagcgcguccucgacuggcuggagaaguacggcguggagcggcugaagcgcauggccaucuccggggacgacugcguggucaagccgaucgacgaccgguucgccaccgcgcucaccgcccugaacgacaugggcaaggugcgcaaggacgugccccagugggagcccagcaagggguggaacgacuggcagcagguccccuucugcucccaccacuuccaccagcugaucaugaaggacggccgggagaucguggugccgugccgcaaccaggacgagcucgucggccgggcccgcgugagccagggggccggcuggagccugcgggagaccgccugccuggggaaguccuacgcgcagauguggcagcucauguacuuccaccgccgggaccugcgccuggccgccaacgccaucugcagcgcggugcccgucgacugggugcccacgucccggaccaccuggagcauccacgcccaccaccaguggaugaccacggaggacaugcucuccguguggaaccgcgucuggaucgaggagaaccccuggauggaggacaagacccacgugagcuccuggggcgacgugccguaccuggggaagcgggaggaccaguggugcggcagccugaucggccucaccgcccgcgccaccugggccuccaacauccaggucgcgaucaaccaggugcgccggcugaucgggaacgagaacuaccuggacuacaugaccagcaugaagcgcuucaagaacgagggcgaccccgagggggcccucugguga

SEQ ID NO: 8451 - RNA, 9879 nt, Artificial Sequence
  derived and/or modified CDS sequence (opt1) from DENV-1__FJ882525__SS-prME
agcgugaccaugcugcucaugcugaugcccaccgcccuggccuuccaccucacgacccggggcggggagccccacaugaucgugagcaagcaggagcggggcaagagccugcuguucaagaccagcgcgggggugaacaugugcacccucguggccauggaccugggcgaguucugcgaggacacgaugaccuacaagugcccccggaucaccgaggccgagcccgacgacguggacugcuggugcaacgccaccgacacgugggugaccuacgggaccugcagccagaccggcgagcaccggcgcgacaagcgguccguggcccuggcgccccacgugggccucgggcuggagacgcggaccgagaccuggaugagcuccgagggcgccuggaagcagauccagcggguggagaccugggcccugcgccaccccggguucacggugaucgcccucuuccuggcgcacgccaucggcaccagcaucacccagaaggggaucaucuucauccugcucaugcuggucacccccuccauggccaugcggugcgugggcaucggcagccgcgacuucguggaggggcuguccggcgccacgugggucgacguggugcucgagcacgggagcugcgucaccaccauggccaaggacaagcccacccuggacaucgagcugcucaagacggaggugaccaaccccgcggugcugcggaagcugugcaucgaggccaagaucuccaacaccaccacggacagccgcugcccgacccagggcgaggccacccucgucgaggagcaggacgccaacuucgugugccggcgcaccuucguggaccggggcugggggaacggcugcgggcuguucggcaaggggucccugaucacgugcgccaaguucaagugcgucaccaagcucgagggcaagaccgugcaguacgagaaccugaaguacagcgugaucgucaccgugcacacgggcgaccagcaccaggucgggaacgaguccaccgagcacggcaccaccgcgaccaucacgccccaggcccccagcaccgagauccagcugaccgacuacggggcccucacccuggacugcagcccccggacgggccuggacuucaacgagauggugcuccugaccaugaaggagaaguccuggcuggugcacaagcagugguuccucgaccugccgcugcccuggaccagcggggccuccaccagccaggagacguggaaccggaaggaccuccuggucaccuucaagaccgcccacgcgaagaagcaggagguggugguccugggcucccaggagggcgccaugcacaccgcccucacgggggccaccgagauccagaccagcggcaccacgaccaucuucgccgggcaccugaagugccgccugaagauggacaagcucacccugaagggcauguccuacgugaugugcaccgggagcuucaagcuggagaaggagguggcggagacgcagcacggcaccguccucgugcagauccgguacgagggcaccgacgcccccugcaagauccccuucuccacccaggacgagaagggggugacgcagaacggccgccugaucaccgccaacccgaucgucaccgacaaggagaagcccgugaacaucgaggccgagccgcccuucggggagagcuacaucgugaucggcgcgggcgagaaggcccugaagcuguccugguucaagaaggggagcuccaucggcaagauguucgaggccaccgcccgcggggcccgccgcauggcgauccucggcgacacggccugggacuucgggagcaucggcggcgucuucaccuccguggggaagcuggugcaccagaucuucggcaccgccuacgggguccuguucagcggcguguccuggaccaugaagaucgggaucggcgugcuccugacguggcugggccucaacagccgguccaccagccuguccaugaccugcaucgccgucgggcuggugacccucuaccugggcgugaugguccaggccgacagcgggugcgugaucaacuggaagggccgcgagcugaagugcgggagcggcaucuucgugacgaacgagguccacaccuggaccgagcaguacaaguuccaggcggacuccccgaagcggcucagcgccgccaucggcaaggccugggaggagggggugugcggcauccgcuccgccacccggcuggagaacaucauguggaagcagaucagcaacgagcugaaccacauccuccuggagaacgacaugaaguucaccguggucgugggggacguggcgggcauccuggcccaggggaagaagaugauccgcccccagcccauggaguacaaguacuccuggaaguccuggggcaaggccaagaucaucggcgccgacguccagaacacgaccuucaucaucgacgggcccaacaccccggagugccccgacgaccagcgggcguggaacaucugggagguggaggacuacggcuucgggaucuucaccacgaacaucuggcucaagcugcgcgacuccuacacccaggugugcgaccaccggcugaugagcgccgccaucaaggacuccaaggccguccacgccgacaugggcuacuggaucgagagcgagaagaacgagaccuggaagcucgcgcgcgccuccuucaucgaggugaagaccugcaucuggcccaagagccacacgcugugguccaacggcgugcuggagagcgagaugaucauccccaagaucuacgggggcccgaucucccagcacaacuaccggcccggguacuucacccagaccgccggccccuggcaccucgggaagcuggagcuggacuucgaccucugcgagggcaccacggucgugguggacgagcacugcggcaaccgcgggccgagccugcggaccaccaccgucacgggcaagaucauccacgaguggugcugccgcuccugcacccugccgccccugcgguucaagggggaggacggcugcugguacgggauggagauccgccccgugaaggagaaggaggagaaccuggucaagagcauggucagcgccggcuccggcgagguggacagcuucucccuggggcuccugugcaucagcaucaugaucgaggaggugaugcggucccgcuggagccggaagaugcugaugaccggcacccucgccgucuucuuccugcugaucaucgggcagcucacguggaacgaccugauccgccugugcaucauggugggcgcgaacgccuccgaccgcauggggaugggcaccaccuaccucgcccugauggccaccuucaagaugcggccgauguucgccguggggcuccuguuccgccggcugacgagccgcgagguccugcuccugaccaucgggcugucccucguggcgagcgucgagcugcccaacucccuggaggagcucggcgacgggcuggccaugggcaucaugauccugaagcuccugaccgacuuccagagccaccagcugugggccacccuccugucccugacguucaucaagaccaccuucagccuccacuacgccuggaagaccauggcgauggugcuguccaucgugagccuguucccccucugccuguccacgaccagccagaagaccaccuggcugcccguccuccugggcucccuggggugcaagccgcucacgauguuccugaucgccgagaacaagaucuggggccggcgcagcuggccccugaacgaggggaucauggccgugggcaucgugagcauccuccuguccagccugcucaagaacgacgucccccuggccgggccccugaucgccggcggcaugcucaucgcgugcuacgugaucuccgggagcuccgccgaccugagccuggagaaggccgccgagguguccugggaggaggaggccgagcacagcggcgcgucccacaacauccucgucgaggugcaggacgacgggaccaugaagaucaaggacgaggagcgggacgacacccugaccauccugcucaaggccacccugcuggccgugagcggcgucuacccgcucuccauccccgccacgcuguucgugugguacuucuggcagaagaagaagcagcgcagcggggugcugugggacacccccagcccgcccgaggucgagcgggccgugcucgacgacggcaucuaccgcaucaugcagcggggccugcuggggcgcagccaggugggcgucgggguguuccaggagaacguguuccacaccauguggcacgucacccggggcgcggugcugauguaccaggggaagcgccucgagcccuccugggccagcgugaagaaggaccugaucuccuacggcggcggguggcggcugcagggcagcuggaacacgggggaggagguccaggugaucgccguggagcccggcaagaaccccaagaacguccagaccgcccccgggaccuucaagaccuccgagggcgaggugggcgccaucgcgcucgacuucaagcccgggacgagcggcagccccaucgugaaccgcgaggggaagaucgucggccuguacggcaacgggguggugaccaccuccggcaccuacgucagcgccaucgcccaggccaaggcgucccaggaggggccccugccggagaucgaggacgagguguuccggaagcgcaaccucacgaucauggaccugcaccccggcagcgggaagacccggcgcuaccugcccgccaucgugcgggaggccaucaagcgcaagcuccgcacccugauccuggccccgacccgggucguggccuccgagauggcggaggcccucaagggcaugcccauccgcuaccagacgaccgccgucaagagcgagcacaccggcaaggagaucgucgaccugaugugccacgccaccuucacgaugcggcugcucucccccgugcgcgugcccaacuacaacaugaucaucauggacgaggcccacuucaccgacccgagcuccaucgcggcccggggguacaucagcacccgcgucggcaugggggaggccgccgccaucuucaugaccgcgacgccgcccggcuccguggaggccuucccccagagcaacgccgugauccaggacgaggagcgggacaucccggagcgcuccuggaacagcggguacgaguggaucaccgacuuccccggcaagaccgucugguucgugcccuccaucaagagcggcaacgacaucgccaacugccugcggaagaacgggaagcgcgugauccagcugucccggaagaccuucgacacggaguaccagaagaccaagaacaacgacugggacuacgucgugaccaccgacaucagcgagaugggcgcgaacuuccgcgccgaccgggugaucgacccccgccggugccucaagccggucauccugaaggacgggcccgagcgcgugauccuggccggccccaugcccgucacgguggccuccgccgcgcagcggcgcgggcggaucggccgcaaccacaacaaggagggcgaccaguacaucuacauggggcagccgcucaacaacgacgaggaccacgcccacuggaccgaggccaagaugcugcuggacaacaucaacacccccgagggcaucauccccgcccucuucgagcccgagcgcgagaaguccgccgcgaucgacggggaguaccggcugcgcggcgaggcccggaagaccuucguggagcugaugcgccgcggggaccucccggucuggcugagcuacaagguggccuccgagggcuuccaguacagcgaccgccgguggugcuucgacggcgagcgcaacaaccaggugcuggaggagaacauggacgucgagaucuggacgaaggagggggagcggaagaagcuccgcccccgguggcuggacgcccgcaccuacuccgacccccuggcccuccgggaguucaaggaguucgcggccggccgccggagcguguccggggaccugauccuggagaucggcaagcucccccagcaccugacccagcgcgcccagaacgcccuggacaaccucgugaugcugcacaacagcgagcagggcgggcgggcguaccgccacgccauggaggagcugccggacaccaucgagacgcucaugcugcuggcccucaucgccguccugaccggcggggugacccuguucuuccucuccggccgggggcugggcaagaccagcaucggccugcucugcgugauggccuccagcguccugcuguggauggcguccguggagccccacuggaucgccgccagcaucauccucgaguucuuccugauggugcugcucauccccgagcccgaccgccagcggaccccgcaggacaaccagcuggccuacgucgugaucgggcuccucuucaugauccugacgguggccgcgaacgagaugggccugcucgagaccaccaagaaggaccuggggaucggccacgucgccguggagaaccaccaccacgccgccaugcuggacguggaccuccaccccgccuccgcguggacccuguacgccgucgccacgaccaucaucacccccaugaugcgccacaccaucgagaacacgaccgccaacaucagccugaccgccaucgcgaaccaggccgccauccucauggggcuggacaagggcuggccgaucuccaagauggacaucggcgugccccugcucgcccuggggugcuacagccaggugaacccccugacccucacggcggccguccugaugcugguggcccacuacgccaucaucggccccgggcuccaggccaaggcgacccgcgaggcccagaagcggaccgccgccggcaucaugaagaacccgaccguggacgggaucgucgccaucgaccuggaccccgugguguacgacgcgaaguucgagaagcagcugggccagaucaugcuccugauccugugcacgucccagauccuccugaugcgcaccaccugggcccugugcgagagcaucacccucgccacgggcccccugaccacccugugggaggggucccccggcaaguucuggaacaccacgaucgccgucagcauggccaacaucuuccgggggagcuaccucgcgggcgccggccuggccuucucccugaugaagucccucgggggcgggcgccggggcaccggggcccagggcgagacccugggcgagaaguggaagcgccagcugaaccagcucuccaagagcgaguucaacaccuacaagcgguccgggaucauggagguggaccgcagcgaggcgaaggagggccugaagcgcggggagacgaccaagcacgccgugucccgcggcaccgccaagcugcggugguucgucgagcgcaacuucgugaagccggaggggaaggugaucgaccucggcugcggccgcggcggguggagcuacuacugcgccgggcugaagaaggucaccgaggugaagggguacacgaagggcgggcccggccacgaggagcccauccccauggccaccuacggguggaaccuggugaagcugcacuccggcaaggacgucuucuucaucccgcccgagaagugcgacacccuccugugcgacaucggggagagcucccccaaccccaccaucgaggagggccgcacgcugcgggugcucaagaugguggagccguggcugcgcgggaaccaguucugcaucaagauccugaaccccuacaugcccagcgucguggagacccucgagcggaugcagcgcaagcacggcggcaugcuggugcggaacccccugucccgcaacagcacccacgagauguacugggucuccugcgggaccggcaacaucgugagcgcggugaacaugaccucccgcaugcuccugaaccgguucacgauggcccaccgcaagccgaccuacgagcgggacgucgaccugggggccggcacccgccacguggccguggagcccgaggucgccaaccucgacaucaucggccagcggaucgagaacaucaagcacgagcacaagagcaccuggcacuacgacgaggacaaccccuacaagacgugggcguaccacggguccuacgaggugaagcccagcggcagcgccuccagcauggucaacgggguggugaagcugcugaccaagccgugggacgucauccccauggugacccagaucgccaugaccgacacgacccccuucggccagcagcgcguguucaaggagaaggucgacacccggacccccaaggccaagcgcgggacggcccagaucauggaggugaccgcgaaguggcucuggggcuuccugucccggaacaagaagccgcgcaucugcacccgggaggaguucacccgcaaggugcggagcaacgccgccaucggcgccgucuucguggacgagaaccaguggaacuccgcgaaggaggccguggaggacgagcgcuucugggaccugguccaccgggagcgcgagcuccacaagcaggggaagugcgccacgugcguguacaacaugaugggcaagcgggagaagaagcugggggaguucggcaaggccaaggggagccgcgccaucugguacauguggcugggcgcgcgguuccucgaguucgaggcccugggcuucaugaacgaggaccacugguucucccgcgagaacagccuguccgggguggagggcgaggggcuccacaagcugggcuacauccugcgggacaucagcaagauccccgggggcaacauguacgccgacgacaccgccggcugggacacccgcaucaccgaggacgaccuccagaacgaggccaagaucacggacaucauggagcccgagcacgcgcugcuggccaaguccaucuucaagcucaccuaccagaacaaggucgugcgcgugcagcggccggccaagaacgggaccgucauggacgugaucagccgccgggaccagcgcggcuccggccaggugggcaccuacggccugaacacguucaccaacauggaggcccagcugauccggcagauggagagcgaggggaucuucucccccagcgagcucgagacccccaaccuggccggccgcguccuggacuggcucgagaagcacgggguggagcggcugaagcgcauggcgaucuccggcgacgacugcguggucaagcccaucgacgaccgguucgccaccgcccugacggcccucaacgacauggggaaggugcgcaaggacaucccgcagugggagcccagcaagggcuggaacgacuggcagcagguccccuucugcagccaccacuuccaccagcugaucaugaaggacggccgggagaucgucgugcccugccgcaaccaggacgagcugguggggcgggcccgcgucucccagggcgcgggguggagccuccgggagaccgccugccugggcaaguccuacgcccagauguggcagcugauguacuuccaccgccgggaccuccgccuggccgcgaacgccaucugcagcgccgugccgguggacuggguccccaccucccggaccacguggagcauccacgcccaccaccaguggaugaccaccgaggacaugcuguccguguggaaccgcguguggaucgaggagaaccccuggauggaggacaagacccacaucagcuccuggggcgacguccccuaccucggcaagcgcgaggaccaguggugcggcagccugaucgggcugacggcccgggcgaccugggccaccaacauccagguggccaucaaccaggugcgccggcucaucggcaacgagaacuaccuggacuacaugaccuccaugaagcgcuucaagaacgagagcgacccggagggggcccugugguga

SEQ ID NO: 8452 - RNA, 9879 nt, Artificial Sequence
  derived and/or modified CDS sequence (opt1) from DENV-1__FJ882526__SS-prME
agcgugaccaugcugcucaugcugaugcccaccgcccuggccuuccaccucacgacccggggcggggagccccacaugaucgugagcaagcaggagcggggcaagagccugcuguucaagaccuccgccggggugaacaugugcacccucaucgccauggaccugggggaguucugcgaggacaccaugaccuacaagugcccccgcaucaccgaggccgagcccgacgacguggacugcuggugcaacgccaccgacacgugggugaccuacgggaccugcagccagaccggggagcaccggcgcgacaagcgguccguggcccuggcgccccacgugggccucgggcuggagacgcgcaccgagaccuggaugagcuccgagggcgccuggaagcagauccagcgggucgagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugcccgacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaagaucguccaguacgagaaccugaaguacagcgugaucgugaccguccacaccggcgaccagcaccagguggggaacgaguccacggagcacggcaccaccgcgaccaucacgccccaggcccccagcacggagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccagcggggccuccaccagccaggagaccuggaaccggaaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcauguccuacgucaugugcaccgggagcuucaagcuggagaaggagguggcggagacccagcacggcacggugcucguccagaucaaguacgagggcaccgacgcccccugcaagauccccuucuccacccaggacgagaagggggugacccagaacggccggcugaucacggccaacccgaucgugaccgacaaggagaagcccgucaacaucgaggccgagccgcccuucggggagagcuacaucgugaucggcgcgggcgagcgcgcccugaagcuguccugguucaagaaggggagcuccaucggcaagauguucgaggccaccgcccgcggggcccgccgcauggcgauccucggcgacaccgccugggacuucgggagcaucggcggcguguucacguccgucgggaagcuggugcaccagaucuucggcaccgccuacggggugcuguucagcggcgucuccuggaccaugaagaucgggaucggcgugcuccugaccuggcugggccucaacagccgguccacgagccuguccaugaccugcaucgccguggggcuggucacccucuaccugggcgugauggugcaggccgacagcgggugcgucaucaacuggaagggccgcgagcugaagugcgggagcggcaucuucgugaccaacgaggugcacacguggaccgagcaguacaaguuccaggcggacuccccgaagcggcucagcgccgccaucggcaaggccugggaggagggggucugcggcauccgcuccgccacccggcuggagaacaucauguggaagcagaucagcaacgagcugaaccacauccuccuggagaacgacaugaaguucaccgugguggucggggacguggcgggcauccuggcccaggggaagaagaugauccgcccccagcccauggaguacaaguacuccuggaaguccuggggcaaggccaagaucaucggcgccgacgugcagaacaccacguucaucaucgacgggcccaacaccccggagugccccgacgaccagcgggcguggaacaucugggaggucgaggacuacggcuucgggaucuucaccaccaacaucuggcucaagcugcgcgacuccuacacccaggugugcgaccaccggcugaugagcgccgccaucaaggacuccaaggccgugcacgccgacaugggcuacuggaucgagagcgagaagaacgagaccuggaagcucgcgcgcgccuccuucaucgaggucaagaccugcaucuggcccaagagccacacccugugguccaacggcgugcuggagagcgagaugaucauccccaagaucuacgggggcccgaucucccagcacaacuaccggcccggguacuucacgcagaccgccggccccuggcaccucgggaagcuggagcuggacuucgaccucugcgagggcaccaccguggucguggacgagcacugcggcaaccgcgggccgagccugcggacgaccaccgugaccggcaagaucauccacgaguggugcugccgcuccugcacgcugccgccccugcgguucaagggggaggacggcugcugguacgggauggagauccgccccgucaaggagaaggaggagaaccuggucaagagcauggugagcgccggcuccggcgaggucgacagcuucucccuggggcuccugugcaucagcaucaugaucgaggaggugaugcggucccgcuggagccggaagaugcugaugaccggcacccucgccguguucuuccugcugaucauggggcagcucaccuggaacgaccugauccgccugugcaucauggucggcgcgaacgccuccgaccgcauggggaugggcacgaccuaccucgcccugauggccaccuucaagaugcggccgauguucgccgugggccuccuguuccgccggcugaccagccgcgaggugcugcuccugacgaucgggcugucccucgucgcgagcguggagcugcccaacucccuggaggagcucggcgacgggcuggccaugggcaucaugauccugaagcuccugaccgacuuccagagccaccagcugugggccacccuccugucccugaccuucaucaagacgaccuucagccuccacuacgccuggaagaccauggcgaugguccuguccaucgugagccuguucccccucugccuguccaccacgagccagaagaccaccuggcugcccgugcuccugggcucccuggggugcaagccgcucaccauguuccugaucgccgagaacaagaucuggggccgcaagagcuggccccugaacgaggggaucauggccgucggcaucgugagcauccuccuguccgcccugcucaagaacgacgugccccuggccgggccccugaucgcgggcggcaugcucaucgccugcuacgucaucagcggguccagcgccgaccugucccuggagaaggccgccgaggugagcugggaggaggaggcggagcacuccggcgccagccacaacauccucguggagguccaggacgacgggacgaugaagaucaaggacgaggagcgcgacgacacccugaccauccugcucaaggccacccugcuggccguguccggcguguacccgcucagcauccccgccacccuguucgucugguacuucuggcagaagaagaagcagcgguccggggugcugugggacacgcccagcccgcccgagguggagcgcgcgguccucgacgacggcaucuaccggaucaugcagcgcggccugcuggggcggucccaggugggcgugggggucuuccaggagaacguguuccacaccauguggcacgugacccgcggcgccguccugauguaccaggggaagcggcucgagcccagcugggccuccgugaagaaggaccugaucagcuacggcggcggguggcgccugcagggcuccuggaacaccggggaggaggugcaggucaucgccguggagcccggcaagaaccccaagaacgugcagacggcccccgggaccuucaagaccagcgagggcgaggucggcgcgaucgcccucgacuucaagcccgggaccuccggcagccccaucgugaaccgggaggggaagaucgugggccuguacggcaacggggucgugacgaccagcggcaccuacguguccgccaucgcccaggcgaaggccagccaggaggggccccugccggagaucgaggacgaggucuuccgcaagcggaaccucaccaucauggaccugcaccccggcuccgggaagacgcgccgguaccugcccgccaucgugcgcgaggccaucaagcggaagcuccgcacccugauccuggccccgacccgcguggucgcgagcgagauggccgaggcccucaagggcaugcccauccgguaccagaccacggccgugaaguccgagcacaccggcaaggagaucguggaccugaugugccacgccaccuucaccaugcgccugcucagccccguccgggugcccaacuacaacaugaucaucauggacgaggcgcacuucacggacccguccagcaucgccgcccgcggguacaucuccacccgggugggcaugggggaggccgccgcgaucuucaugaccgccacgccgcccggcagcgucgaggccuucccccaguccaacgccgugauccaggacgaggagcgcgacaucccggagcggagcuggaacuccggguacgaguggaucacggacuuccccggcaagaccgugugguucguccccagcaucaaguccggcaacgacaucgcgaacugccugcgcaagaacgggaagcgggugauccagcugagccgcaagaccuucgacaccgaguaccagaagacgaagaacaacgacugggacuacguggucaccaccgacaucuccgagaugggcgccaacuuccgggccgaccgcgugaucgacccccggcgcugccucaagccggugauccugaaggacgggcccgagcgggucauccuggccggccccaugcccgugaccgucgccagcgcggcccagcgccgggggcgcaucggccggaaccacaacaaggagggcgaccaguacaucuacauggggcagccgcucaacaacgacgaggaccacgcccacuggacggaggccaagaugcugcuggacaacaucaacacccccgagggcaucauccccgcccucuucgagcccgagcgcgagaaguccgcggccaucgacggggaguaccgccugcggggcgaggcccgcaagaccuucguggagcugaugcggcgcggggaccucccgguguggcugagcuacaaggucgccagcgagggcuuccaguacuccgaccggcgcuggugcuucgacggcgagcggaacaaccaggugcuggaggagaacauggacguggagaucuggaccaaggagggggagcgcaagaagcuccggccccgcuggcuggacgcccggacguacagcgacccccuggcgcuccgcgaguucaaggaguucgccgccggccggcgcuccgucagcggggaccugauccuggagaucggcaagcucccccagcaccugacccagcgggcccagaacgcgcuggacaaccucgugaugcugcacaacuccgagcagggcgggcgcgccuaccggcacgccauggaggagcugccggacaccaucgagacccucaugcugcuggcccucaucgccgugcugacgggcggggucacccuguucuuccucagcggccgcgggcugggcaagaccuccaucggccugcucugcgugauggcgagcuccgugcugcuguggauggccagcgucgagccccacuggaucgccgccuccaucauccucgaguucuuccugauggugcugcucauccccgagcccgaccggcagcgcaccccgcaggacaaccagcuggccuacguggucaucgggcuccucuucaugauccugaccguggcggccaacgagaugggccugcucgagacgaccaagaaggaccuggggaucggccacguggccgucgagaaccaccaccacgccgccaugcuggacguggaccuccaccccgcgagcgccuggacccuguacgccguggccaccacgaucaucacccccaugaugcggcacaccaucgagaacaccacggccaacaucucccugaccgcgaucgccaaccaggccgccauccucauggggcuggacaagggcuggccgaucagcaagauggacaucggcgucccccugcucgcgcuggggugcuacucccaggugaacccccugacccucaccgccgccgugcugaugcuggucgcccacuacgccaucaucggccccgggcuccaggcgaaggccacgcgcgaggcccagaagcgcaccgccgccggcaucaugaagaacccgaccguggacgggaucguggcgaucgaccuggaccccgucguguacgacgccaaguucgagaagcagcugggccagaucaugcuccugauccugugcaccagccagauccuccugaugcggacgaccugggcccugugcgaguccaucacccucgccaccggcccccugacgacccugugggaggggagccccggcaaguucuggaacaccaccaucgccguguccauggcgaacaucuuccgcgggagcuaccucgccggcgccggccuggccuucagccugaugaagucccucgggggcgggcggcgcggcacgggggcgcagggcgagacccugggcgagaaguggaagcggcagcugaaccagcucagcaaguccgaguucaacaccuacaagcgcagcgggaucauggaggucgaccgguccgaggccaaggagggccugaagcgcggggagaccacgaagcacgccgugagccggggcaccgccaagcugcgcugguucguggagcggaaccucgucaagccggaggggaaggugaucgaccugggcugcggccgcgggggcugguccuacuacugcgccgggcugaagaaggugaccgaggucaagggcuacaccaagggcgggcccggccacgaggagcccauccccauggcgacguacggguggaaccuggugaagcuccacagcggcaaggacguguucuucaucccgcccgagaagugcgacacccugcugugcgacaucggggaguccagccccaaccccaccaucgaggagggccggacccuccgcguccugaagaugguggagccguggcugcgggggaaccaguucugcaucaagauccucaaccccuacaugcccuccguggucgagacgcuggagcagaugcagcgcaagcacggcggcaugcuggugcggaacccccucagccgcaacuccacccacgagauguacugggugagcugcgggaccggcaacaucgucuccgccgugaacaugaccagccggaugcugcugaaccgcuucaccauggcccaccgcaagccgacguacgagcgggacguggaccucggggccggcacccgccacgucgccguggagcccgagguggcgaaccuggacaucaucggccagcggaucgagaacaucaagcacgagcacaaguccaccuggcacuacgacgaggacaaccccuacaagaccugggccuaccacgggagcuacgaggucaagcccuccggcagcgccagcuccauggugaacggggucgugaagcugcucacgaagccgugggacgugauccccauggucacccagaucgccaugaccgacaccacgcccuucggccagcagcgcguguucaaggagaagguggacacccggacccccaaggccaagcgcgggaccgcgcagaucauggaggucacggccaaguggcuguggggcuuccugagccggaacaagaagccgcgcaucugcacccgggaggaguucacccgcaaggugcgguccaacgccgccaucggcgcgguguucgucgacgagaaccaguggaacagcgccaaggaggccguggaggacgagcgcuucugggaccucgugcaccgggagcgcgagcugcacaagcaggggaagugcgcgaccugcgucuacaacaugaugggcaagcgggagaagaagcugggggaguucggcaaggccaaggggucccgcgcgaucugguacauguggcucggcgcccgguuccuggaguucgaggcccugggcuucaugaacgaggaccacugguucagccgcgagaacucccucagcgggguggagggcgaggggcugcacaagcugggcuacauccuccgggacaucuccaagauccccgggggcaacauguacgccgacgacacggccggcugggacacccgcaucaccgaggacgaccugcagaacgaggcgaagaucaccgacaucauggagcccgagcacgcccugcucgccaagagcaucuucaagcugacguaccagaacaaggugguccgggugcagcgcccggccaagaacgggaccgugauggacgucaucucccgccgggaccagcgcggcagcggccaggugggcaccuacggccugaacaccuucacgaacauggaggcccagcucauccggcagauggaguccgaggggaucuucagccccuccgagcuggagacccccaaccuggcgggccgcgugcucgacuggcuggagaagcacggggucgagcggcugaagcgcauggccaucagcggcgacgacugcguggugaagcccaucgacgaccgguucgccaccgcccucaccgcccugaacgacauggggaagguccgcaaggacaucccgcagugggagcccuccaagggcuggaacgacuggcagcagguccccuucugcagccaccacuuccaccagcugaucaugaaggacggccgggagaucgugguccccugccgcaaccaggacgagcucguggggcgggcgcgcgugagccagggcgccggguggucccugcgggagacggccugccugggcaagagcuacgcccagauguggcagcucauguacuuccaccgccgggaccugcgccuggcggccaacgccaucugcuccgccgucccgguggacugggugcccaccagccggaccaccugguccauccacgcccaccaccaguggaugacgaccgaggacaugcucagcgucuggaaccgcguguggaucgaggagaaccccuggauggaggacaagacccacaucuccagcuggggcgacgugcccuaccugggcaagcgggaggaccaguggugcggcucccugaucgggcucaccgcgcgcgccacgugggccaccaacauccaggucgccaucaaccaggugcgccggcugaucggcaacgagaacuaccuggacuacaugaccagcaugaagcgcuucaagaacgaguccgacccggagggggcccucugguga

SEQ ID NO: 8453 - RNA, 9879 nt, Artificial Sequence
  derived and/or modified CDS sequence (opt1) from DENV-1__FJ882527__SS-prME
agcgugaccaugcugcucaugcugaugcccaccgcccuggccuuccaccucacgacccggggcggggagccccacaugaucgugagcaagcaggagcggggcaagagccugcuguucaagaccagcgccggggugaacaugugcacccucaucgccauggaccugggcgaguucugcgaggacaccaugaccuacaagugcccccgcaucaccgaggccgagcccgacgacguggacugcuggugcaacgccaccgacacgugggugaccuacgggaccugcagccagaccggcgagcaccggcgggacaagcgguccguggcccuggcgccccacgugggccucgggcuggagacgcgcaccgagaccuggaugagcuccgagggcgccuggaagcagauccagcggguggagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugcccgacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaagaccguccaguacgagaaccugaaguacagcgugaucgugaccguccacacgggcgaccagcaccagguggggaacgaguccaccgagcacggcaccaccgcgaccaucacgccccaggcccccagcaccgagauccagcugaccgacuacggggcccucacccuggacugcagcccccggacgggccuggacuucaacgagaugguccuccugaccaugaaggagaaguccuggcuggugcacaagcagugguuccucgaccugccgcugcccuggaccagcggggccuccaccagccaggagacguggaaccggaaggaccuccuggugaccuucaagaccgcccacgcgaagaagcaggaggucguggugcugggcucccaggagggcgccaugcacaccgcccucacgggggccaccgagauccagaccagcggcaccacgaccaucuucgccgggcaccugaagugccgccugaagauggacaagcucacccugaagggcauguccuacgucaugugcaccgggagcuucaagcuggagaaggagguggcggagacgcagcacggcaccgugcucguccagaucaaguacgagggcaccgacgcccccugcaagauccccuucuccacccaggacgagaagggggugacgcagaacggccggcugaucaccgccaacccgaucgugaccgacaaggagaagcccgucaacaucgaggccgagccgcccuucggggagagcuacaucgugaucggcgcgggcgagaaggcccugaagcuguccugguucaagaaggggagcuccaucggcaagauguucgaggccaccgcccgcggggcccggcgcauggcgauccucggcgacacggccugggacuucgggagcaucggcggcguguucaccuccgucgggaagcuggugcaccagaucuucggcaccgccuacggggugcuguucagcggcgucuccuggaccaugaagaucgggaucggcgugcuccugacguggcugggccucaacagccgcuccaccagccuguccaugaccugcaucgccguggggcuggucacccucuaccugggcgugauggugcaggccgacagcgggugcgucaucaacuggaagggccgggagcugaagugcgggagcggcaucuucgugacgaacgaggugcacaccuggaccgagcaguacaaguuccaggcggacuccccgaagcgccucagcgccgccaucggcaaggccugggaggagggggucugcggcauccgguccgccacccgccuggagaacaucauguggaagcagaucagcaacgagcugaaccacauccuccuggagaacgacaugaaguucaccgugguggucggggacguggcgggcauccuggcccaggggaagaagaugauccggccccagcccauggaguacaaguacuccuggaaguccuggggcaaggccaagaucaucggcgccgacgugcagaacacgaccuucaucaucgacgggcccaacaccccggagugccccgacgaccagcgcgcguggaacaucugggaggucgaggacuacggcuucgggaucuucaccacgaacaucuggcucaagcugcgggacuccuacacccaggugugcgaccaccgccugaugagcgccgccaucaaggacuccaaggccgugcacgccgacaugggcuacuggaucgagagcgagaagaacgagaccuggaagcucgcgcgggccuccuucaucgaggucaagaccugcaucuggcccaagagccacacgcugugguccaacggcgugcuggagagcgagaugaucauccccaagaucuacgggggcccgaucucccagcacaacuaccgccccggguacuucacccagaccgccggccccuggcaccucgggaagcuggagcuggacuucgaccucugcgagggcaccacgguggucguggacgagcacugcggcaaccgggggccgagccugcgcaccaccaccgugacgggcaagaucauccacgaguggugcugccgguccugcacccugccgccccugcgcuucaagggggaggacggcugcugguacgggauggagauccggcccgucaaggagaaggaggagaaccuggucaagagcauggugagcgccggcuccggcgaggucgacagcuucucccuggggcuccugugcaucagcaucaugaucgaggaggugaugcgcucccgguggagccgcaagaugcugaugaccggcacccucgccguguucuuccugcugaucauggggcagcucacguggaacgaccugauccggcugugcaucauggucggcgcgaacgccuccgaccgcauggggaugggcaccaccuaccucgcccugauggccaccuucaagaugcgcccgaugcuggccgugggccuccuguuccggcgccugacgagccgggaggugcuccugcugaccaucgggcucucccuggucgcgagcguggagcugcccaacucccucgaggagcugggcgacgggcuggccaugggcaucaugauccucaagcugcugaccgacuuccagagccaccagcucugggccacccugcugucccucacguucaucaagaccaccuucagccugcacuacgccuggaagaccauggcgaugguccuguccaucgugagccucuucccccugugccuguccacgaccagccagaagaccaccuggcuccccgugcugcugggcucccucgggugcaagccgcuggccauguuccugaucgccgagaacaagaucuggggccgcaagagcuggccccucaacgaggggaucauggccgucggcaucgugagcauccugcuguccagccuccugaagaacgacgugccccuggccgggccccucaucgcgggcggcaugcugaucgccugcuacgucaucuccgggagcuccgccgaccugagccucgagaaggccgccgagguguccugggaggaggaggcggagcacagcggcgccucccacaacauccugguggagguccaggacgacgggacgaugaagaucaaggacgaggagcgggacgacacccugaccauccuccugaaggccacccugcucgccgugagcggcguguacccgcuguccauccccgccacccuguucgucugguacuucuggcagaagaagaagcagcgcagcggggugcucugggacacgcccagcccgcccgagguggagcgggcgguccuggacgacggcaucuaccgcaucaugcagcggggccugcuggggcgcagccaggugggcgugggggucuuccaggagaacguguuccacaccauguggcacgugacccggggcgccguccucauguaccaggggaagcgccuggagcccuccugggccagcgugaagaaggaccugaucuccuacggcggcggguggcggcuccagggcagcuggaacaccggggaggaggugcaggucaucgccguggagcccggcaagaaccccaagaacgugcagacggcccccgggaccuucaagaccuccgagggcgaggucggcgcgaucgcccuggacuucaagcccgggaccagcggcagccccaucgugaaccgcgaggggaagaucgugggccuguacggcaacggggucgugacgaccuccggcaccuacgugagcgccaucgcccaggcgaaggccucccaggaggggccccucccggagaucgaggacgaggucuuccggaagcgcaaccugaccaucauggaccugcaccccggcagcgggaagacgcggcgcuaccuccccgccaucgugcgggaggccaucaagcgcaagcugcggacccugauccucgccccgacccgcguggucgcguccgagauggccgaggcccugaagggcaugcccauccgcuaccagaccacggccgucaagagcgagcacaccggcaaggagaucguggaccugaugugccacgccaccuucaccaugcggcuccugucccccguccgcgugcccaacuacaacaugaucaucauggacgaggcgcacuucacggacccgagcuccaucgccgcccggggguacaucagcacccgcgugggcaugggggaggccgccgcgaucuucaugaccgccacgccgcccggcuccgucgaggccuucccccagagcaacgccgugauccaggacgaggagcgggacaucccggagcgcuccuggaacagcggguacgaguggaucacggacuuccccggcaagaccgugugguucguccccuccaucaagagcggcaacgacaucgcgaacugccugcggaagaacgggaagcgcgugauccagcucucccggaagaccuucgacaccgaguaccagaagacgaagaacaacgacugggacuacguggucaccaccgacaucagcgagaugggcgccaacuuccgcgccgaccgggugaucgacccccgccggugccugaagccggugauccugaaggacgggcccgagcgcgucauccucgccggccccaugcccgugaccgucgccuccgcggcccagcggcgcgggcggaucggccgcaaccacaacaaggagggcgaccaguacaucuacauggggcagccgcugaacaacgacgaggaccacgcccacuggacggaggccaagaugcugcucgacaacaucaacacccccgagggcaucauccccgcccuguucgagcccgagcgggagaaguccgcggccaucgacggggaguaccgccugcgcggcgaggcccggaagaccuucguggagcucaugcgccgcggggaccugccgguguggcugagcuacaaggucgccuccgagggcuuccaguacagcgaccgccgguggugcuucgacggcgagcgcaacaaccaggugcucgaggagaacauggacguggagaucuggaccaaggagggggagcggaagaagcugcgcccccgguggcuggacgcccgcacguacuccgacccccucgcgcugcgggaguucaaggaguucgccgccggccgccggagcgucuccggggaccugauccucgagaucggcaagcugccccagcaccugacccagcgcgcccagaacgcgcucgacaaccuggugaugcugcacaacagcgagcagggcgggcgggccuaccgccacgccauggaggagcucccggacaccaucgagacccugaugcugcucgcccugaucgccgugcugacgggcggggucacccucuucuuccuguccggccgggggcugggcaagaccagcaucggccuccugugcgugauggcguccagcgugcugcucuggauggccuccgucgagccccacuggaucgccgccagcaucauccuggaguucuuccugauggugcuccugauccccgagcccgaccgccagcggaccccgcaggacaaccagcuggccuacguggucaucgggcuccuguucaugauccugaccguggcggccaacgagaugggccuccuggagacgaccaagaaggaccuggggaucggccacguggccgucgagaaccaccaccacgccgccaugcucgacguggaccugcaccccgcguccgccuggacccuguacgccguggccaccacgaucaucacccccaugaugcgccacaccaucgagaacaccacggccaacaucagccucaccgcgaucgccaaccaggccgccauccugauggggcuggacaagggcuggccgaucuccaagauggacaucggcgucccccuccuggcgcuggggugcuacagccaggugaacccccucacccugaccgccgccgugcugaugcucgucgcccacuacgccaucaucggccccgggcugcaggcgaaggccacgcgggaggcccagaagcgcaccgccgccggcaucaugaagaacccgaccguggacgggaucguggcgaucgaccuggaccccgucguguacgacgccaaguucgagaagcagcucggccagaucaugcugcugauccucugcaccucccagauccugcugaugcgcacgaccugggcccucugcgagagcaucacccuggccaccggcccccugacgacccucugggaggggucccccggcaaguucuggaacaccaccaucgccgugagcauggcgaacaucuuccgggggagcuaccuggccggcgccggccuggccuucucccucaugaagucccucgggggcgggcgccgggggacgggggcgcagggcgagacccugggcgagaaguggaagcgccagcucaaccagcuguccaagagcgaguucaacaccuacaagcgguccgggaucauggaggucgaccgcagcgaggccaaggagggccugaagcgcggggagaccacgaagcacgccgugucccgcggcaccgccaagcuccggugguucguggagcgcaaccuggucaagccggaggggaaggugaucgaccugggcugcggccgcggcggguggagcuacuacugcgccgggcugaagaaggugaccgaggucaagggguacaccaagggcgggcccggccacgaggagcccauccccauggcgacguacggguggaaccucgugaagcugcacuccggcaaggacguguucuucaucccgcccgagaagugcgacacccugcucugcgacaucggggagagcucccccaaccccaccaucgaggagggccgcacccugcggguccugaagaugguggagccguggcuccgcgggaaccaguucugcaucaagauccugaaccccuacaugcccagcguggucgagacgcuggagcagaugcagcggaagcacggcggcaugcucgugcgcaacccccugucccggaacagcacccacgagauguacuggguguccugcgggaccggcaacaucgucagcgccgugaacaugaccucccgcaugcugcucaaccgguucaccauggcccaccgcaagccgacguacgagcgcgacguggaccugggggccggcacccggcacgucgccguggagcccgagguggcgaaccuggacaucaucggccagcgcaucgagaacaucaagcacgagcacaagagcaccuggcacuacgacgaggacaaccccuacaagaccugggccuaccacggguccuacgaggucaagcccagcggcagcgccuccagcauggugaacggggucgugaagcuccugacgaagccgugggacgugauccccauggucacccagaucgccaugaccgacaccacgcccuucggccagcagcggguguucaaggagaagguggacacccgcacccccaaggccaagcgggggaccgcgcagaucauggaggucacggccaaguggcuguggggcuuccucucccgcaacaagaagccgcggaucugcacccgcgaggaguucacccggaaggugcgcagcaacgccgccaucggcgcgguguucgucgacgagaaccaguggaacuccgccaaggaggccguggaggacgagcgguucugggaccuggugcaccgcgagcgggagcugcacaagcaggggaagugcgcgaccugcgucuacaacaugaugggcaagcgcgagaagaagcucggggaguucggcaaggccaaggggagccgggcgaucugguacauguggcugggcgcccgcuuccuggaguucgaggcccucggcuucaugaacgaggaccacugguucucccgggagaacagccuguccgggguggagggcgaggggcugcacaagcucggcuacauccugcgcgacaucagcaagauccccgggggcaacauguacgccgacgacacggccggcugggacacccggaucaccgaggacgaccugcagaacgaggcgaagaucaccgacaucauggagcccgagcacgcccuccuggccaaguccaucuucaagcugacguaccagaacaaggugguccgcgugcagcggccggccaagaacgggaccgugauggacgucaucagccgccgcgaccagcggggcuccggccaggugggcaccuacggccucaacaccuucacgaacauggaggcccagcugauccgccagauggagagcgaggggaucuucucccccagcgagcuggagacccccaaccucgcgggccgggugcuggacuggcuggagaagcacggggucgagcgccucaagcggauggccaucuccggcgacgacugcguggugaagcccaucgacgaccgcuucgccaccgcccugaccgcccugaacgacauggggaagguccggaaggacaucccgcagugggagcccagcaagggcuggaacgacuggcagcagguccccuucugcagccaccacuuccaccagcucaucaugaaggacggccgcgagaucgugguccccugccggaaccaggacgagcugguggggcgcgcgcgggugucccagggcgccggguggagccugcgcgagacggccugccucggcaaguccuacgcccagauguggcagcugauguacuuccaccggcgcgaccugcggcucgcggccaacgccaucugcagcgccgucccgguggacugggugcccaccucccgcaccaccuggagcauccacgcccaccaccaguggaugacgaccgaggacaugcuguccgucuggaaccggguguggaucgaggagaaccccuggauggaggacaagacccacaucagcuccuggggcgacgugcccuaccugggcaagcgcgaggaccaguggugcggcagccucaucgggcugaccgcgcgggccacgugggccaccaacauccaggucgccaucaaccaggugcgccgccugaucggcaacgagaacuaccucgacuacaugaccuccaugaagcgguucaagaacgagagcgacccggagggggcccugugguga

SEQ ID NO: 8454 - RNA, 9879 nt, Artificial Sequence
  derived and/or modified CDS sequence (opt1) from DENV-1__FJ882529__SS-prME
agcgugaccaugcugcucaugcugaugcccaccgcccuggccuuccaccucacgacccggggcggggagccccacaugaucgugagcaagcaggagcggggcaagagccugcuguucaagaccagcgccggggugaacaugugcacccucaucgccauggaccugggcgaguucugcgaggacaccaugaccuacaagugcccccgcaucaccgaggccgagcccgacgacguggacugcuggugcaacgccaccgacacgugggugaccuacgggaccugcagccagaccggcgagcaccggcgggacaagcgguccguggcccuggcgccccacgugggccucgggcuggagacgcgcaccgagaccuggaugagcuccgagggcgccuggaagcagauccagcgggucgagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugcccgacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaagaucguccaguacgagaaccugaaguacagcgugaucgugaccguccacaccggcgaccagcaccagguggggaacgaguccacggagcacggcaccaccgcgaccaucacgccccaggcccccagcacggagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccagcggggccuccaccagccaggagaccuggaaccggcaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcauguccuacgucaugugcaccgggagcuucaagcuggagaaggagguggcggagacccagcacggcacggugcucguccagaucaaguacgagggcaccgacgcccccugcaagauccccuucuccacccaggacgagaagggggugacccagaacggccggcugaucacggccaacccgaucgugaccgacaaggagaagcccgucaacaucgaggccgagccgcccuucggggagagcuacaucgugaucggcgcgggcgagaaggcccugaagcuguccugguucaagaaggggagcuccaucggcaagauguucgaggccaccgcccgcggggcccggcgcauggcgauccucggcgacaccgccugggacuucgggagcaucggcggcguguucacguccgucgggaagcuggugcaccagaucuucggcaccgccuacggggugcuguucagcggcgucuccuggaccaugaagaucgggaucggcgugcuccugaccuggcugggccucaacagccgcuccacgagccuguccaugaccugcaucgccguggggcuggucacccucuaccugggcgugauggugcaggccgacagcgggugcgucaucaacuggaagggccgggagcugaagugcgggagcggcaucuucgugaccaacgaggugcacacguggaccgagcaguacaaguuccaggcggacuccccgaagcgccucagcgccgccaucggcaaggccugggaggagggggucugcggcauccgguccgccacccgccuggagaacaucauguggaagcagaucagcaacgagcugaaccacauccuccuggagaacgacgugaaguucaccguggucgugggggacguggcgggcauccuggcccaggggaagaagaugauccggccccagcccauggaguacaaguacuccuggaaguccuggggcaaggccaagaucaucggcgccgacguccagaacaccacguucaucaucgacgggcccaacaccccggagugccccgacgaccagcgcgcguggaacaucugggagguggaggacuacggcuucgggaucuucaccaccaacaucuggcucaagcugcgggacuccuacacccaggugugcgaccaccgccugaugagcgccgccaucaaggacuccaaggccguccacgccgacaugggcuacuggaucgagagcgagaagaacgagaccuggaagcucgcgcgggccuccuucaucgaggugaagaccugcaucuggcccaagagccacacccugugguccaacggcgugcuggagagcgagaugaucauccccaagaucuacgggggcccgaucucccagcacaacuaccgccccggguacuucacgcagaccgccggccccuggcaccucgggaagcuggagcuggacuucgaccucugcgagggcaccaccgucgugguggacgagcacugcggcaaccgggggccgagccugcgcacgaccaccgucaccggcaagaucauccacgaguggugcugccgguccugcacgcugccgccccugcgcuucaagggggaggacggcugcugguacgggauggagauccggcccgugaaggagaaggaggagaaccuggucaagagcauggucagcgccggcuccggcgagguggacagcuucucccuggggcuccugugcaucagcaucaugaucgaggaggugaugcgcucccgguggagccgcaagaugcugaugaccggcacccucgccgucuucuuccugcugaucauggggcagcucaccuggaacgaccugauccggcugugcaucauggugggcgcgaacgccuccgaccgcauggggaugggcacgaccuaccucgcccugauggccaccuucaagaugcgcccgauguucgccgugggccuccuguuccggcgccugaccagccgggagguccugcuccugacgaucgggcugucccucguggcgagcgucgagcugcccaacucccuggaggagcucggcgacgggcuggccaugggcaucaugauccugaagcuccugaccgacuuccagagccaccagcugugggccacccuccugucccugaccuucaucaagacgaccuucagccuccacuacgccuggaagaccauggcgauggugcuguccaucgugagccuguucccccucugccuguccaccacgagccagaagaccaccuggcugcccguccuccugggcucccuggggugcaagccgcucaccauguuccugaucgccgagaacaagaucuggggccgcaagagcuggccccugaacgaggggaucauggccgugggcaucgugagcauccuccuguccagccugcucaagaacgacgucccccuggccgggccccugaucgccggcggcaugcucaucgcgugcuacgugaucuccgggagcuccgccgaccugagccuggagaaggccgccgagguguccugggaggaggaggccgagcacagcggcgcgucccacaacauccucgucgaggugcaggacgacgggacgaugaagaucaaggacgaggagcgggacgacacccugaccauccugcucaaggccacccugcuggccgugagcggcgucuacccgcucuccauccccgccacccuguucgugugguacuucuggcagaagaagaagcagcgcagcggggugcugugggacacgcccagcccgcccgaggucgagcgggccgugcucgacgacggcaucuaccgcaucaugcagcggggccugcuggggcgcagccaggugggcgucgggguguuccaggagaacguguuccacaccauguggcacgucacccggggcgcggugcugauguaccaggggaagcgccucgagcccuccugggccagcgugaagaaggaccugaucuccuacggcggcggguggcggcugcagggcagcuggaacaccggggaggagguccaggugaucgccguggagcccggcaagaaccccaagaacguccagacggcccccgggaccuucaagaccuccgagggcgaggugggcgccaucgcgcucgacuucaagcccgggaccagcggcagccccaucgugaaccgcgaggggaagaucgucggccuguacggcaacgggguggugacgaccuccggcaccuacgucagcgccaucgcccaggccaaggcgucccaggaggggccccugccggagaucgaggacgagguguuccggaagcgcaaccucaccaucauggaccugcaccccggcagcgggaagacgcggcgcuaccugcccgccaucgugcgggaggccaucaagcgcaagcuccggacccugauccuggccccgacccgcgucguggccuccgagauggcggaggcccucaagggcaugcccauccgcuaccagaccacggccgucaagagcgagcacaccggcaaggagaucgucgaccugaugugccacgccaccuucaccaugcggcugcucucccccgugcgcgugcccaacuacaacaugaucaucauggacgaggcccacuucacggacccgagcuccaucgcggcccggggguacaucagcacccgcgucggcaugggggaggccgccgccaucuucaugaccgcgacgccgcccggcuccguggaggccuucccccagagcaacgccgugauccaggacgaggagcgggacaucccggagcgcuccuggaacagcggguacgaguggaucacggacuuccccggcaagaccgucugguucgugcccuccaucaagagcggcaacgacaucgccaacugccugcggaagaacgggaagcgcgugauccagcugucccggaagaccuucgacaccgaguaccagaagacgaagaacaacgacugggacuacgucgugaccaccgacaucagcgagaugggcgcgaacuuccgcgccgaccgggugaucgacccccgccggugccucaagccggucauccugaaggacgggcccgagcgcgugauccuggccggccccaugcccgucaccguggccuccgccgcgcagcggcgcgggcggaucggccgcaaccacaacaaggagggcgaccaguacaucuacauggggcagccgcucaacaacgacgaggaccacgcccacuggacggaggccaagaugcugcuggacaacaucaacacccccgagggcaucauccccgcccucuucgagcccgagcgggagaaguccgccgcgaucgacggggaguaccgccugcgcggcgaggcccggaagaccuucguggagcugaugcgccgcggggaccucccggucuggcugagcuacaagguggccuccgagggcuuccaguacagcgaccgccgguggugcuucgacggcgagcgcaacaaccaggugcuggaggagaacauggacgucgagaucuggaccaaggagggggagcggaagaagcuccgcccccgguggcuggacgcccgcacguacuccgacccccuggcccuccgggaguucaaggaguucgcggccggccgccggagcguguccggggaccugauccuggagaucggcaagcucccccagcaccugacccagcgcgcccagaacgcccuggacaaccucgugaugcugcacaacagcgagcagggcgggcgggcguaccgccacgccauggaggagcugccggacaccaucgagacccucaugcugcuggcccucaucgccguccugacgggcggggugacccuguucuuccucuccggccgggggcugggcaagaccagcaucggccugcucugcgugauggccuccagcguccugcuguggauggcguccguggagccccacuggaucgccgccagcaucauccucgaguucuuccugauggugcugcucauccccgagcccgaccgccagcggaccccgcaggacaaccagcuggccuacgucgugaucgggcuccucuucaugauccugaccguggccgcgaacgagaugggccugcucgagacgaccaagaaggaccuggggaucggccacgucgccguggagaaccaccaccacgccgccaugcuggacguggaccuccaccccgccuccgcguggacccuguacgccgucgccaccacgaucaucacccccaugaugcgccacaccaucgagaacaccacggccaacaucagccugaccgccaucgcgaaccaggccgccauccucauggggcuggacaagggcuggccgaucuccaagauggacaucggcgugccccugcucgcccuggggugcuacagccaggugaacccccugacccucaccgcggccguccugaugcugguggcccacuacgccaucaucggccccgggcuccaggccaaggcgacgcgggaggcccagaagcgcaccgccgccggcaucaugaagaacccgaccguggacgggaucgucgccaucgaccuggaccccgugguguacgacgcgaaguucgagaagcagcugggccagaucaugcuccugauccugugcaccucccagauccuccugaugcgcacgaccugggcccugugcgagagcaucacccucgccaccggcccccugacgacccugugggaggggucccccggcaaguucuggaacaccaccaucgccgucagcauggccaacaucuuccgggggagcuaccucgcgggcgccggccuggccuucucccugaugaagucccucgggggcgggcgccggggcacgggggcccagggcgagacccugggcgagaaguggaagcgccagcugaaccagcucuccaagagcgaguucaacaccuacaagcgguccgggaucauggagguggaccgcagcgaggcgaaggagggccugaagcgcggggagaccacgaagcacgccgugucccgcggcaccgccaagcugcggugguucgucgagcgcaaccucgugaagccggaggggaaggugaucgaccugggcugcggccgcggcggguggagcuacuacugcgccgggcugaagaaggucaccgaggugaagggguacaccaagggcgggcccggccacgaggagcccauccccauggccacguacggguggaaccuggugaagcuccacuccggcaaggacgucuucuucaucccgcccgagaagugcgacacccugcugugcgacaucggggagagcucccccaaccccaccaucgaggagggccgcacccuccgggugcugaagaugguggagccguggcugcgcgggaaccaguucugcaucaagauccucaaccccuacaugcccagcgucguggagacgcuggagcagaugcagcggaagcacggcggcaugcuggugcgcaacccccucucccggaacagcacccacgagauguacugggucuccugcgggaccggcaacaucgugagcgcggugaacaugaccucccgcaugcugcugaaccgguucaccaugguccaccgcaagccgacguacgagcgcgacguggaccucggggccggcacccggcacguggccgucgagcccgagguggccaaccuggacaucaucggccagcgcaucgagaacaucaagcacgagcacaagagcaccuggcacuacgacgaggacaaccccuacaagaccugggccuaccacggguccuacgaggucaagcccagcggcagcgcguccagcauggugaacgggguggucaagcugcucacgaagccgugggacgugauccccauggugacccagaucgccaugaccgacaccacgcccuucggccagcagcgggucuucaaggagaagguggacacccgcacccccaaggccaagcgggggaccgcccagaucauggaggugacggccaaguggcuguggggcuuccugucccgcaacaagaagccgcggaucugcacccgcgaggaguucacccggaagguccgcagcaacgcggccaucggcgccguguucguggacgagaaccaguggaacuccgccaaggaggcggucgaggacgagcgguucugggaccucgugcaccgcgagcgggagcugcacaagcaggggaagugcgcgaccugcguguacaacaugaugggcaagcgcgagaagaagcugggggaguucggcaaggccaaggggagccgggccaucugguacauguggcucggcgcccgcuuccuggaguucgaggcgcugggcuucaugaacgaggaccacugguucucccgggagaacagccucuccggggucgagggcgaggggcugcacaagcugggcuacauccuccgcgacaucagcaagauccccgggggcaacauguacgccgacgacacggccggcugggacacccggaucaccgaggacgaccugcagaacgaggccaagaucaccgacaucauggagcccgagcacgcccugcucgcgaaguccaucuucaagcugacguaccagaacaagguggugcgcguccagcggccggccaagaacgggaccgugauggacgugaucagccgccgcgaccagcggggcuccgggcaggucggcaccuacggccugaacaccuucacgaacauggaggcccagcucauccgccagauggagagcgaggggaucuucucccccagcgagcuggagacccccaaccuggccggccgggugcucgacuggcuggagaagcacgggguggagcgccugaagcggauggccaucuccggcgacgacugcgucgugaagcccaucgacgaccgcuucgcgaccgcccucaccgcccugaacgacauggggaaggugcggaaggacaucccgcagugggagcccagcaagggcuggaacgacuggcagcagguccccuucugcagccaccacuuccaccagcugaucaugaaggacggccgcgagaucguggugcccugccggaaccaggacgagcucgucgggcgcgcccgggugucccagggcgccggguggagccugcgcgagacggcgugccugggcaaguccuacgcccagauguggcagcucauguacuuccaccggcgcgaccugcggcuggccgccaacgcgaucugcagcgccgugccggucgacugggugcccaccucccgcaccaccuggagcauccacgcccaccaccaguggaugacgaccgaggacaugcucuccguguggaaccgggucuggaucgaggagaaccccuggauggaggacaagacccacaucagcuccuggggcgacgugcccuaccugggcaagcgcgaggaccaguggugcggcagccugaucgggcucaccgcccgggccacgugggcgaccaacauccagguggccaucaaccagguccgccgccugaucggcaacgagaacuaccuggacuacaugaccuccaugaagcgguucaagaacgagagcgacccggagggggcccucugguga

SEQ ID NO: 8455 - RNA, 9879 nt, Artificial Sequence
  derived and/or modified CDS sequence (opt1) from DENV-1__FJ882530__SS-prME
agcgugaccaugcugcucaugcugaugcccaccgcccuggccuuccaccucacgacccggggcggggagccccacaugaucgugagcaagcaggagcggggcaagagccugcuguucaagaccagcgcgggggugaacaugugcacccucaucgccauggaccugggcgaguucugcgaggacacgaugaccuacaagugcccccgcaucaccgaggccgagcccgacgacguggacugcuggugcaacgccaccgacacgugggugaccuacgggaccugcagccagaccggcgagcaccggcgggacaagcgguccguggcccuggcgccccacgugggccucgggcuggagacgcgcaccgagaccuggaugagcuccgagggcgccuggaagcagauccagcggguggagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugcccgacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaagaccguccaguacgagaaccugaaguacagcgugaucgugaccguccacacgggcgaccagcaccagguggggaacgaguccaccgagcacggcaccaccgcgaccaucacgccccaggcccccagcaccgagauccagcugaccgacuacggggcccucacccuggacugcagcccccggacgggccuggacuucaacgagaugguccuccugaccaugaaggagaaguccuggcuggugcacaagcagugguuccucgaccugccgcugcccuggaccagcggggccuccaccagccaggagacguggaaccggaaggaccuccuggugaccuucaagaccgcccacgcgaagaagcaggaggucguggugcugggcucccaggagggcgccaugcacaccgcccucacgggggccaccgagauccagaccagcggcaccacgaccaucuucgccgggcaccugaagugccgccugaagauggacaagcucacccugaagggcauguccuacgucaugugcaccgggagcuucaagcuggagaaggagguggcggagacgcagcacggcaccgugcucguccagaucaaguacgagggcaccgacgcccccugcaagauccccuucuccacccaggacgagaagggggugacgcagaacggccggcugaucaccgccaacccgaucgugaccgacaaggagaagcccgucaacaucgaggccgagccgcccuucggggagagcuacaucgugaucggcgcgggcgagaaggcccugaagcuguccugguucaagaaggggagcuccaucggcaagauguucgaggccaccgcccgcggggcccggcgcauggcgauccucggcgacacggccugggacuucgggagcaucggcggcguguucaccuccgucgggaagcuggugcaccagaucuucggcaccgccuacggggugcuguucagcggcgucuccuggaccaugaagaucgggaucggcgugcuccugacguggcugggccucaacagccgcuccaccagccuguccaugaccugcaucgccguggggcuggucacccucuaccugggcgugauggugcaggccgacagcgggugcgucaucaacuggaagggccgggagcugaagugcgggagcggcaucuucgugacgaacgaggugcacaccuggaccgagcaguacaaguuccaggcggacuccccgaagcgccucagcgccgccaucggcaaggccugggaggagggggucugcggcauccgguccgccacccgccuggagaacaucauguggaagcagaucagcaacgagcugaaccacauccuccuggagaacgacaugaaguucaccgugguggucggggacguggcgggcauccuggcccaggggaagaagaugauccggccccagcccauggaguacaaguacuccuggaaguccuggggcaaggccaagaucaucggcgccgacgugcagaacacgaccuucaucaucgacgggcccaacaccccggagugccccgacgaccagcgcgcguggaacaucugggaggucgaggacuacggcuucgggaucuucaccacgaacaucuggcucaagcugcgggacucccacacccaggugugcgaccaccgccugaugagcgccgccaucaaggacuccaaggccgugcacgccgacaugggcuacuggaucgagagcgagaagaacgagaccuggaagcucgcgcgggccuccuucaucgaggucaagaccugcaucuggcccaagagccacacgcugugguccaacggcgugcuggagagcgagaugaucauccccaagaucuacgggggcccgaucucccagcacaacuaccgccccggguacuucacccagaccgccggccccuggcaccucgggaagcuggagcuggacuucgaccucugcgagggcaccacgguggucguggacgagcacugcggcaaccgggggccgagccugcgcaccaccaccgugacgggcaagaucauccacgaguggugcugccgguccugcacccugccgccccugcgcuucaagggggaggacggcugcugguacgggauggagauccggcccgucaaggagaaggaggagaaccuggucaagagcauggugagcgccggcuccggcgaggucgacagcuucucccuggggcuccugugcaucagcaucaugaucgaggaggugaugcgcucccgguggagccgcaagaugcugaugaccggcacccucgccguguucuuccugcugaucauggggcagcucacguggaacgaccugauccggcugugcaucauggucggcgcgaacgccuccgaccgcauggggaugggcaccaccuaccucgcccugauggccaccuucaagaugcgcccgauguucgccguggggcuccuguuccggcgccugacgagccgggaggugcugcuccugaccaucgggcugucccucgucgcgagcguggagcugcccaacucccuggaggagcucggcgacgggcuggccaugggcaucaugauccugaagcuccugaccgacuuccagagccaccagcugugggccacccuccugucccugacguucaucaagaccaccuucagccuccacuacgccuggaagaccauggcgaugguccuguccaucgugagccuguucccccucugccuguccacgaccagccagaagaccaccuggcugcccgugcuccugggcucccuggggugcaagccgcucacgauguuccugaucgccgagaacaagaucuggggccgcaagagcuggccccugaacgaggggaucauggccgucggcaucgugagcauccuccuguccagccugcucaagaacgacgugccccuggccgggccccugaucgccggcggcaugcucaucgcgugcuacgucaucuccgggagcuccgccgaccugagccuggagaaggccgccgagguguccugggaggaggaggccgagcacagcggcgcgucccacaacauccucguggagguccaggacgacgggaccaugaagaucaaggacgaggagcgggacgacacccugaccauccugcucaaggccacccugcuggccgugagcggcguguacccgcucuccauccccgccacgcuguucgucugguacuucuggcagaagaagaagcagcgcagcggggugcugugggacacccccagcccgcccgagguggagcgggccguccucgacgacggcaucuaccgcaucaugcagcggggccugcuggggcgcagccaggugggcgugggggucuuccaggagaacguguuccacaccauguggcacgugacccggggcgcgguccugauguaccaggggaagcgccucgagcccuccugggccagcgugaagaaggaccugaucuccuacggcggcggguggcggcugcagggcagcuggaacacgggggaggaggugcaggucaucgccguggagcccggcaagaaccccaagaacgugcagaccgcccccgggaccuucaagaccuccgagggcgaggucggcgccaucgcgcucgacuucaagcccgggacgagcggcagccccaucgugaaccgcgaggggaagaucgugggccuguacggcaacggggucgugaccaccuccggcaccuacgugagcgccaucgcccaggccaaggcgucccaggaggggccccugccggagaucgaggacgaggucuuccggaagcgcaaccucacgaucauggaccugcaccccggcagcgggaagacccggcgcuaccugcccgccaucgugcgggaggccaucaagcgcaagcuccggacccugauccuggccccgacccgcguggucgccuccgagauggcggaggcccucaagggcaugcccauccgcuaccagacgaccgccgucaagagcgagcacaccggcaaggagaucguggaccugaugugccacgccaccuucacgaugcggcugcucucccccguccgcgugcccaacuacaacaugaucaucauggacgaggcccacuucaccgacccgagcuccaucgcggcccggggguacaucagcacccgcgugggcaugggggaggccgccgccaucuucaugaccgcgacgccgcccggcuccgucgaggccuucccccagagcaacgccgugauccaggacgaggagcgggacaucccggagcgcuccuggaacagcggguacgaguggaucaccgacuuccccggcaagaccgugugguucguccccuccaucaagagcggcaacgacaucgccaacugccugcggaagaacgggaagcgcgugauccagcugucccggaagaccuucgacacggaguaccagaagaccaagaacaacgacugggacuacguggucaccaccgacaucagcgagaugggcgcgaacuuccgcgccgaccgggugaucgacccccgccggugccucaagccggugauccugaaggacgggcccgagcgcgucauccuggccggccccaugcccgugacggucgccuccgccgcgcagcggcgcgggcggaucggccgcaaccacaacaaggagggcgaccaguacaucuacauggggcagccgcucaacaacgacgaggaccacgcccacuggaccgaggccaagaugcugcuggacaacaucaacacccccgagggcaucauccccgcccucuucgagcccgagcgggagaaguccgccgcgaucgacggggaguaccgccugcgcggcgaggcccggaagaccuucguggagcugaugcgccgcggggaccucccgguguggcugagcuacaaggucgccuccgagggcuuccaguacagcgaccgccgguggugcuucgacggcgagcgcaacaaccaggugcuggaggagaacauggacguggagaucuggacgaaggagggggagcggaagaagcuccgcccccgguggcuggacgcccgcaccuacuccgacccccuggcccuccgggaguucaaggaguucgcggccggccgccggagcgucuccggggaccugauccuggagaucggcaagcucccccagcaccugacccagcgcgcccagaacgcccuggacaaccucgugaugcugcacaacagcgagcagggcgggcgggcguaccgccacgccauggaggagcugccggacaccaucgagacgcucaugcugcuggcccucaucgccgugcugaccggcggggucacccuguucuuccucuccggccgggggcugggcaagaccagcaucggccugcucugcgugauggccuccagcgugcugcuguggauggcguccgucgagccccacuggaucgccgccagcaucauccucgaguucuuccugauggugcugcucauccccgagcccgaccgccagcggaccccgcaggacaaccagcuggccuacguggucaucgggcuccucuucaugauccugacgguggccgcgaacgagaugggccugcucgagaccaccaagaaggaccuggggaucggccacguggccgucgagaaccaccaccacgccgccaugcuggacguggaccuccaccccgccuccgcguggacccuguacgccguggccacgaccaucaucacccccaugaugcgccacaccaucgagaacacgaccgccaacaucagccugaccgccaucgcgaaccaggccgccauccucauggggcuggacaagggcuggccgaucuccaagauggacaucggcgucccccugcucgcccuggggugcuacagccaggugaacccccugacccucacggcggccgugcugaugcuggucgcccacuacgccaucaucggccccgggcuccaggccaaggcgacccgggaggcccagaagcgcaccgccgccggcaucaugaagaacccgaccguggacgggaucguggccaucgaccuggaccccgucguguacgacgcgaaguucgagaagcagcugggccagaucaugcuccugauccugugcacgucccagauccuccugaugcgcaccaccugggcccugugcgagagcaucacccucgccacgggcccccugaccacccugugggaggggucccccggcaaguucuggaacaccacgaucgccgugagcauggccaacaucuuccgggggagcuaccucgcgggcgccggccuggccuucucccugaugaagucccucgggggcgggcgccggggcaccggggcccagggcgagacccugggcgagaaguggaagcgccagcugaaccagcucuccaagagcgaguucaacaccuacaagcgguccgggaucauggaggucgaccgcagcgaggcgaaggagggccugaagcgcggggagacgaccaagcacgccgugucccgcggcaccgccaagcugcggugguucguggagcgcaaccucgucaagccggaggggaaggugaucgaccugggcugcggccgcggcggguggagcuacuacugcgccgggcugaagaaggugaccgaggucaagggguacacgaagggcgggcccggccacgaggagcccauccccauggccaccuacggguggaaccuggugaagcuccacuccggcaaggacguguucuucaucccgcccgagaagugcgacacccugcugugcgacaucggggagagcucccccaaccccaccaucgaggagggccgcacgcuccggguccugaagaugguggagccguggcugcgcgggaaccaguucugcaucaagauccucaaccccuacaugcccagcguggucgagacccuggagcagaugcagcggaagcacggcggcaugcuggugcgcaacccccucucccggaacagcacccacgagauguacuggguguccugcgggaccggcaacaucgucagcgcggugaacaugaccucccgcaugcugcugaaccgguucacgauggcccaccgcaagccgaccuacgagcgcgacguggaccucggggccggcacccggcacgucgccguggagcccgagguggccaaccuggacaucaucggccagcgcaucgagaacaucaagcacgagcacaagagcaccuggcacuacgacgaggacaaccccuacaagacgugggcguaccacggguccuacgaggucaagcccagcggcagcgccuccagcauggugaacggggucgugaagcugcucaccaagccgugggacgugauccccauggucacccagaucgccaugaccgacacgacccccuucggccagcagcggguguucaaggagaagguggacacccgcacccccaaggccaagcgggggacggcccagaucauggaggucaccgcgaaguggcuguggggcuuccugucccgcaacaagaagccgcggaucugcacccgcgaggaguucacccggaaggugcgcagcaacgccgccaucggcgccguguucgucgacgagaaccaguggaacuccgcgaaggaggccguggaggacgagcgguucugggaccucgugcaccgcgagcgggagcugcacaagcaggggaagugcgccacgugcgucuacaacaugaugggcaagcgcgagaagaagcugggggaguucggcaaggccaaggggagccgggccaucugguacauguggcucggcgcgcgcuuccuggaguucgaggcccugggcuucaugaacgaggaccacugguucucccgggagaacagccucuccgggguggagggcgaggggcugcacaagcugggcuacauccuccgcgacaucagcaagauccccgggggcaacauguacgccgacgacaccgccggcugggacacccggaucaccgaggacgaccugcagaacgaggccaagaucacggacaucauggagcccgagcacgcgcugcucgccaaguccaucuucaagcugaccuaccagaacaaggugguccgcgugcagcggccggccaagaacgggaccgugauggacgucaucagccgccgcgaccagcggggcuccggccaggugggcaccuacggccugaacacguucaccaacauggaggcccagcucauccgccagauggagagcgaggggaucuucucccccagcgagcuggagacccccaaccuggccggccgggugcucgacuggcuggagaagcacggggucgagcgccugaagcggauggcgaucuccggcgacgacugcguggugaagcccaucgacgaccgcuucgccaccgcccucacggcccugaacgacauggggaagguccggaaggacaucccgcagugggagcccagcaagggcuggaacgacuggcagcagguccccuucugcagccaccacuuccaccagcugaucaugaaggacggccgcgagaucgugguccccugccggaaccaggacgagcucguggggcgcgcccgggugucccagggcgcgggguggagccugcgcgagaccgccugccugggcaaguccuacgcccagauguggcagcucauguacuuccaccggcgcgaccugcggcuggccgcgaacgccaucugcagcgccgucccgguggacugggugcccaccucccgcaccacguggagcauccacgcccaccaccaguggaugaccaccgaggacaugcucuccgucuggaaccggguguggaucgaggagaaccccuggauggaggacaagacccacaucagcuccuggggcgacgugcccuaccugggcaagcgcgaggaccaguggugcggcagccugaucgggcucacggcccgggcgaccugggccaccaacauccaggucgccaucaaccaggugcgccgccugaucggcaacgagaacuaccuggacuacaugaccuccaugaagcgguucaagaacgagagcgacccggagggggcccucugguga

SEQ ID NO: 8456 - RNA, 9879 nt, Artificial Sequence
  derived and/or modified CDS sequence (opt1) from DENV-1__GQ868605__SS-prME
agcgugaccaugcugcugaugcugaugcccaccgcccuggccuuccaccucaccacccggggcggggagccccacaugaucgugaccaagcaggagcggggcaagagccugcuguucaagaccagcgugggggugaacaugugcacccucaucgccauggaccugggcgagcugugcgaggacaccaugaccuacaagugcccccgcaucaccgaggccgagcccgacgacgucgacugcuggugcaacgccacggacaccugggugaccuacgggaccugcucccagacgggcgagcaccggcgggacaagcggagcguggcccucgcgccccacgucggccuggggcuggagacccgcaccgagaccuggauguccagcgagggcgcguggaagcagauccagcggguggagacgugggcccuccgccaccccggguucaccgugaucgcccuguuccuggcccacgcgaucggcaccuccaucacccagaaggggaucaucuucauccuccugaugcuggucacgcccagcauggccaugcggugcgugggcaucggcucccgcgacuucguggaggggcucagcggcgccaccugggucgacguggugcuggagcacggguccugcgucaccaccauggccaaggacaagcccacgcuggacaucgagcuccugaagaccgaggugaccaaccccgccgugcugcggaagcucugcaucgaggcgaagaucagcaacaccacgaccgacucccgcugcccgacccagggcgaggccacccugauggaggagcaggacgccaacuucgucugccggcgcacguucguggaccggggcugggggaacggcugcgggcuguucggcaaggggagccucaucacgugcgccaaguucaagugcgugaccaagcuggagggcaagaucguccaguacgagaaccugaaguacuccgugaucgugaccguccacacgggcgaccagcaccagguggggaacgagagcaccgagcacggcaccaccgccaccaucacgccccaggcgcccaccuccgagauccagcucaccgacuacggggcccugacccuggacugcagcccccgcacgggccucgacuucaacgagaugguccugcugaccaugaaggagaaguccuggcucgugcacaagcagugguuccuggaccugccgcuccccuggaccagcggggccagcaccucccaggagacguggaaccggcaggaccugcuggugaccuucaagaccgcccacgccaagaagcaggaggucguggugcucggcagccaggagggcgcgaugcacaccgcccugacgggggccaccgagauccagaccuccggcaccacgaccaucuucgccgggcaccugaagugccgccucaagauggacaagcugacccugaagggcaugagcuacgucaugugcaccggguccuucaagcucgagaaggagguggccgagacgcagcacggcaccgugcugguccagaucaaguacgagggcaccgacgcgcccugcaagauccccuucagcacccaggacgagaagggggugacgcagaacggccggcugaucaccgccaacccgaucgugaccgacaaggagaagcccgucaacaucgaggccgagccgcccuucggggaguccuacaucgugaucggcgugggcgagaaggcccugaagcucagcugguucaagaagggguccagcaucggcaagauguucgaggcgaccgcccgcggggcccggcgcauggccauccugggcgacacggccugggacuucggguccaucggcggcgucuucaccagcguggggaagcuggugcaccagaucuucggcaccgcguacgggguccucuucuccggcgugagcuggaccaugaagaucgggaucggcgugcugcugacguggcucggccugaacucccgcagcaccucccugagcaugaccugcaucgccgucgggcucgugacccuguaccugggcgugaugguccaggccgacuccgggugcgugaucaacuggaagggccgggagcucaagugcgggagcggcaucuucgugacgaacgagguccacaccuggaccgagcaguacaaguuccaggccgacagcccgaagcgccuguccgccgcgaucggcaaggccugggaggagggggugugcggcauccggagcgccacccgccuggagaacaucauguggaagcagaucuccaacgagcucaaccacauccugcuggagaacgacaugaaguucaccguggucgugggggacguggucggcauccucgcccaggggaagaagaugauccggccccagcccauggagcacaaguacagcuggaaguccuggggcaaggccaagaucaucggcgcggacgugcagaacacgaccuucaucaucgacgggcccaacaccccggagugccccgacgaccagcgcgccuggaacaucugggagguggaggacuacggcuucgggaucuucaccacgaacaucuggcugaagcugcgggacagcuacacccaggucugcgaccaccgccucauguccgccgccaucaaggacagcaaggcggugcacgccgacaugggcuacuggaucgaguccgagaagaacgacaccuggaagcuggcccgggccagcuucaucgaggugaagaccugcaucuggcccaagucccacacgcuguggagcaacggcguccucgaguccgagaugaucauccccaagaucuacgggggcccgaucagccagcacaacuaccgccccggguacuucacccagaccgccggccccuggcaccuggggaagcuggagcucgacuucgaccugugcgagggcaccacggugguggucgacgagcacugcggcaaccgggggccgucccugcgcaccaccaccgugacgggcaagaucauccacgaguggugcugccggagcugcacccugccgccccuccgcuucaagggggaggacggcugcugguacgggauggagauccggcccgugaaggagaaggaggagaaccuggucaaguccauggugagcgcgggcagcggcgagguggacuccuucagccucgggcugcuguccaucagcaucaugaucgaggaggucaugcgcucccgguggagccgcaagaugcucaugaccggcacccuggccguguuccugcuccugaucguggggcagcugacguggaacgaccucauccggcugugcaucauggucggcgccaacgccuccgaccgcauggggaugggcaccaccuaccuggcccucauggcgaccuucaagaugcgcccgauguucgccgugggccugcuguuccggcgccucacgagccgggagguccugcugcucaccaucgggcugucccugguggccagcguggagcuccccaacucccuggaggagcugggcgacgggcucgccaugggcaucaugauccugaagcugcucaccgacuuccagagccaccagcugugggccacccugcucucccugacguucaucaagaccgcgcugagccuccacuacgccuggaagaccauggccaugguccuguccaucgugagccuguucccccucugccuguccaccacgagccagaagaccaccuggcugcccgugcuccugggcucccuggggugcaagccgcucaccauguuccugaucgccgagaacaagaucuggggccgcaagagcuggccccugaacgaggggaucauggcggucggcguggugagcauccuccuguccagccugcucaagaacgacgucccccuggccgggccccugaucgccggcggcaugcucaucgccugcuacgugaucuccgggagcuccgccgaccugagccuggagaaggcggccgagguguccugggaggaggaggccgagcacagcggcgccucccacaacauccucgucgaggugcaggacgacgggacgaugaagaucaaggacgaggagcgggacgacacccugaccauccugcucaaggccacccugcuggcggugagcggcgucuacccgcucuccauccccgccacccuguucgugugguacuucuggcagaagaagaagcagcgcagcggggugcugugggacacgcccagcccgcccgaggucgagcgggccgugcuggacgacggcaucuaccgcaucaugcagcggggccuccuggggcgcagccaggugggcgucgggguguuccaggagaacguguuccacaccauguggcacgucacccggggcgccgugcugauguaccaggggaagcgccucgagcccuccugggccagcgugaagaaggaccugaucuccuacggcggcggguggcggcugcagggcagcuggaacaccggggaggagguccaggugaucgcgguggagcccggcaagaaccccaagaacguccagacggcccccgggaccuucaagacccccgagggcgaggugggcgccaucgcccucgacuucaagcccgggaccuccggcagccccaucgugaaccgcgaggggaagaucgucggccuguacggcaacgggguggugacgaccagcggcaccuacgucuccgccaucgcgcaggccaaggccagccaggaggggccgcugcccgagaucgaggacgagguguuccggaagcgcaaccucaccaucauggaccugcaccccggcuccgggaagacgcggcgcuaccugccggccaucgugcgggaggcgaucaagcgcaagcuccggacccugauccuggcccccacccgcgucguggccagcgagauggccgaggcccucaagggcaugcccauccgcuaccagaccacggcggugaaguccgagcacaccggcaaggagaucgucgaccugaugugccacgccaccuucaccaugcggcugcucagccccgugcgcgugccgaacuacaacaugaucaucauggacgaggcccacuucacggaccccuccagcaucgccgcccggggguacaucuccacccgcgucggcaugggggaggcggccgccaucuucaugaccgccacgccgcccggcagcguggaggccuucccgcaguccaacgcggugauccaggacgaggagcgggacauccccgagcgcagcuggaacuccggguacgaguggaucacggacuuccccggcaagaccgucugguucgugcccagcaucaaguccggcaacgacaucgccaacugccugcggaagaacgggaagcgcgugauccagcugagccggaagaccuucgagaccgaguaccagaagacgaagaacaacgacugggacuacgucgugaccaccgacaucuccgagaugggcgccaacuuccgcgccgaccgggucaucgacccgcgccggugccucaagcccgugauccugaaggacgggagcgagcgcgugauccuggcgggccccaugcccgucaccguggccuccgccgcccagcggcgcgggcggaucggccgcaaccacaacaaggagggcgaccaguacaucuacauggggcagccgcucaacaacgacgaggaccacgcccacuggacggaggcgaagaugcugcuggacaacaucaacacccccgagggcaucauccccgcccucuucgagcccgagcgggagaaguccgccgccaucgacggggaguaccgccugcgcggcgaggcccggaagaccuucguggagcugaugcgccgcggggaccucccggucuggcugagcuacaagguggcguccgagggcuuccaguacagcgaccgccgguggugcuucgacggcgagcgcaacaaccaggugcuggaggagaacauggacgucgagaucuggaccaaggagggggagcggaagaagcuccgcccccgguggcuggacgcccgcacguacuccgacccccuggcccuccgggaguucaaggaguucgccgccggccgccggagcguguccggggaccugaucaucgagaucggcaagcugccccagcaccucacccagaaggcgcagaacgcccuggacaaccuggugaugcuccacaacagcgagcagggcgggcgcgccuaccggcacgccauggaggagcugccggacaccaucgagacccugaugcuccuggcgcugaucgccguccucacgggcggggugacccuguucuuccuguccggccgcgggcucggcaagaccagcaucggccugcugugcgugauggccuccagcguccuccuguggauggccuccguggagccccacuggaucgccgcgagcaucauccuggaguucuuccucauggugcugcugauccccgagcccgaccggcagcgcaccccgcaggacaaccagcucgccuacgucgugaucgggcugcuguucaugauccucaccguggccgccaacgagaugggccugcuggagacgaccaagaaggaccucgggaucggccacgucgccguggagaaccaccaccacgcgaccaugcuggacguggaccugcaccccgccuccgccuggacccucuacgccgucgccacgaccaucaucacccccaugaugcggcacaccaucgagaacacgaccgcgaacaucagccugaccgccaucgccaaccaggccgccauccugauggggcucgacaagggcuggccgaucuccaagauggacaucggcgugccccugcuggcgcucgggugcuacagccaggugaacccccugacccugacggccgccguccucaugcugguggcccacuacgcgaucaucggccccgggcugcaggccaaggccacccgcgaggcccagaagcggaccgccgcgggcaucaugaagaacccgaccguggacgggaucgucgccaucgaccucgaccccgugguguacgacgccaaguucgagaagcagcugggccagaucaugcugcucauccugugcacgucccagauccugcucaugcgcaccaccugggcccugugcgagagcaucacccuggccacgggcccccucaccacccugugggaggggucccccggcaaguucuggaacaccacgaucgcggucagcauggccaacaucuuccgcgggagcuaccuggccggcgccggccucgccuucucccugaugaagucccucgggggcgggcggcgcgggaccggggcgcagggcgagacccucggcgagaaguggaagcggcagcugaaccagcuguccaagagcgaguucaacaucuacaagcgcuccgggaucauggagguggaccggagcgaggccaaggagggccucaagcgcggggagaccacgcggcacgccgugucccgcggcaccgccaagcugcggugguucgucgagcgcaaccuggugaagccggaggggaaggugaucgaccugggcugcggccgcggcggguggagcuacuacugcgcggggcucaagaaggucaccgaggugaagggguacaccaagggcggccccggccacgaggagcccauccccauggccacguacggguggaaccuggugaagcugcacuccggcaaggacgucuucuucaccccgcccgagaagugcgacacccuccugugcgacaucggggagagcucccccaaccccaccaucgaggagggccgcacgcugcgggugcucaagaugguggagccguggcugcgcgggaaccaguucugcaucaagauccugaaccccuacaugcccagcgucguggagacccucgagcagaugcagcggaagcacggcggcaugcuggugcgcaacccccugucccggaacagcacccacgagauguacugggucuccugcgggaccggcaacaucgugagcgccgugaacaugaccucccgcaugcuccugaaccgguucacgauggcccaccgcaagccgaccuacgagcgcgacgucgaccugggggccggcacccggcacguggcggucgagcccgagguggccaaccucgacaucaucggccagcgcaucgagaacaucaagcacgagcacaagagcaccuggcacuacgacgaggacaaccccuacaagacgugggccuaccacggguccuacgaggugaagcccagcggcagcgccuccagcauggucaacgggguggugaagcugcugaccaagccgugggacgucauccccauggugacccagaucgccaugaccgacacgacccccuucggccagcagcggguguucaaggagaaggucgacacccgcacccccaaggcgaagcgggggacggcccagaucauggaggugaccgcccgcuggcucugguccuuccugagccggaacaagaagccgcgcaucugcacccgggaggaguucacccgcaaggugcgguccaacgccgccaucggcgcggucuucguggacgagaaccaguggaacagcgccaaggaggccguggaggacgagcgcuucugggaccugguccagaaggagcgggagcuccacaagcagggcaagugcgccacgugcguguacaacaugauggggaagcgcgagaagaagcugggcgaguucgggaaggcgaagggcucccgggccaucugguacauguggcugggggcccgcuuccucgaguucgaggcccugggcuucaugaacgaggaccacugguucagccgggagaacucccugagcggcguggagggggagggccuccacaagcugggguacauccugcgcgacaucuccaagauccccggcgggaacauguacgccgacgacaccgcgggcugggacacccggaucaccgaggacgaccuccagaacgaggccaagaucacggacaucauggagcccgagcacgcccugcuggccaccagcaucuucaagcucaccuaccagaacaaggucgugcgcgugcagcggccggccaagaacggcaccgucauggacgugaucucccgccgcgaccagcgggggagcggccagguggggacguacggccugaacaccuucaccaacauggaggcgcagcugauccgccagauggaguccgagggcaucuuccuccccagcgagcuggagacccccaaccuggccgagcggguccucgacuggcuggagaagcacgggguggagcgccugaagcggauggccaucuccggcgacgacugcguggucaagcccaucgacgaccgcuucgccacggcccucaccgcgcugaacgacauggggaaggugcggaaggacaucccgcagugggagcccagcaagggcuggaacgacuggcagcagguccccuucugcagccaccacuuccaccagcugaucaugaaggacgggcgcgagaucgucgugcccugccggaaccaggacgagcucgugggccgcgcccgggucucccagggcgccggguggagccugcgcgagaccgccugccugggcaaguccuacgcccagauguggcagcucauguacuuccaccggcgcgaccugcggcuggcggccaacgccaucugcagcgccgugccgguggacuggguccccaccucccgcacgaccuggagcauccacgcgcaccaccaguggaugaccaccgaggacaugcucuccguguggaaccggguguggaucgaggagaaccccuggauggaggacaagacgcacgucagcuccuggggcgacgugcccuaccugggcaagcgcgaggaccaguggugcgggagccugaucggccucaccgcccgggccaccugggccuccaacauccagguggccaucaaccagguccgccgccugaucggcaacgagaacuaccuggacuacaugaccagcaugaagcgguucaagaacgagggggacccggagggcgcgcucugguga

SEQ ID NO: 8457 - RNA, 9879 nt, Artificial Sequence
  derived and/or modified CDS sequence (opt1) from DENV-1__FJ882534__SS-prME
agcgugaccaugcugcucaugcugaugcccaccgcccuggccuuccaccucacgacccgcggcggggagccgcacaugaucgucuccaagcaggagcggggcaagagccugcuguucaagaccuccgcgggggugaacaugugcacccucaucgccauggaccugggcgagcugugcgaggacacgaugaccuacaagugcccccgcaucaccgaggccgagcccgacgacguggacugcuggugcaacgccaccgacacgugggucaccuacgggaccugcagccagaccggcgagcaccggcgcgacaagcgguccguggcccucgcgccccacgugggccuggggcuggagacgcgcaccgagaccuggaugagcuccgagggcgccuggaagcagauccagcgggucgagaccugggcccuccgccacccgggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcggugcugcggaagcucugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacaccggcgaccagcaccagguggggaacgaguccacggagcacggcaccaccgcgaccaucaccccccaggcccccacgaccgagauccagcucaccgacuacggggcccugacccuggacugcagcccccgcacgggccucgacuucaacgagaugguccugcugaccaugaaggagaaguccuggcucgugcacaagcagugguuccuggaccugccgcuccccuggaccagcggggccagcaccucccaggagacguggaaccggcaggaccugcuggugaccuucaagaccgcccacgcgaagaagcaggaggucguggugcucggcccccaggagggcgccaugcacaccgcccugacgggggccaccgagauccagaccagcggcaccacgaccaucuucgccgggcaccugaagugccgccucaagauggacaagcugacccugaagggcauguccuacgucaugugcaccgggagcuucaagcucgagaaggagguggcggagacgcagcacggcaccgugcugguccagaucaaguacgagggcaccgacgcccccugcaagaucccguucuccacccaggacgagaagggggugacgcagaacggccggcugaucaccgccaaccccaucgugaccgacaaggagaagcccgucaacaucgaggccgagcccccguucggggagagcuacaucgugaucggcgcgggcgagaaggcccugaagcucuccugguucaagaaggggagcuccaucggcaagauguucgaggccaccgcccgcggggcccggcgcauggcgauccugggcgacacggccugggacuucgggagcaucggcggcguguucaccuccgucgggaagcuggugcaccagaucuucggcaccgccuacggggugcucuucagcggcgucuccuggaccaugaagaucgggaucggcgugcugcugacguggcucggccugaacagccgcuccaccagccuguccaugaccugcaucgccguggggcucgucacccuguaccugggcgugauggugcaggccgacagcgggugcgucaucaacuggaagggccgggagcucaagugcggguccggcaucuucgugacgaacgaggugcacaccuggaccgagcaguacaaguuccaggcggacagccccaagcgccugagcgccgccaucggcaaggccugggaggagggggucugcggcauccgguccgccacccgccuggagaacaucauguggaagcagaucagcaacgagcucaaccacauccugcuggagaacgacaugaagcucaccgugguggucggggacguggcgggcauccuggggcagggcaagaagaugauccggccccagcccauggaguacaaguacuccuggaagagcuggggcaaggccaagaucaucggggccgacgcccagaacacgaccuucaucaucgacggcccgaacacccccgagugccccgacgaccagcgcgcguggaacaucugggagguggaggacuacggguucggcaucuucaccacgaacaucuggcugaagcuccgggacuccuacacccaggucugcgaccaccgccugaugagcgccgccaucaaggacuccaaggccgugcacgccgacaugggcuacuggaucgagagcgagaagaacgagaccuggaagcuggcgcgggccuccuucaucgaggugaagaccugcaucuggcccaagagccacacgcucugguccaacgggguccuggagagcgagaugaucaucccgaagaucuacggcgggcccaucucccagcacaacuaccgccccggcuacuucacccagaccgccgggccguggcaccugggcaagcucgagcuggacuucgaccugugcgagggcaccacggugguggucgacgagcacugcgggaaccggggccccagccuccgcaccaccaccgugacggggaagaucauccacgaguggugcugccgguccugcacccugcccccccugcgcuuccggggcgaggacgggugcugguacggcauggagauccgcccggugaaggagaaggaggagaaccucgucaagagcaugguguccgccggcagcggggagguggacagcuucucccugggccugcucugcaucagcaucaugaucgaggaggucaugcggucccgcuggagccggaagaugcugaugaccgggacccuggccguguucuuccuccugaucaugggccagcugacguggaacgaccucauccgccugugcaucauggugggggcgaacgccuccgaccgcaugggcaugggcaccaccuaccuggcccucauggccaccuucaagaugcggcccauguucgccgucgggcugcuguuccgccggcucacgagccgcgaggugcugcugcucaccaucggccugucccugguggcgagcgucgagcuccccaacucccuggaggagcugggggacggccucgccaugggcaucaugauccugaagcugcucaccgacuuccagagccaccagcugugggccacccugcucucccugacguucaucaagaccaccuucagccugcacuacgccuggaagaccauggcgauggugcucuccaucgucagccuguucccccugugccucuccacgaccagccagaagaccaccuggcugccggugcugcucgggucccugggcugcaagccccugacgauguuccucaucguggagaacaagaucugggggcggaagagcuggccccugaacgagggcaucauggccgucgggaucguguccauccugcucagcagccugcugaagaacgacgugccccucgccggcccgcugaucgccggcgggaugcugaucgccugcuacgucaucuccggcagcuccgcggaccucagccuggagaaggccgccgagguguccugggaggaggaggccgagcacagcggggccucccacaacauccugguggagguccaggacgacggcaccaugaagaucaaggacgaggagcgcgacgacacccucaccauccugcugaaggcgacccuccuggccgugagcgggguguacccccuguccauccccgccacgcucuucgucugguacuucuggcagaagaagaagcagcggagcggcgugcugugggacacccccuccccgcccgagguggagcgcgccguccuggacgacggcaucuaccggaucaugcagcgcgggcugcucggccggagccaggugggggugggcgucuuccaggagaacguguuccacaccauguggcacgugacccgcggggccguccugauguaccagggcaagcggcuggagcccuccugggcgagcgugaagaaggaccucaucuccuacggcgggggcuggcgccugcgggggagcuggaacacgggcgaggaggugcaggucaucgccguggagcccgggaagaacccgaagaacgugcagaccgcccccggcaccuucaagacccccgagggcgaggucggggccaucgcccuggacuucaagcccggcacguccgggagcccgaucgugaaccgcgagggcaagaucgugggccucuacgggaacggcgucgugaccaccuccgggaccuacgugagcgcgaucgcccaggccaaggccagccaggagggcccccugcccgagaucgaggacgaggucuuccggaagcgcaaccugacgaucauggaccuccacccgggguccggcaagacccggcgcuaccugcccgcgaucgugcgggaggccaucaagcgcaagcugcgcacccucauccuggcccccacccggguggucgccagcgagauggccgaggcgcugaagggcaugcccauccgcuaccagacgaccgccgugaaguccgagcacaccgggaaggagaucguggaccucaugugccacgccaccuucacgaugcggcugcugagcccgguccgcgugcccaacuacaacaugaucaucauggacgaggcccacuucaccgaccccuccagcaucgccgcgcggggcuacaucuccacccgcguggggaugggcgaggccgccgccaucuucaugaccgccacgcccccggggagcgucgaggcguucccccaguccaacgccgugauccaggacgaggagcgggacauccccgagcgcagcuggaacuccggcuacgaguggaucaccgacuuccccggcaagaccgugugguucgucccgagcaucaaguccgggaacgacaucgccaacugccuccggaagaacggcaagcgcgugauccagcugagccggaagaccuucgacacggaguaccagaagaccaagaacaacgacugggacuacguggucaccaccgacaucuccgagaugggggccaacuuccgcgcggaccgggugaucgacccccgccggugccugaagcccgugauccucaaggacggccccgagcgcgucauccuggccgggccgaugcccgugacggucgccagcgccgcccagcggcgcggccggaucggccgcaaccacaacaaggagggggaccaguacaucuacaugggccagccccugaacaacgacgaggaccacgcgcacuggaccgaggccaagaugcuccuggacaacaucaacacccccgaggggaucaucccggcccuguucgagcccgagcgcgagaaguccgccgccguggacggcgaguaccggcuccgcggggaggcgcggaagaccuucguggagcugaugcgccggggcgaccugcccgucuggcucagcuacaagguggccuccgagggcuuccaguacagcgaccgccgguggugcuucgacggggagcgcaacaaccaggugcuggaggagaacauggacgucgagaucuggacgaaggagggcgagcggaagaagcugcgcccccgguggcucgacgcccgcaccuacagcgacccgcuggcccugcgggaguucaaggaguucgccgcggggcgccgguccgugagcggcgaccucauccuggagaucggcaagcugccccagcaccucacccagcgcgcccagaacgcccuggacaaccuggugaugcuccacaacuccgagcaggggggccgggccuaccgccacgcgauggaggagcugcccgacaccaucgagacgcugaugcuccuggcccugaucgccguccucaccgggggcgugacccuguucuuccugagcgggcggggccucggcaagaccuccaucgggcugcugugcgugauggccagcuccguccuccuguggauggccagcguggagccccacuggaucgcggccuccaucauccuggaguucuuccucauggugcugcugaucccggagcccgaccgccagcggaccccccaggacaaccagcucgccuacgucgugaucggccugcuguucaugauccucacgguggccgccaacgagauggggcugcuggagaccaccaagaaggaccucggcaucgggcacgucgcgguggagaaccaccaccacgccgccaugcuggacguggaccugcacccggccagcgccuggacccucuacgcggucgccacgaccaucaucacccccaugaugcgccacaccaucgagaacacgaccgccaacaucucccugaccgccaucgccaaccaggcggccauccugaugggccucgacaagggcuggcccaucagcaagauggacaucggggugccccugcuggcccucggcugcuacucccaggugaacccgcugacccugacggccgcgguccucaugcugguggcccacuacgccaucaucgggcccggccugcaggccaaggccacccgcgaggcgcagaagcggaccgccgccgggaucaugaagaaccccaccguggacggcaucgucgccaucgaccucgaccccgugguguacgacgccaaguucgagaagcagcugggccagaucaugcugcucauccugugcacgagccagauccugcucaugcgcaccaccugggcgcugugcgaguccaucacccuggccacggggccgcucaccacccugugggagggcagccccgggaaguucuggaacaccacgaucgccgucuccauggccaacaucuuccggggcagcuaccuggccggcgcggggcucgccuucucccugaugaagagccugggcgggggccgccgggggaccggcgcccagggcgagacccucggggagaaguggaagcgccagcugaaccagcugagcaaguccgaguucaacaccuacaagcggagcggcaucauggagguggaccgcuccgaggccaaggaggggcucaagcggggcgagacgaccaagcacgcggugagccgcgggaccgccaagcugcggugguucgucgagcgcaaccuggugaagcccgagggcaaggugaucgaccugggcugcgggcggggcgggugguccuacuacugcgccggccucaagaaggucaccgaggugaagggguacacgaagggcggccccgggcacgaggagccgauccccauggccaccuacggcuggaaccuggugaagcugcacagcgggaaggacgucuucuucaucccccccgagaagugcgacacccuccugugcgacaucggcgaguccagcccgaaccccaccaucgaggaggggcgcacgcugcgggugcucaagaugguggagcccuggcugcgcggcaaccaguucugcaucaagauccugaaccccuacaugccguccgucguggagacccucgagcagaugcagcggaagcacggcgggaugcuggugcgcaacccccugagccggaacuccacccacgagauguacugggucagcugcggcaccgggaacaucguguccgccgugaacaugaccagccgcaugcuccugaaccgcuucacgauggcgcaccggaagcccaccuacgagcgcgacgucgaccugggcaccggcacccggcacguggccguggagcccgaggucgccaaccucgacaucaucgggcagcgcaucgagaacaucaagcacgagcacaaguccacguggcacuacgacgaggacaacccguacaagaccugggccuaccacggcagcuacgaggugaagcccuccgggagcgccuccagcauggucaacggcguggugaagcugcugaccaagcccugggacgucauccccauggugacccagaucgcgaugacggacaccaccccguucgggcagcagcggguguucaaggagaaggucgacacccgcacgcccaaggccaagcggggcaccgcccagaucauggaggugaccgcccgcuggcucuggggcuuccugagccggaacaagaagccccgcaucugcacccgggaggaguucacgcgcaaggugcgguccaacgccgcgaucggggccgucuucguggacgagaaccaguggaacagcgccaaggaggccguggaggacgagcgcuucugggaccugguccaccgggagcgcgagcuccacaagcagggcaagugcgcgaccugcguguacaacaugauggggaagcgggagaagaagcugggcgaguucgggaaggccaagggcucccgcgccaucugguacauguggcugggcgcccgguuccucgaguucgaggcccugggguucaugaacgaggaccacugguucagccgcgagaacucccugagcggcguggagggggagggccuccacaagcugggguacauccugcgggacaucuccaagaucccgggcggcaacauguacgcggacgacaccgccgggugggacacccgcaucacggaggacgaccuccagaacgaggccaagaucaccgacaucauggagcccgagcacgcccugcuggccaaggcgaucuucaagcucaccuaccagaacaaggucgugcgcgugcagcggcccgccaagaacggcaccgucauggacgugaucagccgccgggaccagcgcggguccggccaggugggcacguacgggcugaacaccuucaccaacauggaggcccagcugauccggcagauggagagcgagggcaucuucucccccagcgagcucgagaccccgaaccuggccgagcgcgcccuggacuggcucgagaaguacggggucgagcggcugaagcgcauggcgaucuccggcgacgacugcguggugaagcccaucgacgaccgguucgccacggcccugaccgcccucaacgacauggggaagguccgcaaggacaucccccagugggagcccagcaagggcuggaacgacuggcagcaggugccguucugcucccaccacuuccaccagcugaucaugaaggacggccgggagaucgugguccccugccgcaaccaggacgagcugguggggcgggcccgcgugagccagggcgcgggguggucccuccgggagaccgccugccugggcaagagcuacgcccagauguggcagcugauguacuuccaccgccgggaccuccgccuggccgcgaacgccaucugcagcgccguccccguggacugggugcccaccucccggacgaccuggagcauccacgcccaccaccaguggaugaccaccgaggacaugcuguccgucuggaaccgcguguggaucgaggagaacccguggauggaggacaagacgcacaucagcuccugggaggacgugcccuaccucgggaagcgcgaggaccaguggugcggcagccugaucggccugaccgcccgggcgaccugggccaccaacauccaggucgccaucaaccaggugcgccggcucaucgggaacgagaacuaccuggacuacaugaccuccaugaagcgcuucaagaacgagagcgaccccgagggcgcccugugguga

SEQ ID NO: 8458 - RNA, 9879 nt, Artificial Sequence
  derived and/or modified CDS sequence (opt1) from DENV-1__FJ882536__SS-prME
agcgugaccaugcugcucaugcugaugcccaccgcccuggccuuccaccucaccacccgcggcggggagccccacaugaucgugagcaagcaggagcggggcaagagccugcuguucaagaccagcgccggggugaacaugugcacccucaucgccauggaccugggcgagcugugcgaggacacgaugaccuacaagugcccccgcaucaccgaggccgagcccgacgacguggacugcuggugcaacgccaccgacacgugggugaccuacgggaccugcagccagaccggcgagcaccggcgcgacaagcgguccguggcccucgcgccccacgugggccuggggcuggagacgcgcaccgagaccuggaugagcuccgagggcgccuggaagcagauccagcgggucgagaccugggcccuccgccaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcggugcugcggaagcucugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacaccggcgaccagcaccagguggggaacgaguccacggagcacggcaccaccgcgaccaucacgccccaggcccccacgaccgagauccagcucaccgacuacggggcccugacccuggacugcagcccccgcacgggccucgacuucaacgagaugguccugcugaccaugaaggagaaguccuggcucgugcacaagcagugguuccuggaccugccccuccccuggaccagcggggccagcaccucccaggagacguggaaccggcaggaccugcuggugaccuucaagaccgcccacgcgaagaagcaggaggucguggugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgucaugugcaccggguccuucaagcucgagaaggagguggcggagacgcagcacggcaccgugcugguccagaucaaguacgagggcaccgacgcccccugcaagauccccuucagcacccaggacgagaagggggugacgcagaacggccggcugaucaccgccaacccgaucgugaccgacaaggagaagcccgucaacaucgaggccgagccgcccuucggggaguccuacaucgugaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcgucgggaagcuggugcaccagaucuucggcaccgccuacgggguccucuucuccggcgucagcuggaccaugaagaucgggaucggcgugcugcugacguggcucggccugaacucccgcagcaccucccugagcaugaccugcaucgccguggggcucgucacccuguaccugggcgugauggugcaggccgacuccgggugcgucaucaacuggaagggccgggagcucaagugcgggagcggcaucuucgugacgaacgaggugcacaccuggaccgagcaguacaaguuccaggcggacagcccgaagcgccuguccgccgccaucggcaaggccugggaggagggggucugcggcauccggagcgccacccgccuggagaacaucauguggaagcagaucuccaacgagcucaaccacauccugcuggagaacgacaugaagcucaccgugguggucggggacguggcgggcauccuggggcagggcaagaagaugauccggccccagcccauggaguacaaguacagcuggaaguccuggggcaaggccaagaucaucggggccgacgcccagaacacgaccuucaucaucgacggccccaacaccccggagugccccgacgaccagcgcgcguggaacaucugggagguggaggacuacggguucggcaucuucaccacgaacaucuggcugaagcuccgggacagcuacacccaggucugcgaccaccgccugauguccgccgccaucaaggacagcaaggccgugcacgccgacaugggcuacuggaucgaguccgagaagaacgagaccuggaagcuggcgcgggccagcuucaucgaggugaagaccugcaucuggcccaagucccacacgcucuggagcaacgggguccuggaguccgagaugaucauccccaagaucuacggcgggccgaucagccagcacaacuaccgccccggcuacuucacccagaccgccgggcccuggcaccugggcaagcucgagcuggacuucgaccugugcgagggcaccacggugguggucgacgagcacugcgggaaccggggcccgucccuccgcaccaccaccgugacggggaagaucauccacgaguggugcugccggagcugcacccugccgccccugcgcuuccggggcgaggacgggugcugguacggcauggagauccgccccgugaaggagaaggaggagaaccucgucaaguccauggugagcgccggcagcggggagguggacuccuucagccugggccugcucugcaucuccaucaugaucgaggaggucaugcggagccgcuggucccggaagaugcugaugaccgggacccuggccguguucuuccuccugaucaugggccagcugacguggaacgaccucauccgccugugcaucauggugggggcgaacgccagcgaccgcaugggcaugggcaccaccuaccuggcccucauggccaccuucaagaugcggccgauguucgccgucgggcugcuguuccgccggcucacgucccgcgaggugcugcugcucaccaucggccugagccugguggcguccgucgagcuccccaacagccuggaggagcugggggacggccucgccaugggcaucaugauccugaagcugcucaccgacuuccagucccaccagcugugggccacccugcucagccugacguucaucaagaccaccuucucccugcacuacgccuggaagaccauggcgauggugcucagcaucgucucccuguucccccugugccucagcacgaccucccagaagaccaccuggcugcccgugcugcucgggagccugggcugcaagccgcugacgauguuccucaucgccgagaacaagaucugggggcggaaguccuggccccugaacgagggcaucauggccguggggaucgucagcauccugcucagcucccugcugaagaacgacgugccccucgccggcccccugaucgccggcgggaugcugaucgcgugcuacgugaucagcggcuccagcgccgaccucucccuggagaaggccgccgaggucagcugggaggaggaggccgagcacuccggggcgagccacaacauccugguggaggugcaggacgacggcaccaugaagaucaaggacgaggagcgcgacgacacccucaccauccugcugaaggccacccuccuggccgucuccgggguguacccgcugagcauccccgccacccucuucgugugguacuucuggcagaagaagaagcagcgguccggcguccugugggacacccccagcccgcccgagguggagcgcgccgugcuggacgacggcaucuaccggaucaugcagcgcgggcugcucggccggucccaggucggggugggcguguuccaggagaacgucuuccacaccauguggcacgugacccgcggggcggugcugauguaccagggcaagcggcuggagcccagcugggccuccgucaagaaggaccucaucagcuacggcgggggcuggcgccugcggggguccuggaacacgggcgaggagguccaggugaucgccgucgagcccgggaagaaccccaagaacgugcagaccgcccccggcaccuucaagacccccgagggcgaggugggggccaucgcgcuggacuucaagcccggcacgagcgggucccccaucgucaaccgcgagggcaagaucgugggccucuacgggaacggcguggucaccaccagcgggaccuacgugagcgccaucgcccaggccaaggcgucccaggagggcccgcugcccgagaucgaggacgagguguuccggaagcgcaaccugacgaucauggaccuccaccccgggagcggcaagacccggcgcuaccugccggccaucguccgggaggccaucaagcgcaagcugcgcacccucauccuggcccccacccgggugguggccuccgagauggcggaggcccugaagggcaugcccauccgcuaccagacgaccgccgucaagagcgagcacaccgggaaggagaucguggaccucaugugccacgccaccuucacgaugcggcugcugucccccgugcgcgucccgaacuacaacaugaucaucauggacgaggcccacuucaccgaccccagcuccaucgcggcccggggcuacaucagcacccgcguggggaugggcgaggccgccgccaucuucaugaccgcgacgccgcccggguccguggaggccuucccgcagagcaacgccgucauccaggacgaggagcgggacauccccgagcgcuccuggaacagcggcuacgaguggaucaccgacuuccccggcaagaccgugugguucgugcccuccaucaagagcgggaacgacaucgccaacugccuccggaagaacggcaagcgcgucauccagcugucccggaagaccuucgacacggaguaccagaagaccaagaacaacgacugggacuacguggugaccaccgacaucagcgagaugggggcgaacuuccgcgccgaccgggucaucgacccgcgccggugccugaagcccgugauccucaaggacggccccgagcgcgugauccuggccgggcccaugccggucacgguggccuccgccgcgcagcggcgcggccggaucggccgcaaccacaacaaggagggggaccaguacaucuacaugggccagccccugaacaacgacgaggaccacgcccacuggaccgaggccaagaugcuccuggacaacaucaacacccccgaggggaucauccccgcccuguucgagccggagcgcgagaaguccgccgcggucgacggcgaguaccggcuccgcggggaggcccggaagaccuucguggagcugaugcgccggggcgaccugcccguguggcucuccuacaaggucgccagcgagggcuuccaguacagcgaccgccgguggugcuucgacggggagcgcaacaaccaggugcuggaggagaacauggacguggagaucuggacgaaggagggcgagcggaagaagcugcgcccccgguggcucgacgcccgcaccuacuccgacccccuggcccugcgggaguucaaggaguucgcggccgggcgccggagcgucuccggcgaccucauccuggagaucggcaagcugccgcagcaccucacccagcgcgcccagaacgcccuggacaaccuggugaugcuccacaacagcgagcagggcgggcgggcguaccgccacgccauggaggagcugcccgacaccaucgagacgcugaugcuccuggcccugaucgccgugcucaccgggggcgucacccuguucuuccuguccgggcggggccucggcaagaccagcaucgggcugcugugcgugauggccuccagcgugcuccuguggauggcguccgucgagccccacuggaucgccgccagcaucauccuggaguucuuccucauggugcugcugauccccgagccggaccgccagcggacgccccaggacaaccagcucgccuacguggucaucggccugcuguucaugauccucacgguggccgcgaacgagauggggcugcuggagaccaccaagaaggaccucggcaucgggcacguggccgucgagaaccaccaccacgccgccaugcuggacguggaccugcaccccgccuccgcguggacccucuacgccguggccacgaccaucaucaccccgaugaugcgccacaccaucgagaacacgaccgccaacaucagccugaccgccaucgcgaaccaggccgccauccugaugggccucgacaagggcuggcccaucuccaagauggacaucggggucccccugcuggcccucggcugcuacagccaggugaacccccugacccugacggcggccgugcucaugcuggucgcccacuacgccaucaucgggccgggccugcaggccaaggcgacccgcgaggcccagaagcggaccgccgccgggaucaugaagaaccccaccguggacggcaucguggccaucgaccucgaccccgucguguacgacgcgaaguucgagaagcagcugggccagaucaugcugcucauccugugcacgucccagauccugcucaugcgcaccaccugggcccugugcgagagcaucacccuggccacggggccccucaccacccugugggagggcuccccggggaaguucuggaacaccacgaucgccgugagcauggccaacaucuuccggggcuccuaccuggcgggcgccgggcucgccuucagccugaugaagucccugggcgggggccgccgggggaccggcgcccagggcgagacccucggggagaaguggaagcgccagcugaaccagcuguccaagagcgaguucaacaccuacaagcgguccggcaucauggaggucgaccgcagcgaggcgaaggaggggcucaagcggggcgagacgaccaagcacgccgugucccgcgggaccgccaagcugcggugguucguggagcgcaaccuggucaagcccgagggcaaggugaucgaccugggcugcgggcggggcggguggagcuacuacugcgccggccucaagaaggugaccgaggucaagggguacacgaagggcggccccgggcacgaggagcccaucccgauggccaccuacggcuggaaccuggugaagcugcacuccgggaaggacguguucuucaucccgcccgagaagugcgacacccuccugugcgacaucggcgagagcucccccaacccgaccaucgaggaggggcgcacgcugcggguccucaagaugguggagcccuggcugcgcggcaaccaguucugcaucaagauccugaaccccuacaugcccagcguggucgagacccucgagcagaugcagcggaagcacggcgggaugcuggugcgcaacccgcugucccggaacagcacccacgagauguacuggguguccugcggcaccgggaacaucgucagcgcggugaacaugaccucccgcaugcuccugaaccgcuucacgauggcccaccggaagcccaccuacgagcgcgacguggaccugggcaccggcacccggcacgucgccguggagcccgagguggccaaccucgacaucaucgggcagcgcaucgagaacaucaagcacgagcacaagagcacguggcacuacgacgaggacaaccccuacaagaccugggccuaccacggcuccuacgaggucaagccgagcggguccgcgagcagcauggugaacggcgucgugaagcugcugaccaagcccugggacgugauccccauggucacccagaucgccaugacggacaccacccccuucgggcagcagcggguguucaaggagaagguggacacccgcacgccgaaggccaagcggggcaccgcccagaucauggaggucaccgcccgcuggcucuggggcuuccugucccggaacaagaagccccgcaucugcacccgggaggaguucacgcgcaaggugcggagcaacgcggccaucggggccguguucgucgacgagaaccaguggaacuccgccaaggaggcgguggaggacgagcgcuucugggaccuggugcaccgggagcgcgagcuccacaagcagggcaagugcgcgaccugcgucuacaacaugauggggaagcgggagaagaagcugggcgaguucgggaaggccaagggcagccgcgccaucugguacauguggcugggcgcccgguuccucgaguucgaggcgcugggguucaugaacgaggaccacugguucucccgcgagaacagccuguccggcguggagggggagggccuccacaagcugggguacauccugcgggacaucagcaagauccccggcggcaacauguacgccgacgacaccgccgggugggacacccgcaucacggaggacgaccuccagaacgaggccaagaucaccgacaucauggagccggagcacgcccugcuggcgaaggccaucuucaagcucaccuaccagaacaaggugguccgcgugcagcggcccgccaagaacggcaccgugauggacgucaucucccgccgggaccagcgcgggagcggccaggugggcacguacgggcugaacaccuucaccaacauggaggcccagcugauccggcagauggaguccgagggcaucuucagccccuccgagcucgagacccccaaccuggccgagcgcgcgcuggacuggcucgagaaguacgggguggagcggcugaagcgcauggccaucagcggcgacgacugcgucgugaagccgaucgacgaccgguucgccacggcccugaccgcccucaacgacauggggaaggugcgcaaggacaucccccagugggagcccuccaagggcuggaacgacuggcagcagguccccuucugcagccaccacuuccaccagcugaucaugaaggacggccgggagaucguggugccgugccgcaaccaggacgagcuggucgggcgggcgcgcgugucccagggcgccggguggagccuccgggagaccgccugccugggcaagagcuacgcccagauguggcagcugauguacuuccaccgccgggaccuccgccuggcggccaacgccaucugcuccgccgugcccgucgacugggugcccaccagccggacgaccugguccauccacgcccaccaccaguggaugaccaccgaggacaugcugagcguguggaaccgcgucuggaucgaggagaaccccuggauggaggacaagacgcacaucuccagcugggaggacgugccguaccucgggaagcgcgaggaccaguggugcggcucccugaucggccugaccgcgcgggccaccugggccaccaacauccagguggccaucaaccagguccgccggcucaucgggaacgagaacuaccuggacuacaugaccagcaugaagcgcuucaagaacgaguccgaccccgagggcgcccugugguga

SEQ ID NO: 8459 - RNA, 9879 nt, Artificial Sequence
  derived and/or modified CDS sequence (opt1) from DENV-1__FJ882537__SS-prME
agcgugaccaugcugcucaugcugaugcccaccgcccuggccuuccaccucaccacccggggcggggagccccacaugaucguguccaagcaggagcggggcaagagccugcuguucaagaccuccgccggggugaacaugugcacccucaucgccauggaccugggcgagcugugcgaggacaccaugaccuacaagugcccccggaucaccgagguggagcccgacgacguggacugcuggugcaacaccaccgacaccugggugaccuacgggaccugcagccagacgggcgagcaccggcgcgacaagcgguccguggcccucgcgccccacgucggccuggggcuggagacccgggccgagaccuggaugagcuccgagggcgcguggaagcagauccagaagguggagaccugggcccuccggcaccccggguucacggugaucgcccuguuccuggcccacgcgaucggcaccagcaucacccagaaggggaucaucuucauccuccugaugcuggucacccccuccauggccaugcgcugcgugggcaucggcagccgggacuucguggaggggcucuccggcgccacgugggucgacguggugcuggagcacgggagcugcgucaccaccauggccaaggacaagcccacccuggacaucgagcuccugaagacggaggugaccaaccccgccgugcugcgcaagcucugcaucgaggcgaagaucuccaacaccaccacggacagccggugcccgacccagggcgaggccacccuggucgaggagcaggacgccaacuucgugugccgccggaccuucguggaccgcggcugggggaacggcugcgggcuguucggcaaggggucccucaucacgugcgccaaguucaagugcgucaccaagcuggagggcaagaucgugcaguacgagaaccugaaguacagcgugaucgucaccgugcacaccggcgaccagcaccaggucgggaacgaguccacggagcacggcaccaucgccaccaucacgccccaggcgcccaccagcgagauccagcucacggacuacggggcccugacccuggacugcagcccccggaccggccucgacuucaacgagauggugcugcugaccaugaaggagaaguccuggcucgugcacaagcagugguuccuggaccugccccuccccuggacgagcggggccuccaccagccaggagaccuggaaccgccaggaccugcuggucaccuucaagacggcccacgccaagaagcaggagguggugguccucggcucccaggagggcgcgaugcacaccgcccugaccggggccaccgagauccagacgaccggcaccaccacgaucuucgccgggcaccugaagugccggcucaagauggacaagcugacccugaagggcaugagcuacgugaugugcaccggguccuucaagcucgagaaggagguggccgagacccagcacggcacgguccuggugcagaucaaguacgagggcaccgacgcgcccugcaagauccccuucagcacccaggacgagaagggggugacccagaacggccgccugaucacggccaacccgaucgucaccgacaaggagaagcccgugaacaucgaggccgagccgcccuucggggaguccuacaucgugaucggcgccggcgagaaggcgcugaagcucagcugguucaagaagggguccagcaucggcaagauguucgaggccaccgcccgcggggcccgccggauggccauccugggcgacaccgcgugggacuucggguccaucggcggcgucuucacgagcguggggaagcuggugcaccagaucuucggcaccgccuacgggguccucuucuccggcgugagcuggaccaugaagaucgggaucggcgugcugcugaccuggcucggccugaacucccgcagcacgucccugagcaugaccugcaucgccgucgggcucaucacccuguaccugggcgugauggugcaggccgacuccgggugcgucaucaacuggaagggccgcgagcucaagugcgggagcggcaucuucgugaccaacgaggugcacacguggaccgagcaguacaaguuccaggccgacagcccgaagcggcuguccgcggccaucggcaaggccugggaggagggggucugcggcauccgcagcgccacccggcuggagaacaucauguggcgccagaucuccaacgagcucaaccacauccugcuggagaacgacaugaaguucaccgugguggucggggacguggugggcauccucgcccaggggaagaagaugguccggccccagcccauggagcacaaguacagcuggaaguccuggggcaaggcgaagaucaucggcgccgacgugcagaacaccacguucaucaucgacgggcccaacaccccggagugccccgacgaccagcgcgccuggaacaucugggagguggaggacuacggcuucgggaucuucaccaccaacaucuggcugaagcugcgggacagcuacacgcaggucugcgaccaccgccucauguccgccgcgaucaaggacagcaaggccgugcacgccgacaugggcuacuggaucgaguccgagaagaacgagaccuggaagcuggcccgggccagcuucaucgaggugaagaccugcaucuggcccaagucccacacccuguggagcaacggcguccucgaguccgagaugaucauccccaagaucuacgggggcccgaucagccagcacaacuaccgccccggguacuucacgcagaccgcgggccccuggcaccuggggaagcuggagcucgacuucgaccugugcgagggcaccaccgugguggucgacgagcacugcggcaaccgggggccgucccugcgcacgaccaccgugaccggcaagaucauccacgaguggugcugccggagcugcacgcugccgccccuccgcuucaagggggaggacggcugcugguacgggauggagauccggcccgugaaggagaaggaggagaaccuggucaaguccauggugagcgccggcagcggcgagguggacuccuucagccucgggcugcugugcaucuccaucaugaucgaggaggucaugcgcagccgguggucccgcaagaugcucaugaccggcacccuggccguguucuuccugcucaucauggggcagcugaccuggaacgaccugauccggagcugcaucauggugggcgccaacgccuccgaccgcauggggaugggcacgaccuaccucgcgcugauggccaccuucaagaugcgcccgauguucgccgucggccugcuguuccggcgccugaccagccgggaggugcugcuccugacgaucgggcugucccucgucgccagcguggagcugcccaacucccuggaggagcucggcgacgggcuggccaugggcaucaugauccugaagcuccugaccgacuuccagagcuaccagcugugggcgacccuccugucccugaccuucaucaagacgaccuucagccuccacuacgccuggaagaccauggccauggugcuguccaucgucagccugcucccccugugccuguccaccacgagccagaagaccaccuggcuccccgugcugcugggcucccucgggugcaagccgcugaccauguuccugaucgccgagaacaagaucuggggccgcaagagcuggccccucaacgaggggaucauggcggugggcaucgucagcauccugcuguccagccuccugaagaacgacgugccccuggccgggccccucaucgccggcggcaugcugaucgccugcuacgugaucuccgggagcuccgccgaccugagccucgagaaggcggccgaggucuccugggaggaggaggccgagcacagcggcgccucccacaacauccugguggaggugcaggacgacgggacgaugaagaucaaggacgaggagcgggacgacacccugaccauccuccugaaggccacccugcucgcggucagcggcguguacccgcuguccauccccgccacccuguucgugugguacuucuggcagaagaagaagcagcgcagcgggguccucugggacacgcccagcccgcccgagguggagcgggccgugcuggacgacggcaucuaccgcaucaugcagcggggccugcuggggcgcagccaggucggcguggggguguuccaggagaacgucuuccacaccauguggcacgugacccggggcgccgugcucauguaccaggggaagcgccuggagcccuccugggccagcgucaagaaggaccugaucuccuacggcggcggguggcggcuccagggcagcuggaacaccggggaggagguccaggugaucgcggucgagcccggcaagaaccccaagaacgugcagacggcccccgggaccuucaagacccccgagggcgaggugggcgccaucgcccuggacuucaagcccgggaccuccggcagccccaucgucaaccgcgaggggaagaucgugggccuguacggcaacgggguggucacgaccagcggcaccuacguguccgccaucgcgcaggccaaggccagccaggaggggccgcuccccgagaucgaggacgagguguuccggaagcgcaaccugaccaucauggaccugcaccccggcuccgggaagacgcggcgcuaccucccggccaucguccgggaggcgaucaagcgcaagcugcggacccugauccucgcccccacccgcgugguggccagcgagauggccgaggcccugaagggcaugcccauccgcuaccagaccacggcggucaaguccgagcacaccggccgggagaucguggaccugaugugccacgccaccuucaccaugcgccuccugagccccgugcgggucccgaacuacaacaugaucaucauggacgaggcccacuucacggaccccuccagcaucgccgcccgcggguacaucuccacccgggugggcaugggggaggcggccgccaucuucaugaccgccacgccgcccggcagcguggaggccuucccgcaguccaacgcggucauccaggacgaggagcgcgacauccccgagcggagcuggaacuccggguacgaguggaucacggacuuccccggcaagaccgugugguucgugcccagcaucaaguccggcaacgacaucgccaacugccugcgcaagaacgggaagcgggucauccagcucagccgcaagaccuucgacaccgaguaccagaagacgaagaacaacgacugggacuacguggugaccaccgacaucuccgagaugggcgccaacuuccgggccgaccgcgucaucgacccgcggcgcugccugaagcccgugauccugaaggacgggcccgagcgggucauccucgcgggccccaugccggugaccguggccagcgccgcccagcgccgggggcgcaucggccggaaccacaacaaggagggcgaccaguacaucuacauggggcagccccugaacaacgacgaggaccacgcccacuggacggaggcgaagaugcugcucgacaacaucaacacccccgagggcaucauccccgcccuguucgagccggagcgcgagaaguccgccgccaucgacggggaguaccgccugcggggcgaggcccgcaagaccuucgucgagcucaugcggcgcggggaccugcccguguggcugagcuacaagguggcgagcgagggcuuccaguacuccgaccggcgcuggugcuucgacggcgagcggaacaaccagguccucgaggagaacauggacguggagaucuggaccaaggagggggagcgcaagaagcugcggccccgcuggcuggacgcccggacguacagcgacccccucgcccugcgcgaguucaaggaguucgccgccggccggcgcuccgugagcggggaccugauccucgagaucggcaagcugccgcagcaccugacccagcgggcgcagaacgcccucgacaaccuggucaugcugcacaacuccgagcagggcgggcgcgccuaccggcacgccauggaggagcuccccgacaccaucgagacccugaugcugcucgcgcugaucgccgugcugacgggcggggugacccucuucuuccugagcggccgcgggcugggcaagaccuccaucggccuccugugcgucauggccagcuccgcccugcucuggauggccagcguggagccccacuggaucgcggccuccaucauccuggaguucuuccugauggugcuccugauccccgagccggaccggcagcgcacgccccaggacaaccagcuggccuacgucgugaucgggcuccuguucaugauccugaccguggccgccaacgagaugggccuccuggagacgaccaagaaggaccuggggaucggccacgucgcgguggagaaccaccaccacgccaccaugcucgacguggaccugcaccccgccagcgccuggacccuguacgccgucgcgacgaccaucaucaccccgaugaugcggcacaccaucgagaacacgaccgccaacaucucccucaccgccaucgccaaccaggccgcgauccugauggggcuggacaagggcuggcccaucagcaagauggacaucggcgugccccuccuggcccuggggugcuacucccaggugaacccccucacccugacggccgccguccugaugcucguggcgcacuacgccaucaucggcccggggcugcaggccaaggccacccgcgaggcccagaagcgcaccgcggccggcaucaugaagaaccccaccguggacgggaucgucgccaucgaccuggaccccgugguguacgacgccaaguucgagaagcagcucggccagaucaugcugcugauccucugcacgagccagauccugcugaugcggaccaccugggcccucugcgaguccaucacccuggcgacgggcccccugaccacccucugggaggggagcccgggcaaguucuggaacaccacgaucgccgucuccauggccaacaucuuccgcgggagcuaccuggccggcgccggccuggcguucagccucaugaagucccucgggggcgggcggcgcgggaccggggcccagggcgagacccugggcgagaaguggaagcggcagcucaaccagcugagcaaguccgaguucaacaccuacaagcgcagcgggaucauggagguggaccgguccgaggccaaggagggccugcgccgcggggagacgaccaagcacgccgugagccgcggcaccgcgaagcuccggugguucgucgagcgcaaccuggugaagcccgaggggaaggugaucgaccugggcugcggccgcggcgggugguccuacuacugcgccgggcugaagaaggucaccgaggugaagggguacacgaagggcggccccggccacgaggagcccaucccgauggccaccuacggguggaaccucgugaagcugcacagcggcaaggacgucuucuucaucccgcccgagaagugcgacacccugcucugcgacaucggggaguccagccccaacccgaccaucgaggagggccgcacgcugcgggugcugaagaugguggagcccuggcuccgcgggaaccaguucugcaucaagauccugaaccccuacaugcccuccgucguggagacccuggagcacaugcagcggaagcacggcggcaugcucgugcgcaacccgcugagccggaacuccacccacgagauguacugggucagcugcgggaccggcaacaucguguccgccgugaacaugaccagccgcaugcugcucaaccgcuucacgauggcccaccggaagcccaccuacgagcgcgacgucgaccugggggcgggcacccggcacguggccguggagcccgaggucgccaaccuggacaucaucggccagcgcaucgagaacaucaagcacgagcacaaguccaccuggcacuacgacgaggacaaccccuacaagacgugggccuaccacgggagcuacgaggugaagccguccggcagcgccagcuccauggucaacgggguggugaagcuccugaccaagcccugggacgucauccccauggugacccagaucgcgaugaccgacacgacccccuucggccagcagcggguguucaaggagaaggucgacacccgcaccccgaaggccaagcgggggacggcccagaucauggaggugaccgcccgcuggcuguggggcuuccucagccggaacaagaagccccgcaucugcacccgggaggaguucacccgcaaggugcgguccaacgccgcgaucggcgccgucuucguggacgagaaccaguggaacagcgccaaggaggccguggaggacgagcgcuucugggaccugguccaccgggagcgcgagcugcacaagcaggggaagugcgcgacgugcguguacaacaugaugggcaagcgggagaagaagcucggggaguucggcaaggccaaggggucccgcgccaucugguacauguggcugggcgcccgguuccuggaguucgaggcccucggcuucaugaacgaggaccacugguucagccgcgagaacucccugagcgggguggagggcgaggggcugcacaagcucggcuacauccugcgggacaucuccaagauccccgggggcaacauguacgcggacgacaccgccggcugggacacccgcaucaccgaggacgaccugcagaacgaggccaagaucacggacaucauggagccggagcacgcccuccuggccaccagcaucuucaagcugaccuaccagaacaaggucgugcgcgugcagcggcccgcgaagaacgggaccgucauggacgugaucucccgccgggaccagcgcggcagcggccaggugggcacguacggccucaacaccuucaccaacauggaggcccagcugauccggcagauggaguccgaggggaucuucagccccuccgagcuggagacccccaaccucgccgagcgcguccuggacuggcuggagaaguacggcguggagcggcucaagcgcauggccaucagcggggacgacugcguggucaagccgaucgacgaccgguucgccacggcgcugaccgcccugaacgacaugggcaaggugcgcaaggacaucccccagugggagcccuccaagggguggaacgacuggcagcagguccccuucugcagccaccacuuccaccagcucaucaugaaggacggccgggagaucgucgugccgugccgcaaccaggacgagcuggugggccgggcccgcgucagccagggggccggcuggucccugcgggagaccgccugccucgggaaguccuacgcgcagauguggcagcugauguacuuccaccgccgggaccugcgccucgccgccaacgccaucugcuccgcggugcccguggacuggguccccaccagccggacgaccugguccauccacgcccaccaccaguggaugaccaccgaggacaugcugagcguguggaaccgcguguggaucgaggagaaccccuggauggaggacaagacgcacaucuccagcuggggcgacgucccguaccuggggaagcgcgaggaccaguggugcggcucccucaucggccugaccgcccgggccaccugggccaccaacauccagguggcgaucaaccaggugcgccggcugaucgggaacgagaacuaccucgacuacaugaccagcaugaagcgcuucaagaacgaguccgaccccgagggcgcccugugguga

SEQ ID NO: 8460 - RNA, 9879 nt, Artificial Sequence
  derived and/or modified CDS sequence (opt1) from DENV-1__GQ868606__SS-prME
agcgugaccaugcugcucaugcugaugcccaccgcccuggccuuccaccucacgacccggggcggggagccccacaugaucgugagcaagcaggagcggggcaagagccugcuguucaagaccagcgcgggggugaacaugugcacccucaucgccauggaccugggcgaguucugcgaggacacgaugaccuacaagugcccccgcaucaccgaggccgagcccgacgacguggacugcuggugcaacgccaccgacacgugggugaccuacgggaccugcagccagaccggcgagcaccggcgggacaagcgguccguggcccuggcgccccacgugggccucgggcuggagacgcgcaccgagaccuggaugagcuccgagggcgccuggaagcagauccagcggguggagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugcccgacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaagaccguccaguacgagaaccugaaguacagcgugaucgugaccguccacacgggcgaccagcaccagguggggaacgaguccaccgagcacggcaccaccgcgaccaucacgccccaggcccccagcaccgagauccagcugaccgacuacggggcccucacccuggacugcagcccccggacgggccuggacuucaacgagaugguccuccugaccaugaaggagaaguccuggcuggugcacaagcagugguuccucgaccugccgcugcccuggaccagcggggccuccaccagccaggagacguggaaccggaaggaccuccuggugaccuucaagaccgcccacgcgaagaagcaggaggucguggugcugggcucccaggagggcgccaugcacaccgcccucacgggggccaccgagauccagaccagcggcaccacgaccaucuucgccgggcaccugaagugccgccugaagauggacaagcucacccugaagggcauguccuacgucaugugcaccgggagcuucaagcuggagaaggagguggcggagacgcagcacggcaccgugcucguccagaucaaguacgagggcaccgacgcccccugcaagauccccuucuccacccaggacgagaagggggugacgcagaacggccggcugaucaccgccaacccgaucgugaccgacaaggagaagcccgucaacaucgaggccgagccgcccuucggggagagcuacaucgugaucggcgcgggcgagaaggcccugaagcuguccugguucaagaaggggagcuccaucggcaagauguucgaggccaccgcccgcggggcccggcgcauggcgauccucggcgacacggccugggacuucgggagcaucggcggcguguucaccuccgucgggaagcuggugcaccagaucuucggcaccgccuacggggugcuguucagcggcgucuccuggaccaugaagaucgggaucggcgugcuccugacguggcugggccucaacagccgcuccaccagccuguccaugaccugcaucgccguggggcuggucacccucuaccugggcgugauggugcaggccgacagcgggugcgucaucaacuggaagggccgggagcugaagugcgggagcggcaucuucgugacgaacgaggugcacaccuggaccgagcaguacaaguuccaggcggacuccccgaagcgccucagcgccgccaucggcaaggccugggaggagggggucugcggcauccgguccgccacccgccuggagaacaucauguggaagcagaucagcaacgagcugaaccacauccuccuggagaacgacaugaaguucaccgugguggucggggacguggcgggcauccuggcccaggggaagaagaugauccggccccagcccauggaguacaaguacuccuggaaguccuggggcaaggccaagaucaucggcgccgacgugcagaacacgaccuucaucaucgacgggcccaacaccccggagugccccgacgaccagcgcgcguggaacaucugggaggucgaggacuacggcuucgggaucuucaccacgaacaucuggcucaagcugcgggacuccuacacccaggugugcgaccaccgccugaugagcgccgccaucaaggacuccaaggccgugcacgccgacaugggcuacuggaucgagagcgagaagaacgagaccuggaagcucgcgcgggccuccuucaucgaggucaagaccugcaucuggcccaagagccacacgcugugguccaacggcgugcuggagagcgagaugaucauccccaagaucuacgggggcccgaucucccagcacaaccaccgccccggguacuucacccagaccgccggccccuggcaccucgggaagcuggagcuggacuucgaccucugcgagggcaccacgguggucguggacgagcacugcggcaaccgggggccgagccugcgcaccaccaccgugacgggcaagaucauccacgaguggugcugccgguccugcacccugccgccccugcgcuucaagggggaggacggcugcugguacgggauggagauccggcccgucaaggagaaggaggagaaccuggucaagagcauggugagcgccggcuccggcgaggucgacagcuucucccuggggcuccugugcaucagcaucaugaucgaggaggugaugcgcucccgguggagccgcaagaugcugaugaccggcacccucgccguguucuuccugcugaucauggggcagcucacguggaacgaccugauccggcugugcaucauggucggcgcgaacgccuccgaccgcauggggaugggcaccaccuaccucgcccugauggccaccuucaagaugcgcccgauguucgccguggggcuccuguuccggcgccugacgagccgggaggugcugcuccugaccaucgggcugucccucgucgcgagcguggagcugcccaacucccuggaggagcucggcgacgggcuggccaugggcaucaugauccugaagcuccugaccgacuuccagagccaccagcugugggccacccuccugucccugacguucaucaagaccaccuucagccuccacuacgccuggaagaccauggcgaugguccuguccaucgugagccuguucccccucugccuguccacgaccagccagaagaccaccuggcugcccgugcuccugggcucccuggggugcaagccgcucacgauguuccugaucgccgagaacaagaucuggggccgcaagagcuggccccugaacgaggggaucauggccgucggcaucgugagcauccuccuguccagccugcucaagaacgacgugccccuggccgggccccugaucgccggcggcaugcucaucgcgugcuacgucaucuccgggagcuccgccgaccugagccuggagaaggccgccgagguguccugggaggaggaggccgagcacagcggcgcgucccacaacauccucguggagguccaggacgacgggaccaugaagaucaaggacgaggagcgggacgacacccugaccauccugcucaaggccacccugcuggccgugagcggcguguacccgcucuccauccccgccacgcuguucgucugguacuucuggcagaagaagaagcagcgcagcggggugcugugggacacccccagcccgcccgagguggagcgggccguccucgacgacggcaucuaccgcaucaugcagcggggccugcuggggcgcagccaggugggcgugggggucuuccaggagaacguguuccacaccauguggcacgugacccggggcgcgguccugauguaccaggggaagcgccucgagcccuccugggccagcgugaagaaggaccugaucuccuacggcggcggguggcggcugcagggcagcuggaacacgggggaggaggugcaggucaucgccguggagcccggcaagaaccccaagaacgugcagaccgcccccgggaccuucaagaccuccgagggcgaggucggcgccaucgcgcucgacuucaagcccgggacgagcggcagccccaucgugaaccgcgaggggaagaucgugggccuguacggcaacggggucgugaccaccuccggcaccuacgugagcgccaucgcccaggccaaggcgucccaggaggggccccugccggagaucgaggacgaggucuuccggaagcgcaaccucacgaucauggaccugcaccccggcagcgggaagacccggcgcuaccugcccgccaucgugcgggaggccaucaagcgcaagcuccggacccugauccuggccccgacccgcguggucgccuccgagauggcggaggcccucaagggcaugcccauccgcuaccagacgaccgccgucaagagcgagcacaccggcaaggagaucguggaccugaugugccacgccaccuucacgaugcggcugcucucccccguccgcgugcccaacuacaacaugaucaucauggacgaggcccacuucaccgacccgagcuccaucgcggcccggggguacaucagcacccgcgugggcaugggggaggccgccgccaucuucaugaccgcgacgccgcccggcuccgucgaggccuucccccagagcaacgccgugauccaggacgaggagcgggacaucccggagcgcuccuggaacagcggguacgaguggaucaccgacuuccccggcaagaccgugugguucguccccuccaucaagagcggcaacgacaucgccaacugccugcggaagaacgggaagcgcgugauccagcugucccggaagaccuucgacacggaguaccagaagaccaagaacaacgacugggacuacguggucaccaccgacaucagcgagaugggcgcgaacuuccgcgccgaccgggugaucgacccccgccggugccucaagccggugauccugaaggacgggcccgagcgcgucauccuggccggccccaugcccgugacggucgccuccgccgcgcagcggcgcgggcggaucggccgcaaccacaacaaggagggcgaccaguacaucuacauggggcagccgcucaacaacgacgaggaccacgcccacuggaccgaggccaagaugcugcuggacaacaucaacacccccgagggcaucauccccgcccucuucgagcccgagcgggagaaguccgccgcgaucgacggggaguaccgccugcgcggcgaggcccggaagaccuucguggagcugaugcgccgcggggaccucccgguguggcugagcuacaaggucgccuccgagggcuuccaguacagcgaccgccgguggugcuucgacggcgagcgcaacaaccaggugcuggaggagaacauggacguggagaucuggacgaaggagggggagcggaagaagcuccgcccccgguggcuggacgcccgcaccuacuccgacccccuggcccuccgggaguucaaggaguucgcggccggccgccggagcgucuccggggaccugauccuggagaucggcaagcucccccagcaccugacccagcgcgcccagaacgcccuggacaaccucgugaugcugcacaacagcgagcagggcgggcgggcguaccgccacgccauggaggagcugccggacaccaucgagacgcucaugcugcuggcccucaucgccgugcugaccggcggggucacccuguucuuccucuccggccgggggcugggcaagaccagcaucggccugcucugcgugauggccuccagcgugcugcuguggauggcguccgucgagccccacuggaucgccgccagcaucauccucgaguucuuccugauggugcugcucauccccgagcccgaccgccagcggaccccgcaggacaaccagcuggccuacguggucaucgggcuccucuucaugauccugacgguggccgcgaacgagaugggccugcucgagaccaccaagaaggaccuggggaucggccacguggccgucgagaaccaccaccacgccgccaugcuggacguggaccuccaccccgccuccgcguggacccuguacgccguggccacgaccaucaucacccccaugaugcgccacaccaucgagaacacgaccgccaacaucagccugaccgccaucgcgaaccaggccgccauccucauggggcuggacaagggcuggccgaucuccaagauggacaucggcgucccccugcucgcccuggggugcuacagccaggugaacccccugacccucacggcggccgugcugaugcuggucgcccacuacgccaucaucggccccgggcuccaggccaaggcgacccgggaggcccagaagcgcaccgccgccggcaucaugaagaacccgaccguggacgggaucguggccaucgaccuggaccccgucguguacgacgcgaaguucgagaagcagcugggccagaucaugcuccugauccugugcacgucccagauccuccugaugcgcaccaccugggcccugugcgagagcaucacccucgccacgggcccccugaccacccugugggaggggucccccggcaaguucuggaacaccacgaucgccgugagcauggccaacaucuuccgggggagcuaccucgcgggcgccggccuggccuucucccugaugaagucccucgggggcgggcgccggggcaccggggcccagggcgagacccugggcgagaaguggaagcgccagcugaaccagcucuccaagagcgaguucaacaccuacaagcgguccgggaucauggaggucgaccgcagcgaggcgaaggagggccugaagcgcggggagacgaccaagcacgccgugucccgcggcaccgccaagcugcggugguucguggagcgcaaccucgucaagccggaggggaaggugaucgaccugggcugcggccgcggcggguggagcuacuacugcgccgggcugaagaaggugaccgaggucaagggguacacgaagggcgggcccggccacgaggagcccauccccauggccaccuacggguggaaccuggugaagcuccacuccggcaaggacguguucuucaucccgcccgagaagugcgacacccugcugugcgacaucggggagagcucccccaaccccaccaucgaggagggccgcacgcuccggguccugaagaugguggagccguggcugcgcgggaaccaguucugcaucaagauccucaaccccuacaugcccagcguggucgagacccuggagcagaugcagcggaagcacggcggcaugcuggugcgcaacccccucucccggaacagcacccacgagauguacuggguguccugcgggaccggcaacaucgucagcgcggugaacaugaccucccgcaugcugcugaaccgguucacgauggcccaccgcaagccgaccuacgagcgcgacguggaccucggggccggcacccggcacgucgccguggagcccgagguggccaaccuggacaucaucggccagcgcaucgagaacaucaagcacgagcacaagagcaccuggcacuacgacgaggacaaccccuacaagacgugggcguaccacggguccuacgaggucaagcccagcggcagcgccuccagcauggugaacggggucgugaagcugcucaccaagccgugggacgugauccccauggucacccagaucgccaugaccgacacgacccccuucggccagcagcggguguucaaggagaagguggacacccgcacccccaaggccaagcgggggacggcccagaucauggaggucaccgcgaaguggcuguggggcuuccugucccgcaacaagaagccgcggaucugcacccgcgaggaguucacccggaaggugcgcagcaacgccgccaucggcgccguguucgucgacgagaaccaguggaacuccgcgaaggaggccguggaggacgagcgguucugggaccucgugcaccgcgagcgggagcugcacaagcaggggaagugcgccacgugcgucuacaacaugaugggcaagcgcgagaagaagcugggggaguucggcaaggccaaggggagccgggccaucugguacauguggcucggcgcgcgcuuccuggaguucgaggcccugggcuucaugaacgaggaccacugguucucccgggagaacagccucuccgggguggagggcgaggggcugcacaagcugggcuacauccuccgcgacaucagcaagauccccgggggcaacauguacgccgacgacaccgccggcugggacacccggaucaccgaggacgaccugcagaacgaggccaagaucacggacaucauggagcccgagcacgcgcugcucgccaaguccaucuucaagcugaccuaccagaacaaggugguccgcgugcagcggccggcccgcaacgggaccgugauggacgucaucagccgccgggaccagcgcggcuccggccaggugggcaccuacggccugaacacguucaccaacauggaggcccagcucauccggcagauggagagcgaggggaucuucucccccagcgagcuggagacccccaaccuggccggccgcgugcucgacuggcuggagaagcacggggucgagcggcugaagcgcauggcgaucuccggcgacgacugcguggugaagcccaucgacgaccgguucgccaccgcccucacggcccugaacgacauggggaagguccgcaaggacaucccgcagugggagcccagcaagggcuggaacgacuggcagcagguccccuucugcagccaccacuuccaccagcugaucaugaaggacggccgggagaucgugguccccugccgcaaccaggacgagcucguggggcgggcccgcgugucccagggcgcgggguggagccugcgggagaccgccugccugggcaaguccuacgcccagauguggcagcucauguacuuccaccgccgggaccugcgccuggccgcgaacgccaucugcagcgccgucccgguggacugggugcccaccucccggaccacguggagcauccacgcccaccaccaguggaugaccaccgaggacaugcucuccgucuggaaccgcguguggaucgaggagaaccccuggauggaggacaagacccacaucagcuccuggggcgacgugcccuaccugggcaagcgggaggaccaguggugcggcagccugaucgggcucacggcccgcgcgaccugggccaccaacauccaggucgccaucaaccaggugcgccggcugaucggcaacgagaacuaccuggacuacaugaccuccaugaagcgcuucaagaacgagagcgacccggagggggcccucugguga

SEQ ID NO: 8461 - RNA, 9879 nt, Artificial Sequence
  derived and/or modified CDS sequence (opt1) from DENV-1__FJ882539__SS-prME
agcgugaccaugcugcucaugcugaugcccaccgcccuggccuuccaccucacgacccggggcggggagccccacaugaucguguccaagcaggagcggggcaagagccugcuguucaagaccuccgccggggugaacaugugcacccucaucgccauggaccugggcgaguucugcgaggacaccaugaccuacaagugcccccgcaucaccgaggccgagcccgacgacguggacugcuggugcaacgccaccgacacgugggucaccuacgggaccugcagccagaccggcgagcaccggcgggacaagcgguccguggcccuggcgccccacgugggccucgggcuggagacgcgcaccgagaccuggaugagcuccgagggcgccuggaagcagauccagcgggucgagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugcccgacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaagaccguccaguacgagaaccugaaguacagcgugaucgugaccguccacacgggcgaccagcaccagguggggaacgaguccaccgagcacggcaccaccgcgaccaucacgccccaggcccccagcaccgagauccagcugaccgacuacggggcccucacccuggacugcagcccccggacgggccuggacuucaacgagaugguccuccugaccaugaaggagaaguccuggcuggugcacaagcagugguuccucgaccugccgcugcccuggaccagcggggcccucgccucccaggagaccuggaaccggaaggaccugcuggugacguucaagaccgcgcacgccaagaagcaggaggucguggugcucggcagccaggagggcgccaugcacaccgcccugaccggggccacggagauccagaccuccggcaccaccacgaucuucgcggggcaccugaagugccgccucaagauggacaagcugacccugaagggcaugagcuacgucaugugcaccggguccuucaagcucgagaaggagguggccgagacccagcacggcacggugcugguccagaucaaguacgagggcaccgacgcccccugcaagauccccuucagcacccaggacgagaaggggaucacccagaacggccggcugaucacggccaacccgaucgugaccgacaaggagaagcccgugaacaucgaggcggagccgcccuucggggaguccuacaucgucaucggcgccggcgagaaggcccugaagcucagcugguucaagaagggguccagcaucggcaagauguucgaggccaccgcccgcggggcgcggcgcauggccauccugggcgacaccgccugggacuucggguccaucggcggcguguucacgagcguggggaagcugguccaccagaucuucggcaccgccuacggggugcuguucuccggcgugagcuggaccaugaagaucgggaucggcguccugcugaccuggcucggccugaacucccgcagcacgucccugagcaugaccugcaucgccguggggcucgugacccuguaccugggcgucauggugcaggcggacuccgggugcgugaucaacuggaagggccgggagcucaagugcgggagcggcaucuucgucaccaacgaggugcacacguggaccgagcaguacaaguuccaggccgacagcccgaagcgccuguccgccgccaucggcaaggccugggaggagggggugugcggcauccggagcgcgacccgccuggagaacaucauguggaagcagaucuccaacgagcucaaccacauccugcuggagaacgacaugaaguucaccgucguggugggggacgucgccggcauccucgcccaggggaagaagaugauccggccccagcccauggaguacaaguacagcuggaaguccuggggcaaggccaagaucaucggcgcggacgugcagaacaccacguucaucaucgacgggcccaacaccccggagugccccgacgaccagcgcgccuggaacaucugggagguggaggacuacggcuucgggaucuucaccaccaacaucuggcugaagcugcgggacagcuacacgcaggucugcgaccaccgccucauguccgccgccaucaaggacagcaaggccgugcacgcggacaugggcuacuggaucgaguccgagaagaacgagaccuggaagcuggcccgggccagcuucaucgaggugaagaccugcaucuggcccaagucccacacccuguggagcaacggcguccucgaguccgagaugaucauccccaagaucuacgggggcccgaucagccagcacaaccaccgccccggguacuucacgcagaccgccggccccuggcaccuggggaagcuggagcucgacuucgaccugugcgagggcaccaccgugguggucgacgagcacugcggcaaccgggggccgucccugcgcacgaccaccgugaccggcaagaucauccacgaguggugcugccggagcugcacgcugccgccccuccgcuucaagggggaggacggcugcugguacgggauggagauccggcccgugaaggagaaggaggagaaccuggucaaguccauggugagcgccggcagcggcgagguggacuccuucagccucgggcugcugugcaucuccaucaugaucgaggaggucaugcgcagccgguggucccgcaagaugcucaugaccggcacccuggcgguguucuuccugcucaucauggggcagcugaccuggaacgaccugauccggcucugcaucauggugggcgccaacgccagcgaccgcauggggaugggcacgaccuaccuggcccugauggccaccuucaagaugcgcccgauguucgcggucggccuccuguuccggcgccugaccucccgggaggugcuccugcugacgaucgggcucagccugguggccuccgucgagcugcccaacagccucgaggagcugggcgacgggcuggccaugggcaucaugauccucaagcugcugaccgacuuccagucccaccagcucugggccacccugcugagccucaccuucaucaagacgaccuucucccugcacuacgcguggaagaccauggccauggugcugagcaucgucucccucuucccccugugccugagcaccacgucccagaagaccaccuggcuccccgugcugcugggcagccucgggugcaagccgcugaccauguuccugaucgccgagaacaagaucuggggccgcaaguccuggccccucaacgaggggaucauggccgugggcaucgucagcauccugcugagcucccuccugaagaacgacgugccccuggccgggccccucaucgcgggcggcaugcugaucgccugcuacgugaucagcggguccagcgccgaccugucccucgagaaggccgccgaggucagcugggaggaggaggcggagcacuccggcgccagccacaacauccugguggaggugcaggacgacgggacgaugaagaucaaggacgaggagcgggacgacacccugaccauccuccugaaggccacccugcucgccgucuccggcguguacccgcugagcauccccgccacccuguucgugugguacuucuggcagaagaagaagcagcgcuccgggguccucugggacacgcccagcccgcccgagguggagcgggcggugcuggacgacggcaucuaccgcaucaugcagcggggccugcuggggcgcucccaggucggcguggggguguuccaggagaacgucuuccacaccauguggcacgugacccggggcgccgugcucauguaccaggggaagcgccuggagcccagcugggccuccgucaagaaggaccugaucagcuacggcggcggguggcggcuccagggcuccuggaacaccggggaggagguccaggugaucgccgucgagcccggcaagaaccccaagaacgugcagacggcccccgggaccuucaagaccagcgagggcgaggugggcgcgaucgcccuggacuucaagcccgggaccuccggcagccccaucgucaaccgcgaggggaagaucgugggccuguacggcaacgggguggucacgaccagcggcaccuacguguccgccaucgcccaggcgaaggccagccaggaggggccccucccggagaucgaggacgagguguuccggaagcgcaaccugaccaucauggaccugcaccccggcuccgggaagacgcggcgcuaccuccccgccaucguccgggaggccaucaagcgcaagcugcggacccugauccucgccccgacccgcgugguggcgagcgagauggccgaggcccugaagggcaugcccauccgcuaccagaccacggccgucaaguccgagcacaccggcaaggagaucguggaccugaugugccacgccaccuucaccaugcggcuccugagccccgugcgcguccccaacuacaacaugaucaucauggacgaggcgcacuucacggacccguccagcaucgccgcccggggguacaucuccacccgcgugggcaugggggaggccgccgcgaucuucaugaccgccacgccgcccggcagcguggaggccuucccccaguccaacgccgucauccaggacgaggagcgggacaucccggagcgcagcuggaacuccggguacgaguggaucacggacuuccccggcaagaccgugugguucgugcccagcaucaaguccggcaacgacaucgcgaacugccugcggaagaacgggaagcgcgucauccagcucagccggaagaccuucgacaccgaguaccagaagacgaagaacaacgacugggacuacguggugaccaccgacaucuccgagaugggcgccaacuuccgcgccgaccgggucaucgacccccgccggugccugaagccggugauccugaaggacgggcccgagcgcgugauccucgccggccccaugcccgucaccguggccagcgcggcccagcggcgcgggcggaucggccgcaaccacaacaaggagggcgaccaguacaucuacauggggcagccgcugaacaacgacgaggaccacgcccacuggacggaggccaagaugcugcucgacaacaucaacacccccgagggcaucauccccgcccuguucgagcccgagcgggagaaguccgcggccaucgacggggaguaccgccugcgcggcgaggcccggaagaccuucgucgagcucaugcgccgcggggaccugccgguguggcugagcuacaagguggccagcgagggcuuccaguacuccgaccgccgguggugcuucgacggcgagcgcaacaaccagguccucgaggagaacauggacguggagaucuggaccaaggagggggagcggaagaagcugcgcccccgguggcuggacgcccgcacguacagcgacccccucgcgcugcgggaguucaaggaguucgccgccggccgccgguccgugagcggggaccugauccucgagaucggcaagcugccccagcaccugacccagcgcgcccagaacgcgcucgacaaccuggucaugcugcacaacuccgagcagggcgggcgggccuaccgccacgccauggaggagcucccggacaccaucgagacccugaugcugcucgcccugaucgccgugcugacgggcggggugacccucuucuuccugagcggccgggggcugggcaagaccuccaucggccuccugugcgucauggcgagcuccgugcugcucuggauggccagcguggagccccacuggaucgccgccuccaucauccuggaguucuuccugaugguccuccugauccccgagcccgaccgccagcggaccccgcaggacaaccagcuggccuacguggugaucgggcuccuguucaugauccugaccgucgcggccaacgagaugggccuccuggagacgaccaagaaggaccuggggaucggccacguggccguggagaaccaccaccacgccgccaugcucgacgucgaccugcaccccgcgagcgccuggacccuguacgccguggccaccacgaucaucacccccaugaugcgccacaccaucgagaacaccacggccaacaucucccucaccgcgaucgccaaccaggccgccauccugauggggcuggacaagggcuggccgaucagcaagauggacaucggcgugccccuccuggcgcuggggugcuacucccaggucaacccccucacccugaccgccgccgugcugaugcucguggcccacuacgccaucaucggccccgggcugcaggcgaaggccacgcgggaggcccagaagcgcaccgccgccggcaucaugaagaacccgaccgucgacgggaucguggcgaucgaccuggaccccguggucuacgacgccaaguucgagaagcagcucggccagaucaugcugcugauccucugcaccagccagauccugcugaugcgcacgaccugggcccucugcgaguccaucacccuggccaccggcccccugacgacccucugggaggggagccccggcaaguucuggaacaccaccaucgccguguccauggcgaacaucuuccgggggagcuaccuggccggcgccggccuggccuucagccucaugaagucccucgggggcgggcgccgggggacgggggcgcagggcgagacccugggcgagaaguggaagcgccagcucaaccagcugagcaaguccgaguucaacaccuacaagcggagcgggaucauggagguggaccgcuccgaggccaaggagggccugaagcgcggggagaccacgaagcacgccgucagccgcggcaccgccaagcuccggugguucguggagcgcaaccuggugaagccggaggggaaggucaucgaccugggcugcggccgcggcgggugguccuacuacugcgccgggcugaagaaggugaccgaggugaagggguacaccaagggcggccccggccacgaggagcccauccccauggcgacguacggguggaaccucgucaagcugcacagcggcaaggacguguucuucaucccgcccgagaagugcgacacccugcucugcgacaucggggaguccagccccaaccccaccaucgaggagggccgcacccugcgggugcugaagauggucgagccguggcuccgcgggaaccaguucugcaucaagauccugaaccccuacaugcccuccgugguggagacgcuggagcagaugcagcggaagcacggcggcaugcucguccgcaacccccugagccggaacuccacccacgagauguacugggugagcugcgggaccggcaacaucguguccgccgucaacaugaccagccgcaugcugcucaaccgguucaccauggcccaccgcaagccgacguacgagcgcgacguggaccugggggccggcacccggcacguggccgucgagcccgagguggcgaaccuggacaucaucggccagcgcaucgagaacaucaagcacgagcacaaguccaccuggcacuacgacgaggacaaccccuacaagaccugggccuaccacgggagcuacgaggugaagcccuccggcagcgccagcuccauggucaacgggguggucaagcuccugacgaagccgugggacgugauccccauggugacccagaucgccaugaccgacaccacgcccuucggccagcagcgggucuucaaggagaagguggacacccgcacccccaaggccaagcgggggaccgcgcagaucauggaggugacggccaaguggcuguggggcuuccucagccgcaacaagaagccgcggaucugcacccgcgaggaguucacccggaagguccgcuccaacgccgccaucggcgcgguguucguggacgagaaccaguggaacagcgccaaggaggccgucgaggacgagcgguucugggaccuggugcaccgcgagcgggagcugcacaagcaggggaagugcgcgaccugcguguacaacaugaugggcaagcgcgagaagaagcucggggaguucggcaaggccaaggggucccgggcgaucugguacauguggcugggcgcccgcuuccuggaguucgaggcccucggcuucaugaacgaggaccacugguucagccgggagaacucccugagcggggucgagggcgaggggcugcacaagcucggcuacauccugcgcgacaucuccaagauccccgggggcaacauguacgccgacgacacggccggcugggacacccggaucaccgaggacgaccugcagaacgaggcgaagaucaccgacaucauggagcccgagcacgcccuccuggccaagagcaucuucaagcugacguaccagaacaagguggugcgcguccagcggccggccaagaacgggaccgugauggacgugaucucccgccgcgaccagcggggcagcgggcaggucggcaccuacggccucaacaccuucacgaacauggaggcccagcugauccgccagauggaguccgaggggaucuucagccccuccgagcuggagacccccaaccucgcgggccgggugcuggacuggcuggagaagcacgggguggagcgccucaagcggauggccaucagcggcgacgacugcgucgugaagcccaucgacgaccgcuucgccaccgcccugaccgcccugaacgacauggggaaggugcggaaggacaucccgcagugggagcccuccaagggcuggaacgacuggcagcagguccccuucugcagccaccacuuccaccagcucaucaugaaggacggccgcgagaucguggugcccugccggaaccaggacgagcuggucgggcgcgcgcgggugagccagggcgccggguggucccugcgcgagacggccugccucggcaagagcuacgcccagauguggcagcugauguacuuccaccggcgcgaccugcggcucgcggccaacgccaucugcuccgccgugccggucgacugggugcccaccagccgcaccaccugguccauccacgcccaccaccaguggaugacgaccgaggacaugcugagcguguggaaccgggucuggaucgaggagaaccccuggauggaggacaagacccacaucuccagcuggggcgacgugcccuaccugggcaagcgcgaggaccaguggugcggcucccucaucgggcugaccgcgcgggccacgugggccaccaacauccagguggccaucaaccagguccgccgccugaucggcaacgagaacuaccucgacuacaugaccagcaugaagcgguucaagaacgaguccgacccggagggggcccugugguga

SEQ ID NO: 8462 - RNA, 9879 nt, Artificial Sequence
  derived and/or modified CDS sequence (opt1) from DENV-1__FJ882541__SS-prME
agcgugaccaugcugcucaugcugauccccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgagguggagcccgacgacguggacugcuggugcaacaccacggacaccugggugaccuacgggaccugcagccagacgggcgagcaccggcgcgacaagcggagcguggcccucgcgccccacgucggccuggggcuggagacccgcgccgagaccuggaugagcuccgagggcgcguggaagcagauccagaagguggagaccugggcccuccggcaccccggguucacggugaucgcccuguuccuggcccacgcgaucggcaccagcaucacccagaaggggaucaucuucauccuccugaugcuggucacccccuccauggccaugcgcugcgugggcaucggcagccgggacuucguggaggggcucuccggcgccacgugggucgacguggugcuggagcacgggagcugcgucaccaccauggccaaggacaagcccacccuggacaucgagcuccugaagacggaggugaccaaccccgccgugcugcgcaagcucugcaucgaggcgaagaucuccaacaccaccacggacagccggugcccgacccagggcgaggccacccuggucgaggagcaggacgccaacuucgugugccgccggaccuucguggaccgcggcugggggaacggcugcgggcuguucggcaaggggucccucaucacgugcgccaaguucaagugcgucaccaagcuggagggcaagaucgugcaguacgagaaccugaaguacagcgugaucgucaccgugcacaccggcgaccagcaccaggucgggaacgaguccacggagcacggcaccaccgccaccaucacgccccaggcgcccacgagcgagauccagcucaccgacuacggggcccugacccuggacugcagcccccggaccggccucgacuucaacgagauggugcugcugacgaugaaggggaaguccuggcucgugcacaagcagugguuccuggaccugccccuccccuggaccagcggcgccuccaccagccaggagaccuggaaccgccaggaccugcuggucacguucaagaccgcccacgccaagaagcaggagguggugguccucggcucccaggagggggcgaugcacaccgcccugaccggcgccacggagauccagaccagcgggaccaccacgaucuucgccggccaccugaagugccggcucaagauggacaagcugacccugaaggggauguccuacgugaugugcaccggcagcuucaagcucgagaaggagguggccgagacccagcacggcacgguccuggugcagaucaaguacgaggggaccgacgcgcccugcaagauccccuucuccacccaggacgagaagggcgugacccagaacgggcgccugaucacggccaacccgaucgucaccgacaaggagaagcccgugaacaucgaggccgagccgcccuucggcgagagcuacaucgugaucggcgccggggagaaggcgcugaagcucuccugguucaagaagggcagcuccaucgggaagauguucgaggccaccgcccggggcgcccgccggauggccauccugggggacaccgcgugggacuucggcagcaucggcggggucuucacguccgugggcaagcuggugcaccagaucuucgggaccgccuacggcguccucuucagcgggguguccuggaccaugaagaucggcaucggcgugcugcugaccuggcucgggcugaacagccgcuccacgagccuguccaugaccugcaucgccgucggccucgugacccuguaccugggggugaugguccaggccgacagcggcugcgugaucaacuggaaggggcgcgagcucaagugcggcagcggcaucuucgugaccaacgagguccacacguggaccgagcaguacaaguuccaggccgacuccccgaagcggcugagcgcggccaucgggaaggccugggaggagggcgugugcgggauccgcuccgccacccggcuggagaacaucauguggcgccagaucagcaacgagcucaaccacauccugcuggagaacgacaugaaguucaccguggucgugggcgacguggucgggauccucgcccagggcaagaagaugauccggccccagcccauggagcacaaguacuccuggaaguccuggggcaaggcgaagaucaucggggccgacgugcagaacaccacguucaucaucgacggccccaacaccccggagugccccgacgaccagcgcgccuggaacaucugggagguggaggacuacggguucggcaucuucaccaccaacaucuggcugaagcugcgggacuccuacacgcaggucugcgaccaccgccucaugagcgccgcgaucaaggacuccaaggccgugcacgccgacaugggcuacuggaucgagagcgagaagaacgagaccuggaagcuggcccgggccuccuucaucgaggugaagaccugcaucuggcccaagagccacacccugugguccaacgggguccucgagagcgagaugaucauccccaagaucuacggcgggccgaucucccagcacaacuaccgccccggcuacuucacgcagaccgcggggcccuggcaccugggcaagcuggagcucgacuucgaccugugcgagggcaccaccgugguggucgacgagcacugcgggaaccggggcccgagccugcgcacgaccaccgugaccgggaagaucauccacgaguggugcugccgguccugcacgcugccgccccuccgcuucaagggcgaggacgggugcugguacggcauggagauccggcccgugaaggagaaggaggagaaccuggucaagagcauggugagcgccggcuccggggagguggacagcuucucccucggccugcugugcaucagcaucaugaucgaggaggucaugcgcucccgguggagccgcaagaugcucaugaccgggacccuggccguguucuuccugcucaucaugggccagcugaccuggaacgaccugauccgguccugcaucauggugggggccaacgccagcgaccgcaugggcaugggcacgaccuaccucgcgcugauggccaccuucaagaugcgcccgauguucgccgucgggcuccuguuccggcgccugaccucccgggaggugcugcuccugacgaucggccugagccucgucgccuccguggagcugcccaacagccuggaggagcucggggacggccuggccaugggcaucaugauccugaagcuccugaccgacuuccaguccuaccagcugugggcgacccuccugagccugaccuucaucaagacgaccuucucccuccacuacgccuggaagaccauggccauggugcugagcaucgucucccugcucccccugugccugagcaccacgucccagaagaccaccuggcuccccgugcugcuggggagccucggcugcaagccgcugaccauguuccugaucgccgagaacaagaucugggggcgcaagagcuggccccucaacgagggcaucauggcgguggggaucgucuccauccugcugagcucccuccugaagaacgacgugccccuggccggcccccucaucgccggcgggaugcugaucgccugcuacgugaucagcggcuccagcgccgaccugucccucgagaaggcggccgaggucagcugggaggaggaggccgagcacuccggggccagccacaacauccugguggaggugcaggacgacggcacgaugaagaucaaggacgaggagcgggacgacacccugaccauccuccugaaggccacccugcucgcggucuccgggguguacccgcugagcauccccgccacccuguucgugugguacuucuggcagaagaagaagcagcgcuccggcguccucugggacacgcccagcccgcccgagguggagcgggccgugcuggacgacggcaucuaccgcaucaugcagcgggggcugcugggccgcucccaggucggggugggcguguuccaggagaacgucuuccacaccauguggcacgugacccgcggggccgugcucauguaccagggcaagcgccuggagcccagcugggccuccgucaagaaggaccugaucagcuacggcgggggcuggcggcuccagggguccuggaacaccggcgaggagguccaggugaucgcggucgagcccgggaagaaccccaagaacgugcagacggcccccggcaccuucaagacccccgagggcgaggugggggccaucgcccuggacuucaagcccggcaccagcgggagccccaucgucaaccgcgagggcaagaucgugggccuguacgggaacggcguggucacgaccuccgggaccuacgugagcgccaucgcgcaggccaaggccucccaggagggcccgcuccccgagaucgaggacgagguguuccggaagcgcaaccugaccaucauggaccugcaccccgggagcggcaagacgcggcgcuaccucccggccaucguccgggaggcgaucaagcgcaagcugcggacccugauccucgcccccacccgcgugguggccuccgagauggccgaggcccugaagggcaugcccauccgcuaccagaccacggcggucaagagcgagcacaccgggcgggagaucguggaccugaugugccacgccaccuucaccaugcgccuccugucccccgugcgggucccgaacuacaacaugaucaucauggacgaggcccacuucacggaccccagcuccaucgccgcccgcggcuacaucagcacccggguggggaugggcgaggcggccgccaucuucaugaccgccacgccgcccggguccguggaggccuucccgcagagcaacgcggucauccaggacgaggagcgcgacauccccgagcgguccuggaacagcggcuacgaguggaucacggacuuccccggcaagaccgugugguucgugcccuccaucaagagcgggaacgacaucgccaacugccugcgcaagaacggcaagcgggucauccagcucucccgcaagaccuucgacaccgaguaccagaagacgaagaacaacgacugggacuacguggugaccaccgacaucagcgagaugggggccaacuuccgggccgaccgcgucaucgacccgcggcgcugccugaagcccgugauccugaaggacggccccgagcgggucauccucgcggggcccaugccggugaccguggccuccgccgcccagcgccggggccgcaucggccggaaccacaacaaggagggggaccaguacaucuacaugggccagccccugaacaacgacgaggaccacgcccacuggacggaggcgaagaugcugcucgacaacaucaacacccccgaggggaucauccccgcccuguucgagccggagcgcgagaaguccgccgccaucgacggcgaguaccgccugcgcggggaggcccgcaagaccuucgucgagcucaugcggcgcggcgaccugcccguguggcugagcuacaagguggcguccgagggcuuccaguacagcgaccggcgcuggugcuucgacggggagcggaacaaccagguccucgaggagaacauggacguggagaucuggaccaaggagggcgagcgcaagaagcugcggccccgcuggcuggacgcccggacguacuccgacccccucgcccugcgcgaguucaaggaguucgccgccgggcggcgcagcguguccggcgaccugauccucgagaucggcaagcugccgcagcaccugacccagcgggcgcagaacgcccucgacaaccuggucaugcugcacaacagcgagcagggcgggcgcgccuaccggcacgccauggaggagcuccccgacaccaucgagacccugaugcugcucgcgcugaucgccgugcugaccggcggggugacccucuucuuccuguccgggcgcgggcugggcaagaccagcaucgggcuccugugcgucauggccuccagcgcccugcucuggauggccuccguggagccccacuggaucgcggccagcaucauccuggaguucuuccugauggugcuccugauccccgagccggaccggcagcgcacgccccaggacaaccagcuggccuacgucgugaucggccuccuguucaugauccugaccguggccgccaacgagauggggcuccuggagacgaccaagaaggaccugggcaucgggcacgucgcgguggagaaccaccaccacgccaccaugcucgacguggaccugcaccccgccuccgccuggacccuguacgccgucgcgacgaccaucaucaccccgaugaugcggcacaccaucgagaacacgaccgccaacaucagccucaccgccaucgccaaccaggccgcgauccugaugggccuggacaagggcuggcccaucuccaagauggacaucggggugccccuccuggcccugggcugcuacagccaggugaacccccucacccugacggccgccguccugaugcucguggcgcacuacgccaucaucgggccgggccugcaggccaaggccacccgcgaggcccagaagcgcaccgcggccgggaucaugaagaaccccaccguggacggcaucgucgccaucgaccuggaccccgugguguacgacgccaaguucgagaagcagcucggccagaucaugcugcugauccucugcacgucccagauccugcugaugcggaccaccugggcccucugcgagagcaucacccuggcgacggggccccugaccacccucugggagggcuccccggggaaguucuggaacaccacgaucgccgucagcauggccaacaucuuccgcggcagcuaccuggccggcgccgggcuggcguucucccucaugaagucccugggcgggggccggcgcgggaccggcgcccagggcgagacccugggggagaaguggaagcggcagcucaaccagcuguccaagagcgaguucaacaccuacaagcgcuccggcaucauggagguggaccggagcgaggccaaggaggggcugcgccggggcgagacgaccaagcacgccgugucccgcgggaccgcgaagcuccggugguucgucgagcgcaaccuggugaagcccgagggcaaggugaucgaccugggcugcgggcggggcggguggagcuacuacugcgccggccugaagaaggucaccgaggugaagggguacacgaagggcggccccgggcacgaggagcccaucccgauggccaccuacggcuggaaccucgugaagcugcacuccgggaaggacgucuucuucaucccgcccgagaagugcgacacccugcucugcgacaucggcgagagcucccccaacccgaccaucgaggaggggcgcacgcugcgggugcugaagaugguggagcccuggcuccgcggcaaccaguucugcaucaagauccugaaccccuacaugcccagcgucguggagacccuggagcagaugcagcggaagcacggcgggaugcucgugcgcaacccgcugucccggaacagcacccacgagauguacugggucuccugcggcaccgggaacaucgugagcgccgugaacaugaccucccgcaugcugcucaaccgcuucacgauggcccaccggaagcccaccuacgagcgcgacgucgaccugggcgcgggcacccggcacguggccguggagcccgaggucgccaaccuggacaucaucgggcagcgcaucgagaacaucaagcacgagcacaagagcaccuggcacuacgacgaggacaaccccuacaagacgugggccuaccacggcuccuacgaggugaagccgagcgggagcgccuccagcauggucaacggcguggugaagcuccugaccaagcccugggacgucauccccauggugacccagaucgcgaugaccgacacgacccccuucgggcagcagcggguguucaaggagaaggucgacacccgcaccccgaaggccaagcggggcacggcccagaucauggaggugaccgcccgcuggcuguggggcuuccucucccggaacaagaagccccgcaucugcacccgggaggaguucacccgcaaggugcggagcaacgccgcgaucggggccgucuucguggacgagaaccaguggaacuccgccaaggaggccguggaggacgagcgcuucugggaccugguccaccgggagcgcgagcugcacaagcagggcaagugcgcgacgugcguguacaacaugauggggaagcgggagaagaagcucggcgaguucgggaaggccaagggcagccgcgccaucugguacauguggcugggcgcccgguuccuggaguucgaggcccucggguucaugaacgaggaccacugguucucccgcgagaacagccuguccggcguggagggggagggccugcacaagcucggguacauccugcgggacaucagcaagauccccggcggcaacauguacgcggacgacaccgccgggugggacacccgcaucaccgaggacgaccugcagaacgaggccaagaucacggacaucauggagccggagcacgcccuccuggccaccuccaucuucaagcugaccuaccagaacaaggucgugcgcgugcagcggcccgcgcgcaacggcaccgucauggacgugaucagccggcgcgaccagcggggguccggccaggugggcacguacgggcucaacaccuucaccaacauggaggcccagcugauccgccagauggagagcgagggcaucuucucccccagcgagcuggagacccccaaccucgccgagcggguccuggacuggcuggagaagcacgggguggagcgccucaagcggauggccaucuccggcgacgacugcguggucaagccgaucgacgaccgcuucgccacggcgcugagcgcccugaacgacauggggaaggugcggaaggacaucccccagugggagcccagcaagggcuggaacgacuggcagcagguccccuucugcucccaccacuuccaccagcucaucaugaaggacggccgcgagaucgucgugccgugccggaaccaggacgagcugguggggcgcgcccgggucagccagggcgccggguggucccugcgcgagaccgccugccucggcaagagcuacgcgcagauguggcagcugauguacuuccaccggcgcgaccugcggcucgccgccaacgccaucugcuccgcggugcccguggacuggguccccaccagccgcaccacgugguccauccacgcccaccaccaguggaugaccaccgaggacaugcugagcguguggaaccgcguguggaucgaggagaaccccuggauggaggacaagacccacaucuccagcuggggcgacgucccguaccugggcaagcgggaggaccaguggugcggcucccucaucgggcugacggcccgcgccaccugggccaccaacauccagguggcgaucaaccaggugcggcgccugaucggcaacgagaacuaccucgacuacaugaccagcaugaagcgguucaagaacgaguccgaccccgagggggcccugugguga

SEQ ID NO: 8463 - RNA, 9879 nt, Artificial Sequence
  derived and/or modified CDS sequence (opt1) from DENV-1__FJ882542__SS-prME
agcgugaccaugcugcucaugcugaugcccaccgcccuggccuuccaccucaccacccggggcggggagccccacaugaucgugaccaagcaggagcgggggaagucccugcuguucaagaccagcgcgggggugaacaugugcacccucaucgccauggaccugggcgagcugugcgaggacaccaugaccuacaagugcccccggaucaccgaggccgagcccgacgacguggacugcuggugcaacgccaccgacaccugggugaccuacgggaccugcucccagacgggcgagcaccggcgcgacaagcggagcguggcccucgcgccccacgugggccuggggcuggagacccgcaccgagaccuggauguccagcgagggcgccuggaagcagauccagcggguggagacgugggcccuccgccaccccggguucaccgugaucgcccuguuccuggcgcacgccaucggcaccuccaucacccagaaggggaucaucuucauccuccugaugcuggugacgcccagcauggccaugcggugcgucggcaucggcucccgcgacuucguggaggggcucagcggcgccaccuggguggacgucgugcuggagcacggguccugcgugaccaccauggccaaggacaagcccacgcuggacaucgagcuccugaagaccgaggucaccaaccccgcggugcugcggaagcucugcaucgaggccaagaucagcaacaccacgaccgacucccgcugccccacccagggcgaggccacccugauggaggagcaggacgccaacuucgugugccggcgcacguucgucgaccggggcugggggaacggcugcgggcuguucggcaaggggagccucaucacgugcgccaaguucaagugcgugaccaagcuggagggcaagaucgugcaguacgagaaccugaaguacuccgucaucgugaccgugcacacgggcgaccagcaccaggucgggaacgagagcaccgagcacggcaccaccgcgaccaucacgccccaggcccccaccuccgagauccagcucaccgacuacggggcccugacccuggacugcagcccccgcacgggccucgacuucaacgagauggugcugcugaccaugaaggagaaguccuggcucguccacaagcagugguuccuggaccugccgcuccccuggaccagcggggccagcaccucccaggagacguggaaccggcaggaccugcuggugaccuucaagaccgcccacgcgaagaagcaggagguggucgugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgugaugugcaccggguccuucaagcucgagaaggaggucgcggagacgcagcacggcaccgugcuggugcagaucaaguacgagggcaccgacgcccccugcaagauccccuucagcacccaggacgagaagggggucacgcagaacggccggcugaucaccgccaacccgaucgugaccgacaaggagaagcccgugaacaucgaggccgagccgcccuucggggaguccuacaucgucaucggcgcgggcgagaaggcccugaagcucagcugguucaagaagggguccagcaucggcaagauguucgaggccaccgcccgcggggcccggcgcauggcgauccugggcgacacggccugggacuucggguccgugggcggcguguucaccagcgucgggaagcuggugcaccagaucuucggcaccgccuacgggguccuguucuccggcgucagcuggaccaugaagaucgggaucggcgugcugcugacguggcucggccugaacucccgcagcaccucccugagcaugaccugcaucgccguggggcucgucacccuguaccugggcgugauggugcaggccgacuccgggugcgucaucaacuggaagggccgggagcucaagugcgggagcggcaucuucgugacgaacgaggugcacaccuggaccgagcaguacaaguuccaggcggacagcccgaagcgccuguccgccgccaucggcaaggccugggaggagggggucugcggcauccggagcgccacccgccuggagaacaucauguggaagcagaucuccaacgagcucaaccacauccugcuggagaacgacaugaaguucaccgugguggucggggacguggugggcauccucgcgcaggggaagaagaugauccggccccagcccauggagcacaaguacagcuggaaguccuggggcaaggccaagaucaucggcgccgacguccagaacacgaccuucaucaucgacgggcccagcaccccggagugccccgacgaccagcgcgccuggaacaucugggagguggaggacuacggcuucgggaucuucaccacgaacaucuggcugaagcugcgggacuccuacacccaggugugcgaccaccgccucaugagcgcggccaucaaggacuccaaggccguccacgccgacaugggcuacuggaucgagagcgagaagaacgagaccuggaagcuggcccgggcguccuucaucgaggugaagaccugcaucuggcccaagagccacacgcugugguccaacggcgugcucgagagcgagaugaucauccccaagaucuacgggggcccgaucucccagcacaacuaccgccccggguacuucacccagaccgccggccccuggcaccuggggaagcuggagcucgacuucgaccugugcgagggcaccacggucgugguggacgagcacugcggcaaccgggggccgagccugcgcaccaccaccgucacgggcaagaucauccacgaguggugcugccgguccugcacccugccgccccuccgcuucaagggggaggacggcugcugguacgggauggagauccggcccgugaaggagaaggaggagaaccuggugaaguccauggucagcgccggcuccggcgagguggacagcuucucccucgggcugcugugcaucagcaucaugaucgaggaggugaugcgcucccgguggagccgcaagaugcucaugaccggcacccuggccgucuuccugcuccugaucauggggcagcugacguggaacgaccucauccggcugugcaucauggugggcgccaacgcguccgaccgcauggggaugggcaccaccuaccuggcccucauggccaccuucaagaugcgcccgauguucgccgugggccugcuguuccggcgccucacgagccgggagguccugcugcucaccaucgggcugucccugguggccagcgucgagcuccccaacucccuggaggagcugggcgacgggcucgcgaugggcaucaugauccugaagcugcucaccgacuuccagagccaccagcugugggccacccugcucucccugacguucaucaagaccacccugagccuccacuacgccuggaagaccauggccauggugcuguccaucgcgagccuguucccccucugccuguccacgaccagccagaagaccaccuggcugcccgugcuccugggcucccuggggugcaagccgcucacgauguuccugaucaccgagaccaagaucuggggccgcaagagcuggccccugaacgaggggaucauggccgucggcguggugagcauccuccuguccagccugcucaagaacgacgucccccuggccgggccccugaucgccggcggcaugcucaucgccugcuacgugaucuccgggagcuccgcggaccugagccuggagaaggccgccgagguguccugggaggaggaggccgagcacagcggcgccucccacaacauccucgucguggugcaggacgacgggaccaugaagaucaaggacgaggagcgggacgacacccugacgauccugcucaaggcgacccugcuggccgucagcggcguguacccgcucuccauccccgccacccuguucgugugguacuucuggcagaagaagaagcagcgcagcgggguccugugggacacccccagcccgcccgagguggagcgggccgugcuggacgacggcaucuaccgcaucaugcagcggggccuccuggggcgcagccaggucggcguggggguguuccaggagaacgucuuccacacgauguggcacgugacccggggcgccgugcugauguaccaggggaagcgccucgagcccuccugggcgagcgucaagaaggaccugaucuccuacggcggcggguggcggcugcagggcagcuggaacaccggggaggagguccaggugaucgccgucgagcccggcaagaaccccaagaacgugcagaccgcccccgggacguucaagacccccgagggcgaggugggcgccaucgcccucgacuucaagcccgggaccuccggcagccccaucgucaaccgcgaggggaagaucgugggccuguacggcaacgggguggucaccacgagcggcaccuacguguccgcgaucgcccaggccaaggccagccaggaggggccgcugcccgagaucgaggacgagguguuccggaagcgcaaccucaccaucauggaccugcaccccggcuccgggaagacccggcgcuaccugccggcgaucguccgggaggccaucaagcgcaagcuccggacgcugauccuggcccccacccgcgugguggccagcgagauggccgaggcgcucaagggcaugcccauccgcuaccagaccaccgccgucaaguccgagcacacgggcaaggagaucguggaccugaugugccacgccaccuucaccaugcggcugcucagccccgugcgcgucccgaacuacaacaugaucaucauggacgaggcccacuucaccgaccccuccagcaucgccgcgcggggguacaucuccacgcgcgugggcaugggggaggccgccgccaucuucaugaccgccacgccgcccggcagcguggaggcguucccgcaguccaacgccgucauccaggacgaggagcgggacauccccgagcgcagcuggaacuccggguacgaguggaucaccgacuuccccggcaagacggugugguucgugcccagcaucaaguccggcaacgacaucgccaacugccugcggaagaacgggaagcgcgucauccagcugagccggaagaccuucgacaccgaguaccagaagaccaagaacaacgacugggacuacguggugacgaccgacaucuccgagaugggcgccaacuuccgcgcggaccgggucaucgacccgcgccggugccucaagcccgugauccugaaggacgggcccgagcgcgucauccuggccggccccaugccggugaccguggccagcgccgcccagcggcgcgggcggaucggccgcaaccacaacaaggagggcgaccaguacaucuacauggggcagccccucaacaacgacgaggaccacgcgcacuggaccgaggccaagaugcugcuggacaacaucaacacgcccgagggcaucauccccgcccucuucgagccggagcgggagaaguccgccgccaucgacggggaguaccgccugcgcggcgaggcgcggaagaccuucgucgagcugaugcgccgcggggaccuccccguguggcugagcuacaagguggccagcgagggcuuccaguacuccgaccgccgguggugcuucgacggcgagcgcaacaaccagguccuggaggagaacauggacguggagaucuggaccaaggagggggagcggaagaagcuccgcccccgguggcuggacgcccgcaccuacagcgacccccuggcccuccgggaguucaaggaguucgccgcgggccgccgguccgugagcggggaccugauccuggagaucggcaagcucccgcagcaccugacgcagcgcgcccagaacgcccuggacaaccucgucaugcugcacaacuccgagcagggcgggcgggccuaccgccacgcgauggaggagcugcccgacaccaucgagacccucaugcugcuggcccucaucgccgugcugaccggcgggaugacccuguucuuccucagcggccgggggcugggcaagacguccaucggccugcucugcgugauggccagcuccguccugcuguggauggccagcguggagccccacuggaucgcggccuccaucauccucgaguucuuccugauggugcugcucauccccgagccggaccgccagcggacgccccaggacaaccagcuggccuacgucgugaucgggcuccucuucaugauccugaccguggccgccaacgagaugggccugcucgagaccacgaagaaggaccuggggaucggccacgucgcgguggagaaccaccaccacgccaccaugcuggacguggaccuccaccccgccagcgccuggacccuguacgccgucgcgaccacgaucaucaccccgaugaugcgccacaccaucgagaacaccacggccaacaucucccugaccgccaucgccaaccaggccgcgauccucauggggcuggacaagggcuggcccaucagcaagauggacaucggcgugccccugcucgcccuggggugcuacucccaggugaacccccugacccucaccgccgccguccugaugcugguggcgcacuacgccaucaucggcccggggcuccaggccaaggccacgcgggaggcccagaagcgcaccgcggccggcaucaugaagaaccccaccguggacgggaucgucgccaucgaccuggaccccgugguguacgacgccaaguucgagaagcagcugggccagaucaugcuccugauccugugcaccagccagauccuccugaugcgcacgaccugggcccugugcgaguccaucacccucgcgaccggcccccugacgacccugugggaggggagcccgggcaaguucuggaacaccaccaucgccgucuccauggccaacaucuuccgggggagcuaccucgccggcgccggccuggcguucagccugaugaagucccucgggggcgggcgccggggcacgggggcccagggcgagacccugggcgagaaguggaagcgccagcugaaccagcucagcaaguccgaguucaacaucuacaagcggagcgggaucauggagguggaccgcuccgaggccaaggagggccugaagcgcggggagaccacccgccacgccgugagccggggcacggcgaagcugcgcugguucgucgagcggaaccuggugaagcccgaggggaaggugaucgaccucggcugcggccgcgggggcugguccuacuacugcgccgggcugaagaaggucaccgaggugaagggcuacaccaagggcgggcccggccacgaggagcccaucccgauggccaccuacggguggaaccuggugaagcuccacagcggcaaggacgucuucuucacgccgcccgagaagugcgacacccugcugugcgacaucggggaguccagccccaacccgaccaucgaggagggccggacccuccgcgugcugaagaugguggagcccuggcugcgggggaaccaguucugcaucaagauccucaaccccuacaugcccuccgucguggagacccuggagcagaugcagcgcaagcacggcggcaugcuggugcggaacccgcucagccgcaacuccacgcacgagauguacugggucagcugcgggaccggcaacaucguguccgccgugaacaugaccagccggaugcugcugaaccgcuucaccauggcccaccgcaagcccacguacgagcgggacgucgaccucggggcgggcacccgccacguggccguggagcccgaggucgccaaccuggacaucaucggccagcggaucgagaacaucaagcacgagcacaaguccaccuggcacuacgacgaggacaaccccuacaagaccugggccuaccacgggagcuacgaggugaagccguccggcagcgccagcuccauggucaacgggguggugaagcugcucacgaagcccugggacgucauccccauggugacccagaucgcgaugaccgacaccacgcccuucggccagcagcgcguguucaaggagaaggucgacacccggaccccgaaggccaagcgcgggaccgcccagaucauggaggugacggcccgguggcuguggggcuuccugagccgcaacaagaagccccggaucugcacccgcgaggaguucacccggaaggugcgcuccaacgccgcgaucggcgccgucuucguggacgagaaccaguggaacagcgccaaggaggccguggaggacgagcgguucugggaccucguccagaaggagcgcgagcugcacaagcaggggaagugcgcgaccugcguguacaacaugaugggcaagcgggagaagaagcugggggaguucggcaaggccaaggggucccgcgccaucugguacauguggcucggcgcccgguuccuggaguucgaggcccugggcuucaugaacgaggaccacugguucagccgcgagaacucccucagcgggguggagggcgaggggcugcacaagcugggcuacauccuccgggacaucuccaagauccccgggggcaacauguacgcggacgacacggccggcugggacacccgcaucaccgaggacgaccugcagaacgaggccaagaucaccgacaucauggagccggagcacgcccugcucgccacgagcaucuucaagcugaccuaccagaacaaggucgugcgggugcagcgccccgcgaagaacgggaccgucauggacgugaucucccgccgggaccagcgcggcagcggccaggugggcaccuacggccugaacacguucaccaacauggaggcccagcucauccggcagauggaguccgaggggaucuuccugcccagcgagcuggagacccccaaccucgccgagcgcguccuggacuggcuggagaaguacggcguggagcggcucaagcgcauggccaucuccggggacgacugcguggucaagccgaucgacgaccgguucgccaccgcgcugacggcccugaacgacaugggcaaggugcgcaaggacaucccccagugggagcccagcaagggguggaacgacuggcagcagguccccuucugcucccaccacuuccaccagcucaucaugaaggacggccgggagaucgucgugccgugccgcaaccaggacgagcuggugggccgggcccgcgucagccagggggccggcuggagccugcgggagaccgccugccucgggaaguccuacgcgcagauguggcagcugauguacuuccaccgccgggaccugcgccucgccgccaacgccaucugcagcgcggugcccguggacuggguccccaccucccggaccacguggagcauccacgcccaccaccaguggaugaccaccgaggacaugcuguccguguggaaccgcguguggaucgaggagaaccccuggauggaggacaagacccacgucagcuccuggggcgacgugccguaccuggggaagcgggaggaccaguggugcggcagccucaucggccugaccgcccgcgccacgugggccuccaacauccagguggcgaucaaccagguccgccggcugaucgggaacgagaacuaccucgacuacaugaccagcaugaagcgcuucaagaacgagggcgaccccgagggggcccugugguga

SEQ ID NO: 8464 - RNA, 9879 nt, Artificial Sequence
  derived and/or modified CDS sequence (opt1) from DENV-1__FJ882543__SS-prME
agcgugaccaugcugcucaugcugaugcccaccgcccuggccuuccaccucaccacccggggcggggagccccacaugaucgugaccaagcaggagcggggcaagagccugcuguucaagaccagcgcgggggugaacaugugcacccucaucgccauggaccugggggagcugugcgaggacaccaugaccuacaagugcccccggaucaccgaggccgagcccgacgacguggacugcuggugcaacgccacggacaccugggugaccuacgggaccugcagccagacgggggagcaccggcgcgacaagcggagcguggcccucgcgccccacgugggccuggggcuggagacccgcaccgagaccuggauguccagcgagggcgccuggaagcagauccagcgggucgagacgugggcccuccgccaccccggguucaccgugaucgcccuguuccuggcgcacgccaucggcaccuccaucacccagaaggggaucaucuucauccuccugaugcuggugacgcccagcauggccaugcggugcgucggcaucggcucccgcgacuucguggaggggcucagcggcgccaccuggguggacgucgugcuggagcacggguccugcgugaccaccauggccaaggacaagcccacgcuggacaucgagcuccugaagaccgaggucaccaaccccgcggugcugcggaagcucugcaucgaggccaagaucagcaacaccacgaccgacucccgcugcccgacccagggcgaggccacccugauggaggagcaggacgccaacuucgugugccggcgcacguucgucgaccggggcugggggaacggcugcgggcuguucggcaaggggagccucaucacgugcgccaaguucaagugcgugaccaagcuggagggcaagaucgugcaguacgagaaccugaaguacuccgucaucgugaccgugcacacgggcgaccagcaccaggucgggaacgagagcaccgagcacggcaccaccgcgaccaucacgccccaggcccccaccuccgagauccagcucaccgacuacggggcccugacccuggacugcagcccccgcacgggccucgacuucaacgagauggugcugcugaccaugaaggagaaguccuggcucguccacaagcagugguuccuggaccugccgcuccccuggaccagcggggccagcaccucccaggagacguggaaccggcaggaccugcuggugaccuucaagaccgcccacgcgaagaagcaggagguggucgugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgugaugugcaccggguccuucaagcucgagaaggaggucgcggagacgcagcacggcaccgugcuggugcagaucaaguacgagggcaccgacgcccccugcaagauccccuucagcacccaggacgagaagggggucacgcagaacggccggcugaucaccgccaacccgaucgugaccgacaaggagaagcccgugaacaucgaggccgagccgcccuucggggaguccuacaucgucaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcaucgggaagcuggugcaccagaucuucggcaccgccuacgggguccucuucuccggcgugagcuggaccaugaagaucgggaucggcgugcugcugacguggcucggccugaacucccgcagcaccucccugagcaugaccugcaucgccgucgggcucgugacccuguaccugggcgugaugguccaggccgacuccgggugcgugaucaacuggaagggccgggagcucaagugcgggagcggcaucuucgugacgaacgagguccacaccuggaccgagcaguacaaguuccaggcggacagcccgaagcgccuguccgccgccaucggcaaggccugggaggagggggugugcggcauccggagcgccacccgccuggagaacaucauguggaagcagaucuccaacgagcucaaccacauccugcuggagaacgacaugaaguucaccguggucgugggggacguggucggcauccucgcgcaggggaagaagaugauccggccccagcccauggagcacaaguacagcuggaaguccuggggcaaggccaagaucaucggcgccgacgugcagaacacgaccuucaucaucgacgggcccaacaccccggagugccccgacgaccagcgcgccuggaacaucugggagguggaggacuacggcuucgggaucuucaccacgaacaucuggcugaagaugcgggacagcuacacccaggucugcgaccaccgccugauguccgcggccaucaaggacagcaaggccgugcacgccgacaugggcuacuggaucgaguccgagaagaacgagaccuggaagcucgcccgggcgagcuucaucgaggugaagaccugcaucuggcccaagucccacacgcuguggagcaacggcguccuggaguccgagaugaucauccccaagaucuacgggggcccgaucagccagcacaaccaccgccccggguacuucacccagaccgccggccccuggcaccucgggaagcuggagcuggacuucgaccucugcgagggcaccacggugguggucgacgagcacugcggcaaccgggggccgucccugcgcaccaccaccgugacgggcaagaucauccacgaguggugcugccggagcugcacccugccgccccugcgcuucaagggggaggacggcugcugguacgggauggagauccggcccgugaaggagaaggaggagaaccuggucaaguccauggugagcgccggcagcggcgagguggacuccuucagccuggggcuccugugcaucuccaucaugaucgaggaggucaugcgcagccgguggucccgcaagaugcugaugaccggcacccucgccguguuccugcugcucaucauggggcagcugacguggaacgaccugauccggcucugcaucauggugggcgccaacgcgagcgaccgcauggggaugggcaccaccuaccuggcccugauggccaccuucaagaugcgcccgauguucgccgucggccuccuguuccggcgccugacgucccgggaggugcuccugcugaccaucgggcucagccugguggccuccgucgagcugcccaacagccucgaggagcugggcgacgggcuggcgaugggcaucaugauccucaagcugcugaccgacuuccagucccaccagcucugggccgcccugcugagccucaccuucaucaagacgacccugucccugcacuacgccuggaagaccauggcgauggugcucagcaucgucucccugaucccccugugccucagcaccacgucccagaagaccaccuggcugcccgugcugcucggcagccuggggugcaagccgcugaccauguuccucaucgccgagaacaagaucuggggccgcaaguccuggccccugaacgaggggaucauggccgugggcgucgugagcauccugcucagcucccugcugaagaacgacgugccccucgccgggccccugaucgccggcggcaugcugaucgcgugcuacgucaucagcggguccagcgccgaccucucccuggagaaggccgccgaggugagcugggaggaggaggccgagcacuccggcgcgagccacaacauccugguggagguccaggacgacgggacgaugaagaucaaggacgaggagcgggacgacacccucaccauccugcugaaggccacccuccuggccguguccggcguguacccgcugagcauccccgccacccucuucgucugguacuucuggcagaagaagaagcagcgcuccggggugcugugggacacgcccagcccgcccgagguggagcgggccguccuggacgacggcaucuaccgcaucaugcagcggggccugcucgggcgcucccaggugggcgugggggucuuccaggagaacguguuccacaccauguggcacgugacccggggcgcgguccugauguaccaggggaagcgccuggagcccagcugggccuccgugaagaaggaccucaucagcuacggcggcggguggcggcugcagggcuccuggaacaccggggaggaggugcaggucaucgccguggagcccggcaagaaccccaagaacgugcagacggcccccgggaccuucaagacccccgagggcgaggucggcgccaucgcgcuggacuucaagcccgggaccagcggcucccccaucgugaaccgcgaggggaagaucgugggccucuacggcaacggggucgugacgaccagcggcaccuacgugagcgccaucgcccaggccaaggcgucccaggaggggccgcugcccgagaucgaggacgaggucuuccggaagcgcaaccugaccaucauggaccuccaccccggcagcgggaagacgcggcgcuaccugccggccaucgugcgggaggccaucaagcgcaagcugcggacccucauccuggcccccacccgcguggucgccuccgagauggcggaggcccugaagggcaugcccauccgcuaccagaccacggccgucaagagcgagcacaccggcaaggagaucguggaccucaugugccacgccaccuucaccaugcggcugcugucccccguccgcgugccgaacuacaacaugaucaucauggacgaggcccacuucacggaccccagcuccaucgcggcccggggguacaucagcacccgcgugggcaugggggaggccgccgccaucuucaugaccgcgacgccgcccggcuccgucgaggccuucccgcagagcaacgccgugauccaggacgaggagcgggacauccccgagcgcuccuggaacagcggguacgaguggaucacggacuuccucggcaagaccgugugguucguccccuccaucaagagcggcaacgacaucgccaacugccugcggaagaacgggaagcgcgugauccagcugucccggaagaccuucgacaccgaguaccagaagacgaagaacaacgacugggacuacguggucaccaccgacaucagcgagaugggcgcgaacuuccgcgccgaccgggugaucgacccccgccggugccucaagccggugauccugaaggacgggcccgagcgcgucauccuggccggccccaugcccgugaccgucgccuccgccgcgcagcggcgcgggcggaucggccgcaaccacaacaaggagggcgaccaguacaucuacauggggcagccgcucaacaacgacgaggaccacgcccacuggacggaggccaagaugcugcuggacaacaucaacacccccgagggcaucauccccgcccucuucgagcccgagcgggagaaguccgccgcgaucgacggggaguaccgccugcgcggcgaggcccggaagaccuucguggagcugaugcgccgcggggaccucccgguguggcuguccuacaaggucgccagcgagggcuuccaguacagcgaccgccgguggugcuucgacggcgagcgcaacaaccaggugcuggaggagaacauggacguggagaucuggaccaaggagggggagcggaagaagcuccgcccccgguggcuggacgcccgcacguacuccgacccccuggcccuccgggaguucaaggaguucgcggccggccgccggagcgucuccggggaccugauccuggagaucggcaagcucccccagcaccugacccagcgcgcccagaacgcccuggacaaccucgugaugcugcacaacagcgagcagggcgggcgggcguaccgccacgccauggaggagcugccggacaccaucgagacccucaugcugcuggcccucaucgccgugcugacgggcggggucacccuguucuuccucuccggccgggggcugggcaagaccagcaucggccugcucugcgugauggccuccagcgugcugcuguggauggcguccgucgagccccacuggaucgccgccagcaucauccucgaguucuuccugauggugcugcucauccccgagcccgaccgccagcggaccccgcaggacaaccagcuggccuacguggucaucgggcuccucuucaugauccugaccguggccgcgaacgagaugggccugcucgagacgaccaagaaggaccuggggaucggccacguggccgucgagaaccaccaccacgccaccaugcuggacguggaccuccaccccgccuccgccuggacccuguacgcgguggccacgaccaucaucacccccaugaugcgccacaccaucgagaacacgaccgccaacaucagccugaccgccaucgccaaccaggcggccauccucauggggcuggacaagggcuggccgaucuccaagauggacaucggcgucccccugcucgcccuggggugcuacagccaggugaacccccugacccucacggccgcggugcugaugcuggucgcccacuacgccaucaucggccccgggcuccaggccaaggccacccgggaggcgcagaagcgcaccgccgccggcaucaugaagaacccgaccguggacgggaucguggccaucgaccuggaccccgucguguacgacgccaaguucgagaagcagcugggccagaucaugcuccugauccugugcacgucccagauccuccugaugcgcaccaccugggcgcugugcgagagcaucacccucgccacgggcccccugaccacccugugggaggggucccccggcaaguucuggaacaccacgaucgccgugagcauggccaacaucuuccggggguccuaccucgccggcgcgggccuggccuucagccugaugaagucccucgggggcgggcgccggggcaccggggcccagggcgagacccugggcgagaaguggaagcgccagcugaaccagcucuccaagagcgaguucaacaucuacaagcgguccgggaucauggaggucgaccgcagcgaggccaaggagggccugaagcgcggggagaccacgcgccacgcggugucccggggcaccgccaagcugcgcugguucguggagcggaaccuggucaagccggaggggaaggugaucgaccucggcugcggccgcgggggcuggagcuacuacugcgccgggcugaagaaggugaccgaggucaagggcuacaccaagggcgggcccggccacgaggagcccauccccauggccacguacggguggaaccuggugaagcuccacuccggcaaggacguguucuucaccccgcccgagaagugcgacacccugcugugcgacaucggggagagcucccccaaccccaccaucgaggagggccggacgcuccgcguccugaagaugguggagccguggcugcgggggaaccaguucugcaucaagauccucaaccccuacaugcccagcguggucgagacccuggagcagaugcagcgcaagcacggcggcaugcuggugcggaacccccucucccgcaacagcacccacgagauguacuggguguccugcgggaccggcaacaucgucagcgccgugaacaugaccucccggaugcugcugaaccgcuucacgauggcgcaccgcaagccgaccuacgagaaggacguggaccucggggccggcacccggcacgucgccguggagcccgagguggccaaccuggacaucaucggccagcgcaucgagaacaucaagcacgagcacaagagcaccuggcacuacgacgaggacaaccccuacaagacgugggccuaccacggguccuacgaggucaagcccagcggcuccgcgagcagcauggugaacggggucgugaagcugcucaccaagccgugggacgugauccccauggucacccagaucgccaugaccgacacgacccccuucggccagcagcggguguucaaggagaagguggacacccgcacccccaaggccaagcgggggacgguccagaucauggaggugaccgcccgcuggcuguggggcuuccugucccggaacaagaagccgcgcaucugcacccgggaggaguucacccgcaaggugcggagcaacgccgcgaucggcgccgucuucguggacgagaaccaguggaacuccgccaaggaggccguggaggacgagcgcuucugggaccucgucaagaaggagcgggagcugcacaagcaggggaagugcgcgacgugcguguacaacaugaugggcaagcgcgagaagaagcugggggaguucggcaaggccaaggggagccgggccaucugguacauguggcucggcgcccgcuuccuggaguucgaggcccugggcuucaugaacgaggaccacugguucucccgggagaacagccucuccgggguggagggcgaggggcugcacaagcugggcuacauccuccgcgacaucagcaagauccccgggggcaacauguacgcggacgacaccgccggcugggacacccggaucaccgaggacgaccugcagaacgaggccaagaucacggacaucauggagcccgagcacgcccugcucgccaccuccaucuucaagcugaccuaccagaacaaggucgugcgcgugcagcggccggcgaagaacgggaccgucauggacgugaucagccgccgcgaccagcggggcuccggccaggugggcacguacggccugaacaccuucaccaacauggaggcccagcucauccgccagauggagagcgaggggaucuuccugcccuccgagcuggagacccccaaccucgccgagcggguccuggacuggcuggagaaguacggcguggagcgccucaagcggauggccaucagcggggacgacugcguggucaagcccaucgacgaccgcuucgccacggcgcugaccgcccugaacgacaugggcaaggugcggaaggacaucccgcagugggagcccuccaagggguggaacgacuggcagcagguccccuucugcagccaccacuuccaccagcucaucaugaaggacggccgcgagaucgucgugcccugccggaaccaggacgagcuggugggccgcgcccgggucucccagggggccggcuggagccugcgcgagaccgccugccucggcaagagcuacgcgcagauguggcagcugauguacuuccaccggcgcgaccugcggcucgccgccaacgccaucugcuccgcggugccgguggacuggguccccaccagccgcacgaccugguccauccacgcccaccaccaguggaugaccaccgaggacaugcugagcguguggaaccggguguggaucgaggagaaccccuggauggaggacaagacgcacgucuccagcugggaggacgugcccuaccugggcaagcgcgaggaccaguggugcgggucccucaucggccugaccgcccgggccaccugggccagcaacauccagguggcgaucaaccagguccgccgccugaucggcaacgagaacuaccucgacuacaugaccuccaugaagcgguucaagaacgagggggacccggagggcgcccugugguga

SEQ ID NO: 8465 - RNA, 9879 nt, Artificial Sequence
  derived and/or modified CDS sequence (opt1) from DENV-1__FJ882544__SS-prME
agcgugaccaugcugcucaugcugaugcccaccgcccuggccuuccaccucaccacccgcggcggggagccccacaugaucgugagcaagcaggagcggggcaagagccugcuguucaagaccuccgccggggugaacaugugcacccucaucgccauggaccugggcgagcugugcgaggacaccaugaccuacaagugcccccggaucaccgagaccgagcccgacgacguggacugcuggugcaacgccacggacaccugggugaccuacgggaccugcagccagacgggcgagcaccggcgcgacaagcgguccguggcccucgcgccccacgugggccuggggcuggagacccgcaccgagaccuggaugagcuccgagggcgcguggaagcagauccagcgggucgagacgugggcccuccgccaccccggguucaccgugaucgcccuguuccuggcccacgcgaucggcaccagcaucacccagaaggggaucaucuucauccuccugaugcuggugacgcccuccauggccaugcggugcgucggcaucggcaaccgcgacuucguggaggggcucagcggcgccaccuggguggacgucgugcuggagcacggguccugcgugaccaccauggccaaggacaagcccacgcuggacaucgagcuccugaagaccgaggucaccaaccccgccgugcugcggaagcucugcaucgaggcgaagaucagcaacaccacgaccgacucccgcugcccgacccagggcgaggccacccugguggaggagcaggacgccaacuucgucugccggcgcacguucguggaccggggcugggggaacggcugcgggcuguucggcaaggggagccucaucacgugcgccaaguucaagugcgugaccaagcuggagggcaagaucguccaguacgagaaccugaaguacuccgugaucgugaccguccacacgggcgaccagcaccagguggggaacgagagcaccgagcacggcaccaccgccaccaucacgccccaggcgcccaccaccgagauccagcucaccgacuacggggcccugacgcuggacugcagcccccggaccggccucgacuucaacgagaugguccugcugaccaugaaggagaaguccuggcucgugcacaagcagugguuccuggaccugccccuccccuggaccuccggggccagcacgagccaggagaccuggaaccggcaggaccugcuggugaccuucaagaccgcccacgccaagaagcaggaggucguggugcucggcucccaggagggcgcgaugcacacggcccugaccggggccaccgagauccagaccagcggcacgaccaccaucuucgccgggcaccugaagugccgccucaagauggacaagcugacccugaagggcauguccuacgucaugugcacggggagcuucaagcucgagaaggagguggccgagacccagcacggcaccgugcugguccagaucaaguacgagggcaccgacgcgcccugcaagauccccuucuccacgcaggacgagaagggggugacccagaacggccggcugaucaccgccaacccgaucgugaccgacaaggggaagcccgucaacaucgaggccgagccgcccuucggcgagagcuacaucgugaucggcgccggggagaaggcgcugaagcucuccugguucaagaagggcagcuccaucgggaagauguucgaggccacggcccgcggcgcccggcgcauggccauccugggggacaccgcgugggacuucggcagcaucggcgggguguucaccuccgucggcaagcuggugcaccagaucuucgggaccgccuacggcgugcuguucagcggggucuccuggacgaugaagaucggcaucggcgugcugcugaccuggcucgggcugaacagccgcuccaccagccuguccaugaccugcaucgccgugggccucgucacgcuguaccugggggugauggugcaggccgacagcggcugcgucaucaacuggaaggggcgggagcucaagugcggcuccggcaucuucgugaccaacgaggugcacaccuggaccgagcaguacaaguuccaggccgacagcccgaagcgccugagcgcggccaucgggaaggccugggaggagggcgucugcgggauccgguccgccacccgccuggagaacaucauguggaagcagaucagcaacgagcucaaccacauccugcuggagaacgacaugaaguucacggugguggucggcgacguggccgggauccucgcgcagggcaagaagaugauccggccccagcccauggaguacaaguacuccuggaaguccuggggcaaggccaagaucaucggggccgacgugcagaacaccaccuucaucaucgacggccccaacaccccggagugccccgacgaccagcgcgccuggaacaucugggaggucgaggacuacggguucggcaucuucacgaccaacaucuggcugaagcugcgggacuccuacacccaggugugcgaccaccgccucaugagcgcggccaucaaggacuccaaggccgugcacgccgacaugggcuacuggaucgagagcgagaagaacgagaccuggaagcuggcccgggcguccuucaucgaggucaagacgugcaucuggcccaagagccacacccugugguccaacggggugcucgagagcgagaugaucauccccaagaucuacggcgggccgaucucccagcacaacuaccgccccggcuacuucacccagaccgccgggcccuggcaccugggcaagcuggagcucgacuucgaccugugcgagggcacgaccguggucguggacgagcacugcgggaaccggggcccgagccugcgcaccaccacggugaccgggaagaucauccacgaguggugcugccgguccugcacccugccgccccuccgcuuccggggcgaggacgggugcugguacggcauggagauccgccccgucaaggagaaggaggagaaccuggucaagagcaugguguccgccggcagcggggaggucgacagcuucucccucggccugcugugcaucagcaucaugaucgaggaggugaugcggucccgcuggagccggaagaugcucaugaccgggacgcuggccguguucuuccugcucaucaugggccagcugaccuggaacgaccugauccgccucugcaucauggucggggccaacgcguccgaccgcaugggcaugggcaccaccuaccuggcccugauggccacguucaagaugcggccgauguucgccguggggcuccuguuccgccggcugaccagccgcgaggugcuccugcugaccaucggccucucccuggucgccagcguggagcugcccaacucccucgaggagcugggggacggccuggcgaugggcaucaugauccucaagcugcugaccgacuuccagagccaccagcucugggccacgcugcugucccucaccuucaucaagaccaccuucagccugcacuacgccuggaagacgauggccaugguccuguccaucgugagccucuucccccugugccuguccaccaccagccagaagaccacguggcuccccgugcugcuggggucccucggcugcaagccgcugaccauguuccugaucgcggagaacaagaucugggggcggcgcagcuggccccucaacgagggcaucauggccgucgggaucguguccauccugcugagcagccuccugaagaacgacgugccccuggccggcccccucaucgccggcgggaugcugaucgccugcuacgucaucuccggcagcuccgcggaccugagccucgagaaggccgccgagguguccugggaggaggaggccgagcacagcggggccucccacaacauccugguggagguccaggacgacggcaccaugaagaucaaggacgaggagcgggacgacacccugaccauccuccugaaggcgacgcugcucgccgugagcgggguguacccgcuguccauccccgccacccuguucgucugguacuucuggcagaagaagaagcagcgcagcggcgugcucugggacacccccagcccgcccgaggugggccgggccguccuggacgacgggaucuaccgcaucaugcagcggggccugcuggggcgcagccaggugggcgugggggucuuccaggagaacguguuccacaccauguggcacgugacgcggggcgccguccucauguaccagggcaagcgccuggagcccuccugggcgagcgugaagaaggaccugaucuccuacgggggcggguggcggcuccagggcagcuggaacaccggggaggaggugcaggucaucgccguggagcccggcaagaaccccaagaacgugcagaccgcccccggcaccuucaagacgcccgagggggaggucggcgccaucgcccuggacuucaagcccgggaccuccggcagccccaucgugaaccgcgagggcaagaucguggggcuguacggcaacggggucgugaccaccuccggcacguacgugagcgcgaucgcccaggccaaggccagccaggaggggccgcuccccgagaucgaggacgaggucuuccggaagcgcaaccugaccaucauggaccugcaccccggcuccggcaagacccggcgcuaccucccggcgaucgugcgggaggccaucaagcgcaagcugcgcacccugauccucgcccccacgcggguggucgccagcgagauggccgaggcgcugaaggggaugcccauccgcuaccagaccaccgccgugaaguccgagcacaccggcaaggagaucguggaccugaugugccacgccacguucaccaugcggcuccugagccccguccgcgugccgaacuacaacaugaucaucauggacgaggcccacuucaccgaccccuccagcaucgccgcgcggggguacaucuccacccgcgugggcaugggggaggccgccgccaucuucaugacggccacgccgcccggcagcgucgaggcguucccgcaguccaacgccgugauccaggacgaggagcgggacauccccgagcgcagcuggaacuccggcuacgaguggaucaccgacuuccccgggaagaccgugugguucguccccagcaucaaguccggcaacgacaucgccaacugccugcggaagaacgggaagcgcgugauccagcucagccggaagacguucgacaccgaguaccagaagaccaagaacaacgacugggacuacguggucaccacggacaucuccgagaugggcgccaacuuccgcgcggaccgggugaucgacccgcgccggugccugaagcccgugauccugaaggacgggcccgagcgcgucauccucgccggccccaugccggugaccgucgccagcgccgcccagcggcgcggccggaucgggcgcaaccacaacaaggagggcgaccaguacaucuacauggggcagccccugaacaacgacgaggaccacgcgcacuggaccgaggccaagaugcugcucgacaacaucaacacccccgagggcaucauccccgcccuguucgagccggagcgcgagaaguccgccgccaucgacggggaguaccggcugcgcggcgaggcgcggaagacguucguggagcucaugcgccggggcgaccugcccguguggcugagcuacaaggucgccuccgagggguuccaguacagcgaccgccgguggugcuucgacggcgagcgcaacaaccaggugcucgaggagaacauggacguggagaucuggaccaaggagggggagcggaagaagcugcgcccccgguggcuggacgcccgcaccuacagcgacccccucgcccugcgggaguucaaggaguucgccgcgggccgccgguccgucagcggcgaccugauccucgagaucgggaagcugccgcagcaccugacccagcgcgcccagaacgcccucgacaaccuggugaugcugcacaacuccgagcagggcgggcgggccuaccgccacgcgauggaggagcuccccgacacgaucgagacccugaugcugcucgcccugaucgccgugcugaccggcggggucacccucuucuuccugagcggccggggccuggggaagaccuccaucggccuccugugcgugauggccagcuccgugcugcucuggauggccagcgucgagccccacuggaucgcggccuccaucauccuggaguucuuccugauggugcuccugauccccgagccggaccgccagcggacgccccaggacaaccagcuggccuacguggucaucgggcuccuguucaugauccugaccguggccgccaacgagaugggccuccuggagaccaccaagaaggaccuggggaucggccacguggcggucgagaaccaccaccacgccgccaugcucgacguggaccugcaccccgccagcgccuggacgcuguacgcgguggccaccaccaucaucaccccgaugaugcgccacacgaucgagaacaccaccgccaacaucucccucaccgccaucgccaaccaggcggccauccugaugggccuggacaagggguggcccaucagcaagauggacaucggcgucccccuccuggcccuggggugcuacucccaggugaacccccucacgcugaccgccgcggugcugaugcucgucgcccacuacgccaucaucggcccggggcugcaggccaaggccacccgcgaggcgcagaagcggaccgccgccggcaucaugaagaaccccacgguggacggcaucguggccaucgaccuggaccccgucguguacgacgccaaguucgagaagcagcucgggcagaucaugcugcugauccucugcaccagccagauccugcugaugcgcaccaccugggcgcucugcgaguccaucacgcuggccaccggcccccugaccacccucugggaggggagcccgggcaaguucuggaacacgaccaucgccguguccauggccaacaucuuccggggcagcuaccuggccggggcgggccuggccuucucccucaugaagucccucgggggcgggcgccgggggaccggcgcccagggggagacccugggcgagaaguggaagcgccagcucaaccagcugagcaaguccgaguucaacacguacaagcggagcgggaucauggaggucgaccgcuccgaggccaaggagggccugaagcgcggggagaccaccaagcacgcggugagccgcggcaccgccaagcuccggugguucguggagcgcaaccuggucaagcccgagggcaaggugaucgaccuggggugcggccgcgggggcugguccuacuacugcgccgggcugaagaaggugacggaggucaagggcuacaccaagggcgggcccggccacgaggagcccaucccgauggccaccuacggguggaaccucgugaagcugcacagcggcaaggacguguucuucaucccgcccgagaagugcgacacccugcucugcgacaucggggaguccagccccaacccgacgaucgaggagggccgcacccugcggguccugaagaugguggagcccuggcuccgcggcaaccaguucugcaucaagauccugaaccccuacaugcccuccguggucgagacccuggagcagaugcagcggaagcacgggggcaugcucgugcgcaacccgcugagccggaacuccacccacgagauguacugggugagcugcgggaccggcaacaucgucuccgccgugaacaugacgagccgcaugcugcucaaccgcuucaccauggcgcaccggaagcccaccuacgagcgcgacguggaccugggcgccgggacccggcacgucgccguggagcccgagguggccaaccuggacaucaucggccagcgcaucgagaacaucaagcacgagcacaaguccacguggcacuacgacgaggacaaccccuacaagaccugggccuaccacgggagcuacgaggucaagccguccggcagcgcguccagcauggugaacggggucgugaagcuccugaccaagcccugggacgugauccccauggucacccagaucgccaugacggacaccacccccuucggccagcagcggguguucaaggagaagguggacacccgcacgccgaaggccaagcggggcaccgcccagaucauggaggucaccgccaaguggcuguggggguuccucagccgcaacaagaagccccggaucugcacccgcgaggaguucacgcggaaggugcgcuccaacgcggccaucggcgccguguucgucgacgagaaccaguggaacagcgccaaggaggcgguggaggacgagcgguucugggaccuggugcaccgcgagcgggagcugcacaagcaggggaagugcgcgaccugcgucuacaacaugaugggcaagcgcgagaagaagcucggggaguucggcaaggccaagggcucccgggccaucugguacauguggcugggggcccgcuuccuggaguucgaggcgcucggcuucaugaacgaggaccacugguucagccgggagaacucccugagcgggguggagggcgaggggcugcacaagcucggcuacauccugcgcgacaucuccaacauccccggcgggaacauguacgccgacgacaccgccggcugggacacccggaucacggaggacgaccugcagaacgaggcccgcaucaccgacaucauggagccggagcacgcccuccuggccaagagcaucuucaagcugaccuaccagaacaaggugguccgcgugcagcggcccgccaagaacgggaccgugauggacgucaucucccgccgggaccagcgcggcagcggccagguggggacguacggccucaacaccuucaccaacauggaggcccagcugauccggcagauggaguccgaggggaucuucagccccuccgagcuggagacccccaaccucgccgagcgcgugcuggacuggcuggagaaguacggcgucgagcggcucaagcgcauggccaucagcggggacgacugcguggugaagccgaucgacgaccgguucgcgacggcccugaccgcccugaacgacaugggcaagguccgcaaggacaucccccagugggagcccuccaagggcuggaacgacuggcagcagguccccuucugcagccaccacuuccaccagcucaucaugaaggacgggcgggagaucguggucccgugccgcaaccaggacgagcuggugggccgggcccgcgugucccagggggccggcuggagccugcgggagaccgcgugccucggcaagagcuacgcccagauguggcagcugauguacuuccaccgccgggaccugcgccucgccgccaacgcgaucugcuccgccguccccguggacuggauccccaccagccggacgaccugguccauccacgcccaccaccaguggaugaccaccgaggacaugcugagcguguggaaccgcgucuggaucgaggagaaccccuggauggaggacaagacgcacaucuccagcuggggcgacgugccguaccugggcaagcgcgaggaccaguggugcgggucccucaucggccugaccgcccgggccaccugggcgaccaacauccagguggccaucaaccagguccgccggcugaucgggaacgagaacuaccucgacuacaugaccagcaugaagcgcuucaagaacgaguccgaccccgagggcgcccugugguga

SEQ ID NO: 8466 - RNA, 9879 nt, Artificial Sequence
  derived and/or modified CDS sequence (opt1) from DENV-1__FJ898371__SS-prME
agcgugaccaugcugcucaugcugaugcccaccgcccuggccuuccaccucaccacccggggcggggagccccacaugaucgugaccaagcaggagcggggcaagagccugcuguucaagaccagcgcgggggugaacaugugcacccucaucgccauggaccugggcgagcugugcgaggacaccaugaccuacaagugcccccggaucaccgaggccgagcccgacgacguggacugcuggugcaacgccaccgacaccugggugaccuacgggaccugcucccagacgggcgagcaccggcgcgacaagcggagcguggcccucgcgccccacgugggccuggggcuggagacccgcaccgagaccuggauguccagcgagggcgccuggaagcagauccagcgggucgagacgugggcccuccgccaccccggguucaccgugaucgcccuguuccuggcgcacgccaucggcaccuccaucacccagaaggggaucaucuucauccuccugaugcuggugacgcccagcauggccaugcggugcgucggcaucggcucccgcgacuucguggaggggcucagcggcgccaccuggguggacgucgugcuggagcacggguccugcgugaccaccauggccaaggacaagcccacgcuggacaucgagcuccugaagaccgaggucaccaaccccgcggugcugcggaagcucugcaucgaggccaagaucagcaacaccacgaccgacucccgcugccccacccagggcgaggccacccugauggaggagcaggacgccaacuucgugugccggcgcacguucgucgaccggggcugggggaacggcugcgggcuguucggcaaggggagccucaucacgugcgccaaguucaagugcgugaccaagcuggagggcaagaucgugcaguacgagaaccugaaguacuccgucaucgugaccgugcacacgggcgaccagcaccaggucgggaacgagagcaccgagcacggcaccaccgcgaccaucacgccccaggcccccaccuccgagauccagcucaccgacuacggggcccugacccuggacugcagcccccgcacgggccucgacuucaacgagauggugcugcugaccaugaaggagaaguccuggcucguccacaagcagugguuccuggaccugccgcuccccuggaccagcggggccagcaccucccaggagacguggaaccggcaggaccugcuggugaccuucaagaccgcccacgcgaagaagcaggagguggucgugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgugaugugcaccggguccuucaagcucgagaaggaggucgcggagacgcagcacggcaccgugcuggugcagaucaaguacgagggcaccgacgcccccugcaagauccccuuccugacccaggacgagaagggggucacgcagaacggccggcugaucaccgccaacccgaucgugaccgacaaggagaagcccgugaacaucgaggccgagccgcccuucggggagagcuacaucgucaucggcgcgggcgagaaggcccucaagcuguccugguucaagaaggggagcuccaucggcaagauguucgaggccaccgcccgcggggcccggcgcauggcgauccugggcgacacggccugggacuucgggagcaucggcggcguguucaccuccguggggaagcucguccaccagaucuucggcaccgccuacggggugcuguucagcggcguguccuggaccaugaagaucgggaucggcguccugcucacguggcugggccugaacagccgcuccaccagccucuccaugaccugcaucgccguggggcuggugacccuguaccucggcgucauggugcaggccgacagcgggugcgugaucaacuggaagggccgggagcugaagugcggguccggcaucuucgucacgaacgaggugcacaccuggaccgagcaguacaaguuccaggcggacagcccgaagcgccugagcgccgccaucggcaaggccugggaggagggggugugcggcauccgguccgccacccgccucgagaacaucauguggaagcagaucagcaacgagcugaaccacauccugcucgagaacgacaugaaguucaccgucguggugggggacgucgugggcauccuggcgcaggggaagaagaugauccggccccagcccauggagcacaaguacuccuggaaguccuggggcaaggccaagaucaucggcgccgacgugcagaacacgaccuucaucaucgacgggcccaacaccccggagugccccgacgaccagcgcgccuggaacaucugggaggucgaggacuacggcuucgggaucuucaccacgaacaucuggcugaagcuccgggacucccacacccaggugugcgaccaccgccugaugagcgcggccaucaaggacuccaaggccgugcacgccgacaugggcuacuggaucgagagcgagaagaacgagaccuggaagcuggcccgggcguccuucaucgaggucaagaccugcaucuggcccaagagccacacgcucugguccaacggcgugcuggagagcgagaugaucauccccaagaucuacgggggcccgaucucccagcacaacuaccgccccggguacuucacccagaccgccggccccuggcaccuggggaagcucgagcuggacuucgaccugugcgagggcaccacgguggucguggacgagcacugcggcaaccgggggccgagccuccgcaccaccaccgugacgggcaagaucauccacgaguggugcugccgguccugcacccugccgccccugcgcuucaagggggaggacggcugcugguacgggauggagauccggcccgucaaggagaaggaggagaaccucgucaagagcaugguguccgccggcagcggcgaggucgacagcuucucccuggggcugcucugcaucagcaucaugaucgaggaggugaugcgcucccgguggagccgcaagaugcugaugaccggcacccuggccguguuccuccugcugaucauggggcagcucacguggaacgaccugauccggcugugcaucauggucggcgccaacgcguccgaccgcauggggaugggcaccaccuaccucgcccugauggccaccuucaagaugcgcccgauguucgccguggggcugcuguuccggcgccugacgagccgggaggugcugcuccugaccaucgggcugucccucgucgccagcguggagcugcccaacucccuggaggagcucggcgacgggcuggcgaugggcaucaugauccugaagcuccugaccgacuuccagagccaccagcugugggccacccuccugucccugacguucaucaagaccacccucagccugcacuacgccuggaagaccauggccaugguccuguccaucgugagccucuucccccugugccuguccacgaccagccagaagaccaccuggcuccccgugcugcugggcucccucgggugcaagccgcugacgauguuccugaucgcggagaacaagaucuggggccgcaagagcuggccccucaacgaggggaucauggccgucggcgugguguccauccugcugagcagccuccugaagaacgacgucccccuggccgggccccucaucgccggcggcaugcugaucgccugcuacgugaucuccgggagcuccgcggaccugagccucgagaaggccgccgagguguccugggaggaggaggccgagcacagcggcgccucccacaacauccuggucgaggugcaggacgacgggaccaugaagaucaaggacgaggagcgggacgacacccugaccauccuccugaaggcgacccugcucgccgugagcggcgucuacccgcuguccauccccgccacgcuguucgugugguacuucuggcagaagaagaagcagcgcagcggggugcugugggacacccccagcccgcccgaggucgagcgggccgugcucgacgacggcaucuaccgcaucaugcagcggggccugcuggggcgcagccaggugggcgucgggguguuccaggagaacguguuccacaccauguggcacgucacccggggcgccgugcucauguaccaggggaagcgccuggagcccuccugggcgagcgugaagaaggaccugaucuccuacggcggcggguggcggcuccagggcagcuggaacacgggggaggagguccaggugaucgccguggagcccggcaagaaccccaagaacguccagaccgcccccgggaccuucaagacccccgagggcgaggugggcgccaucgcccuggacuucaagcccgggacguccggcagccccaucgugaaccgcgaggggaagaucgucggccuguacggcaacgggguggugaccaccuccggcaccuacgucagcgcgaucgcccaggccaaggccagccaggaggggccgcuccccgagaucgaggacgagguguuccggaagcgcaaccugacgaucauggaccugcaccccggcuccgggaagacccggcgcuaccucccggcgaucgugcgggaggccaucaagcgcaagcugcggacccugauccucgcccccacccgcgucguggccagcgagauggccgaggcgcugaagggcaugcccauccgcuaccagacgaccgccgugaaguccgagcacaccggcaaggagaucgucgaccugaugugccacgccaccuucacgaugcggcuccugagccccgugcgcgugccgaacuacaacaugaucaucauggacgaggcccacuucaccgaccccuccagcaucgccgcgcggggguacaucuccacccgcgucggcaugggggaggccgccgccaucuucaugaccgccacgccgcccggcagcguggaggcguucccgcaguccaacgccgugauccaggacgaggagcgggacauccccgagcgcagcuggaacuccggguacgaguggaucaccgacuuccccggcaagaccgucugguucgugcccagcaucaaguccggcaacgacaucgccaacugccugcggaagaacgggaagcgcgugauccagcucagccggaagaccuucgacacggaguaccagaagaccaagaacaacgacugggacuacgucgugaccaccgacaucuccgagaugggcgccaacuuccgcgcggaccgggugaucgacccgcgccggugccugaagcccgucauccugaaggacgggcccgagcgcgugauccucgccggccccaugccggucacgguggccagcgccgcccagcggcgcgggcggaucggccgcaaccacaacaaggagggcgaccaguacaucuacauggggcagccccugaacaacgacgaggaccacgcgcacuggaccgaggccaagaugcugcucgacaacaucaacacccccgagggcaucauccccgcccuguucgagccggagcgggagaaguccgccgccaucgacggggaguaccgccugcgcggcgaggcgcggaagaccuucguggagcucaugcgccgcggggaccugcccgucuggcugagcuacaagguggccuccgagggcuuccaguacagcgaccgccgguggugcuucgacggcgagcgcaacaaccaggugcucgaggagaacauggacgucgagaucuggacgaaggagggggagcggaagaagcugcgcccccgguggcuggacgcccgcaccuacagcgacccccucgcccugcgggaguucaaggaguucgccgcgggccgccgguccgugagcggggaccugauccucgagaucggcaagcugccgcagcaccugacccagcgcgcccagaacgcccucgacaaccuggugaugcugcacaacuccgagcagggcgggcgggccuaccgccacgcgauggaggagcuccccgacaccaucgagacgcugaugcugcucgcccugaucgccguccugaccggcggggugacccucuucuuccugagcggccgggggcugggcaagaccuccaucggccuccugugcgugauggccagcuccguccugcucuggauggccagcguggagccccacuggaucgcggccuccaucauccuggaguucuuccugauggugcuccugauccccgagccggaccgccagcggacgccccaggacaaccagcuggccuacgucgugaucgggcuccuguucaugauccugacgguggccgccaacgagaugggccuccuggagaccaccaagaaggaccuggggaucggccacgucgcgguggagaaccaccaccacgccaccaugcucgacguggaccugcaccccgccagcgccuggacgcuguacgccgucgcgaccaccaucaucaccccgaugaugcgccacacgaucgagaacaccaccgccaacaucucccucaccgccaucgccaaccaggccgcgauccugauggggcuggacaagggcuggcccaucagcaagauggacaucggcgugccccuccuggcccuggggugcuacucccaggugaacccccucacgcugaccgccgccguccugaugcucguggcgcacuacgccaucaucggcccggggcugcaggccaaggccacccgggaggcccagaagcgcaccgcggccggcaucaugaagaaccccacgguggacgggaucgucgccaucgaccuggaccccgugguguacgacgccaaguucgagaagcagcucggccagaucaugcugcugauccucugcaccagccagauccugcugaugcgcaccaccugggcccucugcgaguccaucacgcuggcgaccggcccccugaccacccucugggaggggagcccgggcaaguucuggaacacgaccaucgccgucuccauggccaacaucuuccgggggagcuaccuggccggcgccggccuggcguucucccucaugaagucccucgggggcgggcgccgggggaccggggcccagggcgagacccugggcgagaaguggaagcgccagcucaaccagcugagcaaguccgaguucaacaucuacaagcggagcgggaucauggagguggaccgcuccgaggccaaggagggccugaagcgcggggagacgacccgccacgccgugagccggggcaccgcgaagcugcgcugguucgucgagcggaaccucgugaagcccgaggggaaggugaucgaccugggcugcggccgcgggggcugguccuacuacugcgccgggcugaagaaggucaccgaggugaagggcuacacgaagggcgggcccggccacgaggagcccaucccgauggccaccuacggguggaaccucgugaagcugcacagcggcaaggacgucuucuucacgccgcccgagaagugcgacacccugcucugcgacaucggggaguccagccccaacccgacgaucgaggagggccggacccugcgcgugcugaagaugguggagcccuggcuccgggggaaccaguucugcaucaagauccugaaccccuacaugcccuccgucguggagacccuggagcagaugcagcgcaagcacggcggcaugcucgugcggaacccgcugagccgcaacuccacccacgagauguacugggucagcugcgggaccggcaacaucguguccgccgugaacaugacgagccggaugcugcucaaccgcuucaccauggcccaccgcaagcccaccuacgagcgggacgucgaccugggggcgggcacccgccacguggccguggagcccgaggucgccaaccuggacaucaucggccagcggaucgagaacaucaagcacgagcacaaguccacguggcacuacgacgaggacaaccccuacaagaccugggccuaccacgggagcuacgaggugaagccguccggcagcgccuccagcauggucaacgggguggugaagcuccugaccaagcccugggacgucauccccauggugacccagaucgcgaugacggacaccacccccuucggccagcagcgcguguucaaggagaaggucgacacccggacgccgaaggccaagcgcgggaccgcccagaucauggaggugaccgcccgguggcuguggggcuuccucagccgcaacaagaagccccggaucugcacccgcgaggaguucacgcggaaggugcgcuccaacgccgcgaucggcgccgucuucguggacgagaaccaguggaacagcgccaaggaggccguggaggacgagcgguucugggaccugguccagaaggagcgcgagcugcacaagcaggggaagugcgcgaccugcguguacaacaugaugggcaagcgggagaagaagcucggggaguucggcaaggccaaggggucccgcgccaucugguacauguggcugggcgcccgguuccuggaguucgaggcccucggcuucaugaacgaggaccacugguucagccgcgagaacucccugagcgggguggagggcgaggggcugcacaagcucggcuacauccugcgggacaucuccaagauccccgggggcaacauguacgcggacgacaccgccggcugggacacccgcaucacggaggacgaccugcagaacgaggccaagaucaccgacaucauggagccggagcacgcccuccuggccaccagcaucuucaagcugaccuaccagaacaaggucgugcgggugcagcgccccgcgaagaacgggacggucauggacgugaucucccgccgggaccagcgcggcagcggccaggugggcaccuacggccucaacaccuucaccaacauggaggcccagcugauccggcagauggaguccgaggggaucuuccugcccagcgagcucgagacgcagaaccuggccgagcgcguccuggacuggcucgagaaguacggcguggagcggcugaagcgcauggccaucuccggggacgacugcguggucaagcccaucgacgaccgguucgccaccgcgcugaccgcccucaacgacaugggcaaggugcgcaaggacaucccgcagugggagcccagcaagggguggaacgacuggcagcagguccccuucugcucccaccacuuccaccagcugaucaugaaggacggccgggagaucgucgugcccugccgcaaccaggacgagcuggugggccgggcccgcgucagccagggggccggcuggucccuccgggagaccgccugccugggcaagagcuacgcgcagauguggcagcugauguacuuccaccgccgggaccuccgccuggccgccaacgccaucugcagcgcggugccgguggacuggguccccacgucccggaccaccuggagcauccacgcccaccaccaguggaugaccacggaggacaugcuguccguguggaaccgcguguggaucgaggagaaccccuggauggagaacaagacccacgucagcuccuggggcgacgugcccuaccucgggaagcgggaggaccaguggugcggcagccugaucggccugaccgcccgcgccaccugggccuccaacauccagguggcgaucaaccagguccgccggcucaucgggaacgagaacuaccuggacuacaugaccagcaugaagcgcuucaagaacgagggcgacccggagggggcccugugguga

SEQ ID NO: 8467 - RNA, 9879 nt, Artificial Sequence
  derived and/or modified CDS sequence (opt1) from DENV-1__FJ882545__SS-prME
agcgugaccaugcugcucaugcugaugcccaccgcccuggccuuccaccucaccacccgcggcggggagccccacaugaucgugagcaagcaggagcggggcaagagccugcuguucaagaccagcgccggggugaacaugugcacccucaucgccauggaccugggcgagcugugcgaggacacgaugaccuacaagugcccccgcaucaccgaggccgagcccgacgacguggacugcuggugcaacgccaccgacacgugggugaccuacgggaccugcagccagaccggcgagcaccggcgcgacaagcgguccguggcccucgcgccccacgugggccuggggcuggagacgcgcaccgagaccuggaugagcuccgagggcgccuggaagcagauccagcgggucgagaccugggcccuccgccaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcggugcugcggaagcucugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacaccggcgaccagcaccagguggggaacgaguccacggagcacggcaccaccgcgaccaucacgccccaggcccccacgaccgagauccagcucaccgacuacggggcccugacccuggacugcagcccccgcacgggccucgacuucaacgagaugguccugcugaccaugaaggagaaguccuggcucgugcacaagcagugguuccuggaccugccccuccccuggaccagcggggccagcaccucccaggagacguggaaccggcaggaccugcuggugaccuucaagaccgcccacgcgaagaagcaggaggucguggugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgucaugugcaccggguccuucaagcucgagaaggagguggcggagacgcagcacggcaccgugcugguccagaucaaguacgagggcaccgacgcccccugcaagauccccuucagcacccaggacgagaagggggugacgcagaacggccggcugaucaccgccaacccgaucgugaccgacaaggagaagcccgucaacaucgaggccgagccgcccuucggggaguccuacaucgugaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcgucgggaagcuggugcaccagaucuucggcaccgccuacgggguccucuucuccggcgucagcuggaccaugaagaucgggaucggcgugcugcugacguggcucggccugaacucccgcagcaccucccugagcaugaccugcaucgccguggggcucgucacccuguaccugggcgugauggugcaggccgacuccgggugcgucaucaacuggaagggccgggagcucaagugcgggagcggcaucuucgugacgaacgaggugcacaccuggaccgagcaguacaaguuccaggcggacagcccgaagcgccuguccgccgccaucggcaaggccugggaggagggggucugcggcauccggagcgccacccgccuggagaacaucauguggaagcagaucuccaacgagcucaaccacauccugcuggagaacgacaugaagcucaccgugguggucggggacguggcgggcauccuggggcagggcaagaagaugauccggccccagcccauggaguacaaguacagcuggaaguccuggggcaaggccaagaucaucggggccgacgcccagaacacgaccuucaucaucgacggccccaacaccccggagugccccgacgaccagcgcgcguggaacaucugggagguggaggacuacggguucggcaucuucaccacgaacaucuggcugaagcuccgggacagcuacacccaggucugcgaccaccgccugauguccgccgccaucaaggacagcaaggccgugcacgccgacaugggcuacuggaucgaguccgagaagaacgagaccuggaagcuggcgcgggccagcuucaucgaggugaagaccugcaucuggcccaagucccacacgcucuggagcaacgggguccuggaguccgagaugaucauccccaagaucuacggcgggccgaucagccagcacaacuaccgccccggcuacuucacccagaccgccgggcccuggcaccugggcaagcucgagcuggacuucgaccugugcgagggcaccacggugguggucgacgagcacugcgggaaccggggcccgucccuccgcaccaccaccgugacggggaagaucauccacgaguggugcugccggagcugcacccugccgccccugcgcuuccggggcgaggacgggugcugguacggcauggagauccgccccgugaaggagaaggaggagaaccucgucaaguccauggugagcgccggcagcggggagguggacuccuucagccugggccugcucugcaucuccaucaugaucgaggaggucaugcggagccgcuggucccggaagaugcugaugaccgggacccuggccguguucuuccuccugaucaugggccagcugacguggaacgaccucauccgccugugcaucauggugggggcgaacgccagcgaccgcaugggcaugggcaccaccuaccuggcccucauggccaccuucaagaugcggccgauguucgccgucgggcugcuguuccgccggcucacgucccgcgaggugcugcugcucaccaucgggcugagccugguggcguccgucgagcuccccaacagccuggaggagcugggggacggccucgccaugggcaucaugauccugaagcugcucaccgacuuccagucccaccagcugugggccacccugcucagccugacguucaucaagaccaccuucucccugcacuacgccuggaagaccauggcgauggugcucagcaucgucucccuguucccccugugccucagcacgaccucccagaagaccaccuggcugcccgugcugcucgggagccugggcugcaagccgcugacgauguuccucaucgccgagaacaagaucugggggcggaaguccuggccccugaacgagggcaucauggccguggggaucgucagcauccugcucagcucccugcugaagaacgacgugccccucgccggcccccugaucgccggcgggaugcugaucgcgugcuacgugaucagcggcuccagcgccgaccucucccuggagaaggccgccgaggucagcugggaggaggaggccgagcacuccggggcgagccacaacauccugguggaggugcaggacgacggcaccaugaagaucaaggacgaggagcgcgacgacacccucaccauccugcugaaggccacccuccuggccgucuccgggguguacccgcugagcauccccgccacccucuucgugugguacuucuggcagaagaagaagcagcgguccggcguccugugggacacccccagcccgcccgagguggagcgcgccgugcuggacgacggcaucuaccggaucaugcagcgcgggcugcucggccggucccaggucggggugggcguguuccaggagaacgucuuccacaccauguggcacgugacccgcggggcggugcugauguaccagggcaagcggcuggagcccagcugggccuccgucaagaaggaccucaucagcuacggcgggggcuggcgccugcggggguccuggaacacgggcgaggagguccaggugaucgccgucgagcccgggaagaaccccaagaacgugcagaccgcccccggcaccuucaagacccccgagggcgaggugggggccaucgcgcuggacuucaagcccggcacgagcgggucccccaucgucaaccgcgagggcaagaucgugggccucuacgggaacggcguggucaccaccagcgggaccuacgugagcgccaucgcccaggccaaggcgucccaggagggcccgcugcccgagaucgaggacgagguguuccggaagcgcaaccugacgaucauggaccuccaccccgggagcggcaagacccggcgcuaccugccggccaucguccgggaggccaucaagcgcaagcugcgcacccucauccuggcccccacccgggugguggccuccgagauggcggaggcccugaagggcaugcccauccgcuaccagacgaccgccgucaagagcgagcacaccgggaaggagaucguggaccucaugugccacgccaccuucacgaugcggcugcugucccccgugcgcgucccgaacuacaacaugaucaucauggacgaggcccacuucaccgaccccagcuccaucgcggcccggggcuacaucagcacccgcguggggaugggcgaggccgccgccaucuucaugaccgcgacgccgcccggguccguggaggccuucccgcagagcaacgccgucauccaggacgaggagcgggacauccccgagcgcuccuggaacagcggcuacgaguggaucaccgacuuccccggcaagaccgugugguucgugcccuccaucaagagcgggaacgacaucgccaacugccuccggaagaacggcaagcgcgucauccagcugucccggaagaccuucgacacggaguaccagaagaccaagaacaacgacugggacuacguggugaccaccgacaucagcgagaugggggcgaacuuccgcgccgaccgggucaucgacccgcgccggugccugaagcccgugauccucaaggacggccccgagcgcgugauccuggccgggcccaugccggucacgguggccuccgccgcgcagcggcgcggccggaucggccgcaaccacaacaaggagggggaccaguacaucuacaugggccagccccugaacaacgacgaggaccacgcccacuggaccgaggccaagaugcuccuggacaacaucaacacccccgaggggaucauccccgcccuguucgagccggagcgcgagaaguccgccgcggucgacggcgaguaccggcuccgcggggaggcccggaagaccuucguggagcugaugcgccggggcgaccugcccguguggcucuccuacaaggucgccagcgagggcuuccaguacagcgaccgccgguggugcuucgacggggagcgcaacaaccaggugcuggaggagaacauggacguggagaucuggacgaaggagggcgagcggaagaagcugcgcccccgguggcucgacgcccgcaccuacuccgacccccuggcccugcgggaguucaaggaguucgcggccgggcgccggagcgucuccggcgaccucauccuggagaucggcaagcugccgcagcaccucacccagcgcgcccagaacgcccuggacaaccuggugaugcuccacaacagcgagcagggcgggcgggcguaccgccacgccauggaggagcugcccgacaccaucgagacgcugaugcuccuggcccugaucgccgugcucaccgggggcgucacccuguucuuccuguccgggcggggccucggcaagaccagcaucgggcugcugugcgugauggccuccagcgugcuccuguggauggcguccgucgagccccacuggaucgccgccagcaucauccuggaguucuuccucauggugcugcugauccccgagccggaccgccagcggacgccccaggacaaccagcucgccuacguggucaucggccugcuguucaugauccucacgguggccgcgaacgagauggggcugcuggagaccaccaagaaggaccucggcaucgggcacguggccgucgagaaccaccaccacgccgccaugcuggacguggaccugcaccccgccuccgcguggacccucuacgccguggccacgaccaucaucaccccgaugaugcgccacaccaucgagaacacgaccgccaacaucagccugaccgccaucgcgaaccaggccgccauccugaugggccucgacaagggcuggcccaucuccaagauggacaucggggucccccugcuggcccucggcugcuacagccaggugaacccccugacccugacggcggccgugcucaugcuggucgcccacuacgccaucaucgggccgggccugcaggccaaggcgacccgcgaggcccagaagcggaccgccgccgggaucaugaagaaccccaccguggacggcaucguggccaucgaccucgaccccgucguguacgacgcgaaguucgagaagcagcugggccagaucaugcugcucauccugugcacgucccagauccugcucaugcgcaccaccugggcccugugcgagagcaucacccuggccacggggccccucaccacccugugggagggcuccccggggaaguucuggaacaccacgaucgccgugagcauggccaacaucuuccggggcuccuaccuggcgggcgccgggcucgccuucagccugaugaagucccugggcgggggccgccgggggaccggcgcccagggcgagacccucggggagaaguggaagcgccagcugaaccagcuguccaagagcgaguucaacaccuacaagcgguccggcaucauggaggucgaccgcagcgaggcgaaggaggggcucaagcggggcgagacgaccaagcacgccgugucccgcgggaccgccaagcugcggugguucguggagcgcaaccuggucaagcccgagggcaaggugaucgaccugggcugcgggcggggcggguggagcuacuacugcgccggccucaagaaggugaccgaggucaagggguacacgaagggcggccccgggcacgaggagcccaucccgauggccaccuacggcuggaaccuggugaagcugcacuccgggaaggacguguucuucaucccgcccgagaagugcgacacccuccugugcgacaucggcgagagcucccccaacccgaccaucgaggaggggcgcacgcugcggguccucaagaugguggagcccuggcugcgcggcaaccaguucugcaucaagauccugaaccccuacaugcccagcguggucgagacccucgagcagaugcagcggaagcacggcgggaugcuggugcgcaacccgcugucccggaacagcacccacgagauguacuggguguccugcggcaccgggaacaucgucagcgcggugaacaugaccucccgcaugcuccugaaccgcuucacgauggcccaccggaagcccaccuacgagcgcgacguggaccugggcaccggcacccggcacgucgccguggagcccgagguggccaaccucgacaucaucgggcagcgcaucgagaacaucaagcacgagcacaagagcacguggcacuacgacgaggacaaccccuacaagaccugggccuaccacggcuccuacgaggucaagccgagcggguccgcgagcagcauggugaacggcgucgugaagcugcugaccaagcccugggacgugauccccauggucacccagaucgccaugacggacaccacccccuucgggcagcagcggguguucaaggagaagguggacacccgcacgccgaaggccaagcggggcaccgcccagaucauggaggucaccgcccgcuggcucuggggcuuccugucccggaacaagaagccccgcaucugcacccgggaggaguucacgcgcaaggugcggagcaacgcggccaucggggccguguucgucgacgagaaccaguggaacuccgccaaggaggcgguggaggacgagcgcuucugggaccuggugcaccgggagcgcgagcuccacaagcagggcaagugcgcgaccugcgucuacaacaugauggggaagcgggagaagaagcugggcgaguucgggaaggccaagggcagccgcgccaucugguacauguggcugggcgcccgguuccucgaguucgaggcgcugggguucaugaacgaggaccacugguucucccgcgagaacagccuguccggcguggagggggagggccuccacaagcugggguacauccugcgggacaucagcaagauccccggcggcaacauguacgccgacgacaccgccgggugggacacccgcaucacggaggacgaccuccagaacgaggccaagaucaccgacaucauggagccggagcacgcccugcuggcgaaggccaucuucaagcucaccuaccagaacaaggugguccgcgugcagcggcccgccaagaacggcaccgugauggacgucaucucccgccgggaccagcgcgggagcggccaggugggcacguacgggcugaacaccuucaccaacauggaggcccagcugauccggcagauggaguccgagggcaucuucagccccuccgagcucgagacccccaaccuggccgagcgcgcgcuggacuggcucgggaaguacggcguggagcggcugaagcgcauggccaucagcggggacgacugcgucgugaagccgaucgacgaccgguucgccacggcccugaccgcccucaacgacaugggcaaggugcgcaaggacaucccccagugggagcccuccaagggcuggaacgacuggcagcagguccccuucugcagccaccacuuccaccagcugaucaugaaggacgggcgggagaucguggugccgugccgcaaccaggacgagcuggucggccgggcgcgcgugucccagggggccggcuggagccuccgggagaccgccugccugggcaagagcuacgcccagauguggcagcugauguacuuccaccgccgggaccuccgccuggcggccaacgccaucugcuccgccgugcccgucgacugggugcccaccagccggacgaccugguccauccacgcccaccaccaguggaugaccaccgaggacaugcugagcguguggaaccgcgucuggaucgaggagaaccccuggauggaggacaagacgcacaucuccagcugggaggacgugccguaccucggcaagcgcgaggaccaguggugcggcucccugaucgggcugaccgcgcgggccaccugggccaccaacauccagguggccaucaaccagguccgccggcucaucggcaacgagaacuaccuggacuacaugaccagcaugaagcgcuucaagaacgaguccgaccccgagggggcccugugguga

SEQ ID NO: 8468 - RNA, 9879 nt, Artificial Sequence
  derived and/or modified CDS sequence (opt1) from DENV-1__FJ898372__SS-prME
agcgugaccaugcugcucaugcugaugcccaccgcccuggccuuccaccucaccacccggggcggggagccccacaugaucgugagcaagcaggagcggggcaagagccugcuguucaagaccagcgcgggggugaacaugugcacccucaucgccauggaccugggcgagcugugcgaggacacgaugaccuacaagugcccccggaucaccgaggccgagcccgacgacguggacugcuggugcaacgccaccgacacgugggugaccuacgggaccugcagccagaccggcgagcaccggcgggacaagcgguccguggcccucgcgccccacgugggccuggggcuggagacgcgcaccgagaccuggaugagcuccgagggcgccuggaagcagauccagcgggucgagaccugggcccuccgccaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggcccgggacaagcccacccuggacaucgagcuccugaagacggaggucaccaaccccgcggugcugcgcaagcucugcaucgaggccaagaucuccaacaccaccacggacagccggugcccgacccagggcgaggccacccugguggaggagcaggacgccaacuucgucugccgccggaccuucguggaccgcggcugggggaacggcugcgggcuguucggcaaggggucccucaucacgugcgccaaguucaagugcgugaccaagcuggagggcaagaucguccaguacgagaaccugaaguacagcgugaucgugaccguccacaccggcgaccagcaccagguggggaacgaguccacggagcacggcaccaccgcgaccaucacgccccaggcccccacgaccgagauccagcucaccgacuacggggcccugacccuggacugcagcccccggacgggccucgacuucaacgagaugguccugcugaccaugaaggagaaguccuggcucgugcacaagcagugguuccuggaccugccccuccccuggaccagcggggccagcaccucccaggagacguggaaccgccaggaccugcuggugaccuucaagaccgcccacgcgaagaagcaggaggucguggugcucggcagccaggagggcgccaugcacaccgcccugacgggggccaccgagauccagaccuccggcaccacgaccaucuucgccgggcaccugaagugccggcucaagauggacaagcugacccugaagggcaugagcuacgucaugugcaccggguccuucaagcucgagaaggagguggcggagacgcagcacggcaccgugcugguccagaucaaguacgagggcaccgacgcccccugcaagauccccuucagcacccaggacgagaagggggugacgcagaacggccgccugaucaccgccaacccgaucgugaccgacaaggagaagcccgucaacaucgaggccgagccgcccuucggggaguccuacaucgugaucggcgcgggcgagaaggcccugaagcucagcugguucaagaagggguccagcaucggcaagauguucgaggccaccgcccgcggggcccgccgcauggcgauccugggcgacacggccugggacuucggguccaucggcggcguguucaccagcgucgggaagcuggugcaccagaucuucggcaccgccuacgggguccucuucuccggcgucagcuggaccaugaagaucgggaucggcgugcugcugacguggcucggccugaacucccggagcaccucccugagcaugaccugcaucgccguggggcucgucacccuguaccugggcgugauggugcaggccgacuccgggugcgucaucaacuggaagggccgcgagcucaagugcgggagcggcaucuucgugacgaacgaggugcacaccuggaccgagcaguacaaguuccaggcggacagcccgaagcggcuguccgccgccaucggcaaggccugggaggagggggucugcggcauccgcagcgccacccggcuggagaacaucauguggaagcagaucuccaacgagcucaaccacauccugcuggagaacgacaugaagcucaccgugguggucggggacguggcgggcauccuggggcagggcaagaagaugauccgcccccagcccauggaguacaaguacagcuggaaguccuggggcaaggccaagaucaucggggccgacgcccagaacacgaccuucaucaucgacggccccaacaccccggagugccccgacgaccagcgggcguggaacaucugggagguggaggacuacggguucggcaucuucaccacgaacaucuggcugaagcuccgcgacagcuacacccaggucugcgaccaccggcugauguccgccgccaucaaggacagcaaggccgugcacgccgacaugggcuacuggaucgaguccgagaagaacgagaccuggaagcuggcgcgcgccagcuucaucgaggugaagaccugcaucuggcccaagucccacacgcucuggagcaacgggguccuggaguccgagaugaucauccccaagaucuacggcgggccgaucagccagcacaacuaccggcccggcuacuucacccagaccgccgggcccuggcaccugggcaagcucgagcuggacuucgaccugugcgagggcaccacggugguggucgacgagcacugcgggaaccgcggcccgucccuccggaccaccaccgugacggggaagaucauccacgaguggugcugccgcagcugcacccugccgccccugcgguuccgcggcgaggacgggugcugguacggcauggagauccggcccgugaaggagaaggaggagaaccucgucaaguccauggugagcgccggcagcggggagguggacuccuucagccugggccugcucugcaucuccaucaugaucgaggaggucaugcgcagccgguggucccgcaagaugcugaugaccgggacccuggccguguucuuccuccugaucaugggccagcugacguggaacgaccucauccgccugugcaucauggugggggcgaacgccagcgaccggaugggcaugggcaccaccuaccuggcccucauggccaccuucaagaugcgcccgauguucgccgucgggcugcuguuccggcgccucacgucccgggaggugcugcugcucaccaucggccugagccugguggcguccgucgagcuccccaacagccuggaggagcugggggacggccucgccaugggcaucaugauccugaagcugcucaccgacuuccagucccaccagcugugggccacccugcucagccugacguucaucaagaccaccuucucccugcacuacgccuggaagaccauggcgauggugcucagcaucgucucccuguucccccugugccucagcacgaccucccagaagaccaccuggcugcccgugcugcucgggagccugggcugcaagccgcugacgauguuccucaucgccgagaacaagaucugggggcgcaaguccuggccccugaacgagggcaucauggccguggggaucgucagcauccugcucagcucccugcugaagaacgacgugccccucgccggcccccugaucgccggcgggaugcugaucgcgugcuacgugaucagcggcuccagcgccgaccucucccuggagaaggccgccgaggucagcugggaggaggaggccgagcacuccggggcgagccacaacauccugguggaggugcaggacgacggcaccaugaagaucaaggacgaggagcgggacgacacccucaccauccugcugaaggccacccuccuggccgucuccgggguguacccgcugagcauccccgccacccucuucgugugguacuucuggcagaagaagaagcagcgcuccggcguccugugggacacccccagcccgcccgagguggagcgggccgugcuggacgacggcaucuaccgcaucaugcagcgggggcugcucggccgcucccaggucggggugggcguguuccaggagaacgucuuccacaccauguggcacgugacccgcggggccgugcugauguaccagggcaagcgccuggagcccagcugggccuccgucaagaaggaccucaucagcuacggcgggggcuggcggcugcgcggguccuggaacacgggcgaggagguccaggugaucgccgucgagcccgggaagaaccccaagaacgugcagaccgcccccggcaccuucaagacccccgagggcgaggugggggccaucgcgcuggacuucaagcccggcacgagcgggucccccaucgucaaccgggagggcaagaucgugggccucuacgggaacggcguggucaccaccagcgggaccuacgugagcgccaucgcccaggccaaggcgucccaggagggcccgcugcccgagaucgaggacgagguguuccgcaagcggaaccugacgaucauggaccuccaccccgggagcggcaagacccgccgguaccugccggccaucguccgcgaggccaucaagcgcaagcugcggacccucauccuggcccccacccgcgugguggccuccgagauggcggaggcccugaagggcaugcccauccgguaccagacgaccgccgucaagagcgagcacaccgggaaggagaucguggaccucaugugccacgccaccuucacgaugcgccugcugucccccgugcgggucccgaacuacaacaugaucaucauggacgaggcccacuucaccgaccccagcuccaucgcggcccgcggcuacaucagcacccggguggggaugggcgaggccgccgccaucuucaugaccgcgacgccgcccggguccguggaggccuucccgcagagcaacgccgucauccaggacgaggagcgcgacauccccgagcgguccuggaacagcggcuacgaguggaucaccgacuuccccggcaagaccgugugguucgugcccuccaucaagagcgggaacgacaucgccaacugccuccgcaagaacggcaagcgggucauccagcugucccgcaagaccuucgacacggaguaccagaagaccaagaacaacgacugggacuacguggugaccaccgacaucagcgagaugggggcgaacuuccgggccgaccgcgucaucgacccgcggcgcugccugaagcccgugauccucaaggacggccccgagcgggugauccuggccgggcccaugccggucacgguggccuccgccgcgcagcgccggggccgcaucggccgcaaccacaacaaggagggggaccaguacaucuacaugggccagccccugaacaacgacgaggaccacgcccacuggaccgaggccaagaugcuccuggacaacaucaacacccccgaggggaucauccccgcccuguucgagccggagcgggagaaguccgccgcggucgacggcgaguaccgccuccgcggggaggcccgcaagaccuucguggagcugaugcggcgcggcgaccugcccguguggcucuccuacaaggucgccagcgagggcuuccaguacagcgaccggcgcuggugcuucgacggggagcggaacaaccaggugcuggaggagaacauggacguggagaucuggacgaaggagggcgagcgcaagaagcugcggccccgcuggcucgacgcccggaccuacuccgacccccuggcccugcgcgaguucaaggaguucgcggccgggcggcgcagcgucuccggcgaccucauccuggagaucggcaagcugccgcagcaccucacccagcgggcccagaacgcccuggacaaccuggugaugcuccacaacagcgagcagggcgggcgcgcguaccggcacgccauggaggagcugcccgacaccaucgagacgcugaugcuccuggcccugaucgccgugcucaccgggggcgucacccuguucuuccuguccgggcgcggccucggcaagaccagcaucgggcugcugugcgugauggccuccagcgugcuccuguggauggcguccgucgagccccacuggaucgccgccagcaucauccuggaguucuuccucauggugcugcugauccccgagccggaccggcagcgcacgccccaggacaaccagcucgccuacguggucaucggccugcuguucaugauccucacgguggccgcgaacgagauggggcugcuggagaccaccaagaaggaccucggcaucgggcacguggccgucgagaaccaccaccacgccgccaugcuggacguggaccugcaccccgccuccgcguggacccucuacgccguggccacgaccaucaucaccccgaugaugcgccacaccaucgagaacacgaccgccaacaucagccugaccgccaucgcgaaccaggccgccauccugaugggccucgacaagggcuggcccaucuccaagauggacaucggggucccccugcuggcccucggcugcuacagccaggugaacccccugacccugacggcggccgugcucaugcuggucgcccacuacgccaucaucgggccgggccugcaggccaaggcgacccgggaggcccagaagcgcaccgccgccgggaucaugaagaaccccaccguggacggcaucguggccaucgaccucgaccccgucguguacgacgcgaaguucgagaagcagcugggccagaucaugcugcucauccugugcacgucccagauccugcucaugcggaccaccugggcccugugcgagagcaucacccuggccacggggccccucaccacccugugggagggcuccccggggaaguucuggaacaccacgaucgccgugagcauggccaacaucuuccgcggcuccuaccuggcgggcgccgggcucgccuucagccugaugaagucccugggcgggggccggcgcgggaccggcgcccagggcgagacccucggggagaaguggaagcggcagcugaaccagcuguccaagagcgaguucaacaccuacaagcgcuccggcaucauggaggucgaccggagcgaggcgaaggaggggcucaagcgcggcgagacgaccaagcacgccgugucccgggggaccgccaagcugcgcugguucguggagcggaaccuggucaagcccgagggcaaggugaucgaccugggcugcgggcgcggcggguggagcuacuacugcgccggccucaagaaggugaccgaggucaagggguacacgaagggcggccccgggcacgaggagcccaucccgauggccaccuacggcuggaaccuggugaagcugcacuccgggaaggacguguucuucaucccgcccgagaagugcgacacccuccugugcgacaucggcgagagcucccccaacccgaccaucgaggaggggcggacgcugcgcguccucaagaugguggagcccuggcugcggggcaaccaguucugcaucaagauccugaaccccuacaugcccagcguggucgagacccucgagcagaugcagcgcaagcacggcgggaugcuggugcggaacccgcugucccgcaacagcacccacgagauguacuggguguccugcggcaccgggaacaucgucagcgcggugaacaugaccucccgcaugcuccugaaccgguucacgauggcccaccgcaagcccaccuacgagcgggacguggaccugggcaccggcacccgccacgucgccguggagcccgagguggccaaccucgacaucaucgggcagcggaucgagaacaucaagcacgagcacaagagcacguggcacuacgacgaggacaaccccuacaagaccugggccuaccacggcuccuacgaggucaagccgagcggguccgcgagcagcauggugaacggcgucgugaagcugcugaccaagcccugggacgugauccccauggucacccagaucgccaugacggacaccacccccuucgggcagcagcgcguguucaaggagaagguggacacccggacgccgaaggccaagcgcggcaccgcccagaucauggaggucaccgcccgguggcucuggggcuuccugucccgcaacaagaagccccggaucugcacccgcgaggaguucacgcggaaggugcgcagcaacgcggccaucggggccguguucgucgacgagaaccaguggaacuccgccaaggaggcgguggaggacgagcgguucugggaccuggugcaccgcgagcgggagcuccacaagcagggcaagugcgcgaccugcgucuacaacaugauggggaagcgcgagaagaagcugggcgaguucgggaaggccaagggcagccgggccaucugguacauguggcugggcgcccgcuuccucgaguucgaggcgcugggguucaugaacgaggaccacugguucucccgggagaacagccuguccggcguggagggggagggccuccacaagcugggguacauccugcgcgacaucagcaagauccccggcggcaacauguacgccgacgacaccgccgggugggacacccgcaucacggaggacgaccuccagaacgaggccaagaucaccgacaucauggagccggagcacgcccugcuggcgaaggccaucuucaagcucaccuaccagaacaaggugguccgggugcagcgccccgccaagaacggcaccgugauggacgucaucucccggcgcgaccagcgggggagcggccaggugggcacguacgggcugaacaccuucaccaacauggaggcccagcugauccgccagauggaguccgagggcaucuucagccccuccgagcucgagacccccaaccuggccgagcgggcgcuggacuggcucgagaaguacgggguggagcgccugaagcggauggccaucagcggcgacgacugcgucgugaagccgaucgacgaccgcuucgccacggcccugaccgcccucaacgacauggggaaggugcggaaggacaucccccagugggagcccuccaagggcuggaacgacuggcagcagguccccuucugcagccaccacuuccaccagcugaucaugaaggacggccgcgagaucguggugccgugccggaaccaggacgagcuggucgggcgcgcgcgggugucccagggcgccggguggagccuccgcgagaccgccugccugggcaagagcuacgcccagauguggcagcugauguacuuccaccggcgcgaccuccggcuggcggccaacgccaucugcuccgccgugcccgucgacugggugcccaccagccgcacgaccugguccauccacgcccaccaccaguggaugaccaccgaggacaugcugagcguguggaaccgcgucuggaucgaggagaaccccuggauggaggacaagacgcacaucuccagcugggaggacgugccguaccucgggaagcgggaggaccaguggugcggcucccugaucggccugaccgcgcgcgccaccugggccaccaacauccagguggccaucaaccagguccggcgccucaucgggaacgagaacuaccuggacuacaugaccagcaugaagcgguucaagaacgaguccgaccccgagggcgcccugugguga

SEQ ID NO: 8469 - RNA, 9879 nt, Artificial Sequence
  derived and/or modified CDS sequence (opt1) from DENV-1__FJ898373__SS-prME
agcgugaccaugcugcucaugcugaugcccaccgcccuggccuuccaccucaccacccggggcggggagccccacaugaucgucuccaagcaggagcggggcaagagccugcuguucaagaccuccgccggggugaacaugugcacccucaucgccauggaccugggcgagcugugcgaggacaccaugaccuacaagugcccccggaucaccgagguggagcccgacgacgucgacugcuggugcaacaccacggacaccugggugaccuacgggaccugcagccagacgggcgagcaccggcgcgacaagcgguccguggcccucgcgccccacgucggccuggggcuggagacccgggccgagaccuggaugagcuccgagggcgcguggaagcagauccagaagguggagaccugggcccuccggcaccccggguucacggugaucgcccuguuccuggcccacgcgaucggcaccagcaucacccagaaggggaucaucuucauccuccugaugcuggucacccccuccauggccaugcgcugcgugggcaucggcagccgggacuucguggaggggcucuccggcgccacgugggucgacguggugcuggagcacgggagcugcgucaccaccauggccaaggacaagcccacccuggacaucgagcuccugaagacggaggugaccaaccccgccgugcugcgcaagcucugcaucgaggcgaagaucuccaacaccaccacggacagccggugcccgacccagggcgaggccacccuggucgaggagcaggacgccaacuucgugugccgccggaccuucguggaccgcggcugggggaacggcugcgggcuguucggcaaggggucccucaucacgugcgccaaguucaagugcgucaccaagcuggagggcaagaucgugcaguacgagaaccugaaguacagcgugaucgucaccgugcacaccggcgaccagcaccaggucgggaacgaguccacggagcacggcaccaucgccaccaucacgccccaggcgcccaccagcgagauccagcucacggacuacggggcccugacccuggacugcagcccccggaccggccucgacuucaacgagauggugcugcugaccaugaaggagaaguccuggcucgugcacaagcagugguuccuggaccugccccuccccuggacgagcggggccuccaccagccaggagaccuggaaccgccaggaccugcuggucaccuucaagacggcccacgccaagaagcaggagguggugguccucggcucccaggagggcgcgaugcacaccgcccugaccggggccaccgagauccagacgaccggcaccaccacgaucuucgccgggcaccugaagugccggcucaagauggacaagcugacccugaagggcaugagcuacgugaugugcaccggguccuucaagcucgagaaggagguggccgagacccagcacggcacgguccuggugcagaucaaguacgagggcaccgacgcgcccugcaagauccccuucagcacccaggacgagaagggggugacccagaacggccgccugaucacggccaacccgaucgucaccgacaaggagaagcccgugaacaucgaggccgagccgcccuucggggaguccuacaucgugaucggcgccggcgagaaggcgcugaagcucagcugguucaagaagggguccagcaucggcaagauguucgaggccaccgcccgcggggcccgccggauggccauccugggcgacaccgcgugggacuucggguccaucggcggcgucuucacgagcguggggaagcuggugcaccagaucuucggcaccgccuacgggguccucuucuccggcgugagcuggaccaugaagaucgggaucggcgugcugcugaccuggcucggccugaacucccgcagcacgucccugagcaugaccugcaucgccgucgggcucaucacccuguaccugggcgugauggugcaggccgacuccgggugcgucaucaacuggaagggccgcgagcucaagugcgggagcggcaucuucgugaccaacgaggugcacacguggaccgagcaguacaaguuccaggccgacagcccgaagcggcuguccgcggccgucggcaaggccugggaggagggggugugcggcauccgcagcgccacccggcuggagaacaucauguggcgccagaucuccaacgagcucaaccacauccugcuggagaacgacaugaaguucaccguggucgugggggacguggucggcauccucgcccaggggaagaagauggugcggccccagcccauggagcacaaguacagcuggaaguccuggggcaaggcgaagaucaucggcgccgacgugcagaacaccacguucaucaucgacgggcccaacaccccggagugccccgacgaccagcgcgccuggaacaucugggaggucgaggacuacggcuucgggaucuucaccaccaacaucuggcugaagcugcgggacagcuacacccaggugugcgaccaccgccucauguccgccgcgaucaaggacagcaaggccgugcacgccgacaugggcuacuggaucgaguccgagaagaacgagaccuggaagcuggcccgggccagcuucaucgaggucaagaccugcaucuggcccaagucccacacccuguggagcaacggcgugcucgaguccgagaugaucauccccaagaucuacgggggcccgaucagccagcacaacuaccgccccggguacuucacgcagaccgcgggccccuggcaccuggggaagcuggagcucgacuucgaccugugcgagggcaccaccguggucguggacgagcacugcggcaaccgggggccgucccugcgcacgaccaccgugaccggcaagaucauccacgaguggugcugccggagcugcacgcugccgccccuccgcuucaagggggaggacggcugcugguacgggauggagauccggcccgucaaggagaaggaggagaaccuggugaaguccauggugagcgccggcagcggcgaggucgacuccuucagccucgggcugcugugcaucuccaucaugaucgaggaggugaugcgcagccgguggucccgcaagaugcucaugaccggcacccuggccguguucuuccugcucaucauggggcagcugaccuggaacgaccugauccggagcugcaucauggucggcgccaacgccuccgaccgcauggggaugggcacgaccuaccucgcgcugauggccaccuucaagaugcgcccgauguucgccgugggccugcuguuccggcgccugaccagccgggagguccugcuccugacgaucgggcugucccucguggccagcguggagcugcccaacucccuggaggagcucggcgacgggcuggccaugggcaucaugauccugaagcuccugaccgacuuccagagcuaccagcugugggcgacccuccugucccugaccuucaucaagacgaccuucagccuccacuacgccuggaagaccauggccaugguccuguccaucgugagccugcucccccugugccuguccaccacgagccagaagaccaccuggcuccccgugcugcugggcucccucgggugcaagccgcugaccauguuccugaucgccgagaacaagaucuggggccgcaagagcuggccccucaacgaggggaucauggcggucggcaucgugagcauccugcuguccagccuccugaagaacgacgugccccuggccgggccccucaucgccggcggcaugcugaucgccugcuacgucaucuccgggagcuccgccgaccugagccucgagaaggcggccgagguguccugggaggaggaggccgagcacagcggcgccucccacaacauccugguggagguccaggacgacgggacgaugaagaucaaggacgaggagcgggacgacacccugaccauccuccugaaggccacccugcucgcggugagcggcguguacccgcuguccauccccgccacccuguucgucugguacuucuggcagaagaagaagcagcgcagcggggugcucugggacacgcccagcccgcccgagguggagcgggccguccuggacgacggcaucuaccgcaucaugcagcggggccugcuggggcgcagccaggugggcgugggggucuuccaggagaacguguuccacaccauguggcacgugacccggggcgccguccucauguaccaggggaagcgccuggagcccuccugggccagcgugaagaaggaccugaucuccuacggcggcggguggcggcuccagggcagcuggaacaccggggaggaggugcaggucaucgcgguggagcccggcaagaaccccaagaacgugcagacggcccccgggaccuucaagacccccgagggcgaggucggcgccaucgcccuggacuucaagcccgggaccuccggcagccccaucgugaaccgcgaggggaagaucgugggccuguacggcaacggggucgugacgaccagcggcaccuacguguccgccaucgcgcaggccaaggccagccaggaggggccgcuccccgagaucgaggacgaggucuuccggaagcgcaaccugaccaucauggaccugcaccccggcuccgggaagacgcggcgcuaccucccggccaucgugcgggaggcgaucaagcgcaagcugcggacccugauccucgcccccacccgcguggucgccagcgagauggccgaggcccugaagggcaugcccauccgcuaccagaccacggcggugaaguccgagcacaccggccgggagaucguggaccugaugugccacgccaccuucaccaugcgccuccugagccccguccgggugccgaacuacaacaugaucaucauggacgaggcccacuucacggaccccuccagcaucgccgcccgcggguacaucuccacccgggugggcaugggggaggcggccgccaucuucaugaccgccacgccgcccggcagcgucgaggccuucccgcaguccaacgcggugauccaggacgaggagcgcgacauccccgagcggagcuggaacuccggguacgaguggaucacggacuuccccggcaagaccgugugguucguccccagcaucaaguccggcaacgacaucgccaacugccugcgcaagaacgggaagcgggugauccagcucagccgcaagaccuucgacaccgaguaccagaagacgaagaacaacgacugggacuacguggucaccaccgacaucuccgagaugggcgccaacuuccgggccgaccgcgugaucgacccgcggcgcugccugaagcccgucauccugaaggacgggcccgagcgggugauccucgcgggccccaugccggugaccgucgccagcgccgcccagcgccgggggcgcaucggccggaaccacaacaaggagggcgaccaguacaucuacauggggcagccccugaacaacgacgaggaccacgcccacuggacggaggcgaagaugcugcucgacaacaucaacacccccgagggcaucauccccgcccuguucgagccggagcgcgagaaguccgccgccaucgacggggaguaccgccugcggggcgaggcccgcaagaccuucguggagcucaugcggcgcggggaccugcccguguggcugagcuacaaggucgcgagcgagggcuuccaguacuccgaccggcgcuggugcuucgacggcgagcggaacaaccaggugcucgaggagaacauggacguggagaucuggaccaaggagggggagcgcaagaagcugcggccccgcuggcuggacgcccggacguacagcgacccccucgcccugcgcgaguucaaggaguucgccgccggccggcgcuccgucagcggggaccugauccucgagaucggcaagcugccgcagcaccugacccagcgggcgcagaacgcccucgacaaccuggugaugcugcacaacuccgagcagggcgggcgcgccuaccggcacgccauggaggagcuccccgacaccaucgagacccugaugcugcucgcgcugaucgccgugcugacgggcggggucacccucuucuuccugagcggccgcgggcugggcaagaccuccaucggccuccugugcgugauggccagcuccgcccugcucuggauggccagcguggagccccacuggaucgcggccuccaucauccuggaguucuuccugaugguccuccugauccccgagccggaccggcagcgcacgccccaggacaaccagcuggccuacguggugaucgggcuccuguucaugauccugaccgucgccgccaacgagaugggccuccuggagacgaccaagaaggaccuggggaucggccacguggcgguggagaaccaccaccacgccaccaugcucgacgucgaccugcaccccgccagcgccuggacccuguacgccguggcgacgaccaucaucaccccgaugaugcggcacaccaucgagaacacgaccgccaacaucucccucaccgccaucgccaaccaggccgcgauccugauggggcuggacaagggcuggcccaucagcaagauggacaucggcgugccccuccuggcccuggggugcuacucccaggucaacccccucacccugacggccgccgugcugaugcucguggcgcacuacgccaucaucggcccggggcugcaggccaaggccacccgcgaggcccagaagcgcaccgcggccggcaucaugaagaaccccaccgucgacgggaucguggccaucgaccuggaccccguggucuacgacgccaaguucgagaagcagcucggccagaucaugcugcugauccucugcacgagccagauccugcugaugcggaccaccugggcccucugcgaguccaucacccuggcgacgggcccccugaccacccucugggaggggagcccgggcaaguucuggaacaccacgaucgccguguccauggccaacaucuuccgcgggagcuaccuggccggcgccggccuggcguucagccucaugaagucccucgggggcgggcggcgcgggaccggggcccagggcgagacccugggcgagaaguggaagcggcagcucaaccagcugagcaaguccgaguucaacaccuacaagcgcagcgggaucauggagguggaccgguccgaggccaaggagggccugcgccgcggggagacgaccaagcacgccgucagccgcggcaccgcgaagcuccggugguucguggagcgcaaccuggugaagcccgaggggaaggucaucgaccugggcugcggccgcgggggcugguccuacuacugcgccgggcugaagaaggugaccgaggugaagggcuacacgaagggcggccccggccacgaggagcccaucccgauggccaccuacggguggaaccucgucaagcugcacagcggcaaggacguguucuucaucccgcccgagaagugcgacacccugcucugcgacaucggggaguccagccccaacccgaccaucgaggagggccgcacgcugcgggugcugaagauggucgagcccuggcuccgcgggaaccaguucugcaucaagauccugaaccccuacaugcccuccgugguggagacccuggagcacaugcagcggaagcacggcggcaugcucguccgcaacccgcugagccggaacuccacccacgagauguacugggugagcugcgggaccggcaacaucguguccgccgucaacaugaccagccgcaugcugcucaaccgcuucacgauggcccaccggaagcccaccuacgagcgcgacguggaccugggggcgggcacccggcacguggccgucgagcccgagguggccaaccuggacaucaucggccagcgcaucgagaacaucaagcacgagcacaaguccaccuggcacuacgacgaggacaaccccuacaagacgugggccuaccacgggagcuacgaggucaagccguccggcagcgccagcuccauggugaacgggguggucaagcuccugaccaagcccugggacgugauccccauggugacccagaucgcgaugaccgacacgacccccuucggccagcagcgggucuucaaggagaagguggacacccgcaccccgaaggccaagcgggggacggcccagaucauggaggugaccgcccgcuggcuguggggcuuccucagccggaacaagaagccccgcaucugcacccgggaggaguucacccgcaagguccgguccaacgccgcgaucggcgccguguucguggacgagaaccaguggaacagcgccaaggaggccgucgaggacgagcgcuucugggaccuggugcaccgggagcgcgagcugcacaagcaggggaagugcgcgacgugcguguacaacaugaugggcaagcgggagaagaagcucggggaguucggcaaggccaaggggucccgcgccaucugguacauguggcugggcgcccgguuccuggaguucgaggcccucggcuucaugaacgaggaccacugguucagccgcgagaacucccugagcggggucgagggcgaggggcugcacaagcucggcuacauccugcgggacaucuccaagauccccgggggcaacauguacgcggacgacaccgccggcugggacacccgcaucaccgaggacgaccugcagaacgaggccaagaucacggacaucauggagccggagcacgcccuccuggccaccagcaucuucaagcugaccuaccagaacaagguggugcgcguccagcggcccgcgaagaacgggaccgugauggacgugaucucccgccgggaccagcgcggcagcgggcaggucggcacguacggccucaacaccuucaccaacauggaggcccagcugauccggcagauggaguccgaggggaucuucagccccuccgagcuggagacccccaaccucgccgagcgcgugcuggacuggcuggagaaguacggcguggagcggcucaagcgcauggccaucagcggggacgacugcgucgugaagccgaucgacgaccgguucgccacggcgcugaccgcccugaacgacaugggcaaggugcgcaaggacaucccccagugggagcccuccaagggguggaacgacuggcagcagguccccuucugcagccaccacuuccaccagcucaucaugaaggacggccgggagaucguggugccgugccgcaaccaggacgagcuggucggccgggcccgcgugagccagggggccggcuggucccugcgggagaccgccugccucgggaaguccuacgcgcagauguggcagcugauguacuuccaccgccgggaccugcgccucgccgccaacgccaucugcuccgcggugcccgucgacugggugcccaccagccggacgaccugguccauccacgcccaccaccaguggaugaccaccgaggacaugcugagcguguggaaccgcgucuggaucgaggagaaccccuggauggaggacaagacgcacaucuccagcuggggcgacgugccguaccuggggaagcgcgaggaccaguggugcggcucccucaucggccugaccgcccgggccaccugggccaccaacauccagguggcgaucaaccagguccgccggcugaucgggaacgagaacuaccucgacuacaugaccagcaugaagcgcuucaagaacgaguccgaccccgagggcgcccugugguga

SEQ ID NO: 8470 - RNA, 9879 nt, Artificial Sequence
  derived and/or modified CDS sequence (opt1) from DENV-1__FJ898374__SS-prME
agcgugaccaugcugcucaugcugaugcccaccgcccuggccuuccaccucaccacccggggcggggagccccacaugaucgugaccaagcaggagcggggcaagagccugcuguucaagaccagcgcgggggugaacaugugcacccucaucgccauggaccugggggagcugugcgaggacaccaugaccuacaagugcccccggaucaccgaggccgagcccgacgacguggacugcuggugcaacgccaccgacaccugggugaccuacgggaccugcagccagaccggggagcaccggcgcgacaagcggagcguggcccucgcgccccacgugggccuggggcuggagacccgcaccgagaccuggauguccagcgagggcgccuggaagcagauccagcggguggagacgugggcccuccgccaccccggguucaccgugaucgcccuguuccuggcgcacgccaucggcaccuccaucacccagaaggggaucaucuucauccuccugaugcuggugacgcccagcauggccaugcggugcgucggcaucggcucccgcgacuucguggaggggcucagcggcgccaccuggguggacgucgugcuggagcacggguccugcgugaccaccauggccaaggacaagcccacgcuggacaucgagcuccugaagaccgaggucaccaaccccgcggugcugcggaagcucugcaucgaggccaagaucagcaacaccacgaccgacucccgcugccccacccagggcgaggccacccugauggaggagcaggacgccaacuucgugugccggcgcacguucgucgaccggggcugggggaacggcugcgggcuguucggcaaggggagccucaucacgugcgccaaguucaagugcgugaccaagcuggagggcaagaucgugcaguacgagaaccugaaguacuccgucaucgugaccgugcacacgggcgaccagcaccaggucgggaacgagagcaccgagcacggcaccaccgcgaccaucacgccccaggcccccaccuccgagauccagcucaccgacuacggggcccugacccuggacugcagcccccgcacgggccucgacuucaacgagauggugcugcugaccaugaaggagaaguccuggcucguccacaagcagugguuccuggaccugccgcuccccuggaccagcggggccagcaccucccaggagacguggaaccggcaggaccugcuggugaccuucaagaccgcccacgcgaagaagcaggagguggucgugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgugaugugcaccggguccuucaagcucgagaaggaggucgcggagacgcagcacggcaccgugcuggugcagaucaaguacgagggcaccgacgcccccugcaagauccccuucagcacccaggacgagaagggggucauccagaacggccggcugaucacggccaacccgaucgugaccgacaaggagaagcccgugaacaucgaggccgagccgcccuucggggaguccuacaucgucaucggcgugggcgagaaggcgcugaagcucagcugguucaagaagggguccagcaucggcaagauguucgaggccaccgcccgcggggcccggcgcauggccauccugggcgacaccgcgugggacuucggguccaucggcggcguguucacgagcgucgggaagcuggugcaccagaucuucggcaccgccuacgggguccuguucuccggcgucagcuggaccaugaagaucgggaucggcgugcugcugaccuggcucggccugaacucccgcagcacgucccugagcaugaccugcaucgccguggggcucgucacccuguaccugggcgugauggugcaggccgacuccgggugcgucaucaacuggaagggccgggagcucaagugcgggagcggcaucuucgugaccaacgaggugcacacguggaccgagcaguacaaguuccaggccgacagcccgaagcgccuguccgcggccaucggcaaggccugggaggagggggucugcggcauccggagcgugacccgccuggagaacaucauguggaagcagaucuccaacgagcucaaccacauccugcuggagaacgacaugaaguucaccguggucgugggggacguggucggcauccucgcccaggggaagaagaugauccggccccagcccauggagcacaaguacagcuggaaguccuggggcaaggccaagaucaucggcgcggacgugcagaacaccacguucaucaucgacgggcccaacaccccggagugccccgacgaccagcgcgccuggaacaucugggagguggaggacuacggcuucgggaucuucaccaccaacaucuggcugaagcugcgggacagcuacacgcaggccugcgaccaccgccucauguccgccgcgaucaaggacagcaaggccguccacgccgacaugggcuacuggaucgaguccgagaagaacgagaccuggaagcuggcccgggccagcuucaucgaggugaagaccugcaucuggcccaagucccacacccuguggagcaacggcgugcucgaguccgagauggucauccccaagaucuacgggggcccgaucagccagcacaacuaccgccccggguacuucacgcagaccgcgggccccuggcaccuggggaagcuggagcucgacuucgaccugugcgagggcaccaccgugguggucgacgagcacugcggcaaccgggggccgucccugcgcacgaccaccgugaccggcaagaucauccacgaguggugcugccggagcugcacgcugccgccccuccgcuucaagggggaggacggcugcugguacgggauggagauccggcccgugaaggagaaggaggagaaccuggucaaguccauggugagcgccggcagcggcgagguggacuccuucagccucgggcugcugugcaucuccaucaugaucgaggaggucaugcgcagccgguggucccgcaagaugcucaugaccggcacccuggccguguuccugcuccugaucauggggcagcugaccuggaacgaccucauccggcugugcaucauggugggcgccaacgccagcgaccgcauggggaugggcacgaccuaccuggcgcucauggccaccuucaagaugcgcccgauguucgccgucggccugcuguuccggcgccucaccucccgggaggugcugcugcucacgaucgggcugagccuggucgccuccguggagcuccccaacagccuggaggagcugggcgacgggcucgccaugggcaucaugauccugaagcugcucaccgacuuccagucccaccagcugugggcgacccugcucagccugaccuucaucaagacgacccugucccuccacuacgccuggaagaccauggccauggugcugagcaucgucucccuguucccccucugccugagcaccacgucccagaagaccaccuggcugcccgugcuccugggcagccuggggugcaagccgcucaccauguuccugaucgccgagaacaagaucuggggccgcaaguccuggccccugaacgaggggaucauggcggugggcgucgugagcauccuccugagcucccugcucaagaacgacgugccccuggccgggccccugaucgccggcggcaugcucaucgccugcuacgucaucagcggguccagcgccgaccugucccuggagaaggcggccgaggugagcugggaggaggaggccgagcacuccggcgccagccacaacauccucguggagguccaggacgacgggacgaugaagaucaaggacgaggagcgggacgacacccugaccauccugcucaaggccacccugcuggcgguguccggcguguacccgcucagcauccccgccacccuguucgucugguacuucuggcagaagaagaagcagcgcuccggggugcugugggacacgcccagcccgcccgagguggagcgggccguccuggacgacggcaucuaccgcaucaugcagcggggccuccuggggcgcucccaggugggcgugggggucuuccaggagaacguguuccacaccauguggcacgugacccggggcgccguccugauguaccaggggaagcgccucgagcccagcugggccuccgugaagaaggaccugaucagcuacggcggcggguggcggcugcagggcuccuggaacaccggggaggaggugcaggucaucgcgguggagcccggcaagaaccccaagaacgugcagacggcccccgggaccuucaagacccccgagggcgaggucggcgccaucgcccucgacuucaagcccgggaccagcggcucccccaucgugaaccgcgaggggaagaucgugggccuguacggcaacggggucgugacgaccagcggcaccuacgugagcgccaucgcgcaggccaaggccucccaggaggggccgcugcccgagaucgaggacgaggucuuccggaagcgcaaccucaccaucauggaccugcaccccggcagcgggaagacgcggcgcuaccugccggccaucgugcgggaggcgaucaagcgcaagcuccggacccugauccuggcccccacccgcguggucgccuccgagauggccgaggcccucaagggcaugcccauccgcuaccagaccacggcggucaagagcgagcacaccggcaaggagaucguggaccugaugugccacgccaccuucaccaugcggcugcucucccccguccgcgugccgaacuacaacaugaucaucauggacgaggcccacuucacggaccccagcuccaucgccgcccggggguacaucagcacccgcgugggcaugggggaggcggccgccaucuucaugaccgccacgccgcccggcuccgucgaggccuucccgcagagcaacgcggugauccaggacgaggagcgggacauccccgagcgcuccuggaacagcggguacgaguggaucacggacuuccccggcaagaccgugugguucguccccuccaucaagagcggcaacgacaucgccaacugccugcggaagaacgggaagcgcgugauccagcugucccggaagaccuucgacaccgaguaccagaagacgaagaacaacgacugggacuacguggucaccaccgacaucagcgagaugggcgccaacuuccgcgccgaccgggugaucgacccgcgccggugccucaagcccgucauccugaaggacgggcccgagcgcgugauccuggcgggccccaugccggugaccgucgccuccgccgcccagcggcgcgggcggaucggccgcaaccacaacaaggagggcgaccaguacaucuacauggggcagccccucaacaacgacgaggaccacgcccacuggacggaggcgaagaugcugcuggacaacaucaacacccccgagggcaucauccccgcccucuucgagccggagcgggagaaguccgccgccaucgacggggaguaccgccugcgcggcgaggcccggaagaccuucguggagcugaugcgccgcggggaccuccccguguggcuguccuacaaggucgcgagcgagggcuuccaguacagcgaccgccgguggugcuucgacggcgagcgcaacaaccaggugcuggaggagaacauggacguggagaucuggaccaaggagggggagcggaagaagcuccgcccccgguggcuggacgcccgcacguacuccgacccccuggcccuccgggaguucaaggaguucgccgccggccgccggagcgucuccggggaccugauccuggagaucggcaagcucccgcagcaccugacccagcgcgcgcagaacgcccuggacaaccucgugaugcugcacaacagcgagcagggcgggcgggccuaccgccacgccauggaggagcugcccgacaccaucgagacccucaugcugcuggcgcucaucgccgugcugacgggcggggucacccuguucuuccucuccggccgggggcugggcaagaccagcaucggccugcucugcgugauggccuccagcgugcugcuguggauggccuccgucgagccccacuggaucgccgcgagcaucauccucgaguucuuccugauggugcugcucauccccgagccggaccgccagcggacgccccaggacaaccagcuggccuacguggucaucgggcuccucuucaugauccugaccguggccgccaacgagaugggccugcucgagacgaccaagaaggaccuggggaucggccacguggccgucgagaaccaccaccacgcgaccaugcuggacguggaccuccaccccgccuccgccuggacccuguacgccguggccacgaccaucaucaccccgaugaugcgccacaccaucgagaacacgaccgcgaacaucagccugaccgccaucgccaaccaggccgccauccucauggggcuggacaagggcuggcccaucuccaagauggacaucggcgucccccugcucgcgcuggggugcuacagccaggugaacccccugacccucacggccgccgugcugaugcuggucgcccacuacgcgaucaucggcccggggcuccaggccaaggccacccgggaggcccagaagcgcaccgccgcgggcaucaugaagaaccccaccguggacgggaucguggccaucgaccuggaccccgucguguacgacgccaaguucgagaagcagcugggccagaucaugcuccugauccugugcacgucccagauccuccugaugcgcaccaccugggcccugugcgagagcaucacccucgccacgggcccccugaccacccugugggagggguccccgggcaaguucuggaacaccacgaucgcggugagcauggccaacaucuuccggggguccuaccucgccggcgccggccuggccuucagccugaugaagucccucgggggcgggcgccggggcaccggggcgcagggcgagacccugggcgagaaguggaagcgccagcugaaccagcucuccaagagcgaguucaacaucuacaagcgguccgggaucauggaggucgaccgcagcgaggccaaggagggccugaagcgcggggagaccacgcgccacgccgugucccggggcaccgccaagcugcgcugguucguggagcggaaccuggucaagcccgaggggaaggugaucgaccucggcugcggccgcgggggcuggagcuacuacugcgcggggcugaagaaggugaccgaggucaagggcuacaccaagggcgggcccggccacgaggagcccaucccgauggccacguacggguggaaccuggugaagcuccacuccggcaaggacguguucuucacgccgcccgagaagugcgacacccugcugugcgacaucggggagagcucccccaacccgaccaucgaggagggccggacgcuccgcguccugaagaugguggagcccuggcugcgggggaaccaguucugcaucaagauccucaaccccuacaugcccagcguggucgagacccuggagcagaugcagcgcaagcacggcggcaugcuggugcggaacccgcucucccgcaacagcacccacgagauguacuggguguccugcgggaccggcaacaucgucagcgccgugaacaugaccucccggaugcugcugaaccgcuucacgauggcccaccgcaagcccaccuacgagcgggacguggaccucggggccggcacccgccacgucgcgguggagcccgaggucgccaaccuggacaucaucggccagcggaucgagaacaucaagcacgagcacaagagcaccuggcacuacgacgaggacaaccccuacaagacgugggccuaccacggguccuacgaggugaagccgagcggcuccgccagcagcauggugaacggggucgugaagcugcucaccaagcccugggacgugauccccauggucacccagaucgccaugaccgacacgacccccuucggccagcagcgcguguucaaggagaagguggacacccggaccccgaaggcgaagcgcgggacggcccagaucauggaggucaccgcccgguggcuguggggcuuccugucccgcaacaagaagccccggaucugcacccgcgaggaguucacccggaaggugcgcagcaacgccgccaucggcgcgguguucgucgacgagaaccaguggaacuccgccaaggaggccguggaggacgagcgguucugggaccucgugcagaaggagcgcgagcugcacaagcaggggaagugcgccacgugcgucuacaacaugaugggcaagcgggagaagaagcugggggaguucggcaaggcgaaggggagccgcgccaucugguacauguggcucggcgcccgguuccuggaguucgaggcccugggcuucaugaacgaggaccacugguucucccgcgagaacagccucuccgggguggagggcgaggggcugcacaagcugggcuacauccuccgggacaucagcaagauccccgggggcaacauguacgccgacgacaccgcgggcugggacacccgcaucaccgaggacgaccugcagaacgaggccaagaucacggacaucauggagccggagcacgcccugcucgccaccuccaucuucaagcugaccuaccagaacaaggugguccgggugcagcgccccgccaagaacgggaccgugauggacgucaucagccgccgggaccagcgcggcuccggccaggugggcacguacggccugaacaccuucaccaacauggaggcgcagcucauccggcagauggagagcgaggggaucuuccugcccuccgagcuggagacccccaaccucgccgagcgcgugcuggacuggcuggagaagcacggcgucgagcggcucaagcgcauggccaucagcggggacgacugcguggugaagccgaucgacgaccgguucgccacggcccugaccgcgcugaacgacaugggcaagguccgcaaggacaucccccagugggagcccuccaagggguggaacgacuggcagcagguccccuucugcagccaccacuuccaccagcucaucaugaaggacggccgggagaucguggucccgugccgcaaccaggacgagcuggugggccgggcccgcgugucccagggggccggcuggagccugcgggagaccgccugccucggcaagagcuacgcccagauguggcagcugauguacuuccaccgccgggaccugcgccucgcggccaacgccaucugcuccgccguccccguggacugggugcccaccagccggacgaccugguccauccacgcgcaccaccaguggaugaccaccgaggacaugcugagcgucuggaaccgcguguggaucgaggagaaccccuggauggaggacaagacgcacguguccagcuggggcgacgucccguaccuggggaagcgggaggaccaguggugcggcucccucaucggccugaccgcccgcgccaccugggccagcaacauccagguggccaucaaccaggugcgccggcugaucgggaacgagaacuaccucgacuacaugaccuccaugaagcgcuucaagaacgagggcgaccccgagggggcgcugugguga

SEQ ID NO: 8471 - RNA, 9879 nt, Artificial Sequence
  derived and/or modified CDS sequence (opt1) from DENV-1__FJ898375__SS-prME
agcgugaccaugcugcucaugcugaugcccaccgcccuggccuuccaccucacgacccggggcggggagccccacaugaucgugagcaagcaggagcggggcaagagccugcuguucaagaccagcgcgggggugaacaugugcacccucaucgccauggaccugggcgaguucugcgaggacacgaugaccuacaagugcccccgcaucaccgaggccgagcccgacgacguggacugcuggugcaacgccaccgacacgugggugaccuacgggaccugcagccagaccggcgagcaccggcgggacaagcgguccguggcccuggcgccccacgugggccucgggcuggagacgcgcaccgagaccuggaugagcuccgagggcgccuggaagcagauccagcggguggagaccugggcccugcgccaccccggguucacggugauggcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugcccgacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaagaccguccaguacgagaaccugaaguacagcgugaucgugaccguccacacgggcgaccagcaccagguggggaacgaguccaccgagcacggcaccaccgcgaccaucacgccccaggcccccagcaccgagauccagcugaccgacuacggggcccucacccuggacugcagcccccggacgggccuggacuucaacgagaugguccuccugaccaugaaggagaaguccuggcuggugcacaagcagugguuccucgaccugccgcugcccuggaccagcggggccuccaccagccaggagacguggaaccggaaggaccuccuggugaccuucaagaccgcccacgcgaagaagcaggaggucguggugcugggcucccaggagggcgccaugcacaccgcccucacgggggccaccgagauccagaccagcggcaccacgaccaucuucgccgggcaccugaagugccgccugaagauggacaagcucacccugaagggcauguccuacgucaugugcaccgggagcuucaagcuggagaaggagguggcggagacgcagcacggcaccgugcucguccagaucaaguacgagggcaccgacgcccccugcaagauccccuucuccacccaggacgagaagggggugacgcagaacggccggcugaucaccgccaacccgaucgugaccgacaaggagaagcccgucaacaucgaggccgagccgcccuucggggagagcuacaucgugaucggcgcgggcgagaaggcccugaagcuguccugguucaagaaggggagcuccaucggcaagauguucgaggccaccgcccgcggggcccggcgcauggcgauccucggcgacacggccugggacuucgggagcaucggcggcguguucaccuccgucgggaagcuggugcaccagaucuucggcaccgccuacggggugcuguucagcggcgucuccuggaccaugaagaucgggaucggcgugcuccugacguggcugggccucaacagccgcuccaccagccuguccaugaccugcaucgccguggggcuggucacccucuaccugggcgugauggugcaggccgacagcgggugcgucaucaacuggaagggccgggagcugaagugcgggagcggcaucuucgugacgaacgaggugcacaccuggaccgagcaguacaaguuccaggcggacuccccgaagcgccucagcgccgccaucggcaaggccugggaggagggggucugcggcauccgguccgccacccgccuggagaacaucauguggaagcagaucagcaacgagcugaaccacauccuccuggagaacgacaugaaguucaccgugguggucggggacguggcgggcauccuggcccaggggaagaagaugauccggccccagcccauggaguacaaguacuccuggaaguccuggggcaaggccaagaucaucggcgccgacgugcagaacacgaccuucaucaucgacgggcccaacaccccggagugccccgacgaccagcgcgcguggaacaucugggaggucgaggacuacggcuucgggaucuucaccacgaacaucuggcucaagcugcgggacuccuacacccaggugugcgaccaccgccugaugagcgccgccaucaaggacuccaaggccgugcacgccgacaugggcuacuggaucgagagcgagaagaacgagaccuggaagcucgcgcgggccuccuucaucgaggucaagaccugcaucuggcccaagagccacacgcugugguccaacggcgugcuggagagcgagaugaucauccccaagaucuacgggggcccgaucucccagcacaacuaccgccccggguacuucacccagaccgccggccccuggcaccucgggaagcuggagcuggacuucgaccucugcgagggcaccacgguggucguggacgagcacugcggcaaccgggggccgagccugcgcaccaccaccgugacgggcaagaucauccacgaguggugcugccgguccugcacccugccgccccugcgcuucaagggggaggacggcugcugguacgggauggagauccggcccgucaaggagaaggaggagaaccuggucaagagcauggugagcgccggcuccggcgaggucgacagcuucucccuggggcuccugugcaucagcaucaugaucgaggaggugaugcgcucccgguggagccgcaagaugcugaugaccggcacccucgccguguucuuccugcugaucauggggcagcucacguggaacgaccugauccggcugugcaucauggucggcgcgaacgccuccgaccgcauggggaugggcaccaccuaccucgcccugauggccaccuucaagaugcgcccgauguucgccguggggcuccuguuccggcgccugacgagccgggaggugcugcuccugaccaucgggcugucccucgucgcgagcguggagcugcccaacucccuggaggagcucggcgacgggcuggccaugggcaucaugauccugaagcuccugaccgacuuccagagccaccagcugugggccacccuccugucccugacguucaucaagaccaccuucagccuccacuacgccuggaagaccauggcgaugguccuguccaucgugagccuguucccccucugccuguccacgaccagccagaagaccaccuggcugcccgugcuccugggcucccuggggugcaagccgcucacgauguuccugaucgccgagaacaagaucuggggccgcaagagcuggccccugaacgaggggaucauggccgucggcaucgugagcauccuccuguccagccugcucaagaacgacgugccccuggccgggccccugaucgccggcggcaugcucaucgcgugcuacgucaucuccgggagcuccgccgaccugagccuggagaaggccgccgagguguccugggaggaggaggccgagcacagcggcgcgucccacaacauccucguggagguccaggacgacgggaccaugaagaucaaggacgaggagcgggacgacacccugaccauccugcucaaggccacccugcuggccgugagcggcguguacccgcucuccauccccgccacgcuguucgucugguacuucuggcagaagaagaagcagcgcagcggggugcugugggacacccccagcccgcccgagguggagcgggccguccucgacgacggcaucuaccgcaucaugcagcggggccugcuggggcgcagccaggugggcgugggggucuuccaggagaacguguuccacaccauguggcacgugacccggggcgcgguccugauguaccaggggaagcgccucgagcccuccugggccagcgugaagaaggaccugaucuccuacggcggcggguggcggcugcagggcagcuggaacacgggggaggaggugcaggucaucgccguggagcccggcaagaaccccaagaacgugcagaccgcccccgggaccuucaagaccuccgagggcgaggucggcgccaucgcgcucgacuucaagcccgggacgagcggcagccccaucgugaaccgcgaggggaagaucgugggccuguacggcaacggggucgugaccaccuccggcaccuacgugagcgccaucgcccaggccaaggcgucccaggaggggccccugccggagaucgaggacgaggucuuccggaagcgcaaccucacgaucauggaccugcaccccggcagcgggaagacccggcgcuaccugcccgccaucgugcgggaggccaucaagcgcaagcuccggacccugauccuggccccgacccgcguggucgccuccgagauggcggaggcccucaagggcaugcccauccgcuaccagacgaccgccgucaagagcgagcacaccggcaaggagaucguggaccugaugugccacgccaccuucacgaugcggcugcucucccccguccgcgugcccaacuacaacaugaucaucauggacgaggcccacuucaccgacccgagcuccaucgcggcccggggguacaucagcacccgcgugggcaugggggaggccgccgccaucuucaugaccgcgacgccgcccggcuccgucgaggccuucccccagagcaacgccgugauccaggacgaggagcgggacaucccggagcgcuccuggaacagcggguacgaguggaucaccgacuuccccggcaagaccgugugguucguccccuccaucaagagcggcaacgacaucgccaacugccugcggaagaacgggaagcgcgugauccagcugucccggaagaccuucgacacggaguaccagaagaccaagaacaacgacugggacuacguggucaccaccgacaucagcgagaugggcgcgaacuuccgcgccgaccgggugaucgacccccgccggugccucaagccggugauccugaaggacgggcccgagcgcgucauccuggccggccccaugcccgugacggucgccuccgccgcgcagcggcgcgggcggaucggccgcaaccacaacaaggagggcgaccaguacaucuacauggggcagccgcucaacaacgacgaggaccacgcccacuggaccgaggccaagaugcugcuggacaacaucaacacccccgagggcaucauccccgcccucuucgagcccgagcgggagaaguccgccgcgaucgacggggaguaccgccugcgcggcgaggcccggaagaccuucguggagcugaugcgccgcggggaccucccgguguggcugagccacaaggucgccuccgagggcuuccaguacagcgaccgccgguggugcuucgacggcgagcgcaacaaccaggugcuggaggagaacauggacguggagaucuggacgaaggagggggagcggaagaagcuccgcccccgguggcuggacgcccgcaccuacuccgacccccuggcccuccgggaguucaaggaguucgcggccggccgccggagcgucuccggggaccugauccuggagaucggcaagcucccccagcaccugacccagcgcgcccagaacgcccuggacaaccucgugaugcugcacaacagcgagcagggcgggcgggcguaccgccacgccauggaggagcugccggacaccaucgagacgcucaugcugcuggcccucaucgccgugcugaccggcggggucacccuguucuuccucuccggccgggggcugggcaagaccagcaucggccugcucugcgugauggccuccagcgugcugcuguggauggcguccgucgagccccacuggaucgccgccagcaucauccucgaguucuuccugauggugcugcucauccccgagcccgaccgccagcggaccccgcaggacaaccagcuggccuacguggucaucgggcuccucuucaugauccugacgguggccgcgaacgagaugggccugcucgagaccaccaagaaggaccuggggaucggccacguggccgucgagaagcaccaccacgccgccaugcuggacguggaccuccaccccgccuccgcguggacccuguacgccguggccacgaccaucaucacccccaugaugcgccacaccaucgagaacacgaccgccaacaucagccugaccgccaucgcgaaccaggccgccauccucauggggcuggacaagggcuggccgaucuccaagauggacaucggcgucccccugcucgcccuggggugcuacagccaggugaacccccugacccucacggcggccgugcugaugcuggucgcccacuacgccaucaucggccccgggcuccaggccaaggcgacccgggaggcccagaagcgcaccgccgccggcaucaugaagaacccgaccguggacgggaucguggccaucgaccuggaccccgucguguacgacgcgaaguucgagaagcagcugggccagaucaugcuccugauccugugcacgucccagauccuccugaugcgcaccaccugggcccugugcgagagcaucacccucgccacgggcccccugaccacccugugggaggggucccccggcaaguucuggaacaccacgaucgccgugagcauggccaacaucuuccgggggagcuaccucgcgggcgccggccuggccuucucccugaugaagucccucgggggcgggcgccggggcaccggggcccagggcgagacccugggcgagaaguggaagcgccagcugaaccagcucuccaagagcgaguucaacaccuacaagcgguccgggaucauggaggucgaccgcagcgaggcgaaggagggccugaagcgcggggagacgaccaagcacgccgugucccgcggcaccgccaagcugcggugguucguggagcgcaaccucgucaagccggaggggaaggugaucgaccugggcugcggccgcggcggguggagcuacuacugcgccgggcugaagaaggugaccgaggucaagggguacacgaagggcgggcccggccacgaggagcccauccccauggccaccuacggguggaaccuggugaagcuccacuccggcaaggacguguucuucaucccgcccgagaagugcgacacccugcugugcgacaucggggagagcucccccaaccccaccaucgaggagggccgcacgcuccggguccugaagaugguggagccguggcugcgcgggaaccaguucugcaucaagauccucaaccccuacaugcccagcguggucgagacccuggagcagaugcagcggaagcacggcggcaugcuggugcgcaacccccucucccggaacagcacccacgagauguacuggguguccugcgggaccggcaacaucgucagcgcggugaacaugaccucccgcaugcugcugaaccgguucacgauggcccaccgcaagccgaccuacgagcgcgacguggaccucggggccggcacccggcacgucgccguggagcccgagguggccaaccuggacaucaucggccagcgcaucgagaacaucaagcacgagcacaagagcaccuggcacuacgacgaggacaaccccuacaagacgugggcguaccacggguccuacgaggucaagcccagcggcagcgccuccagcauggugaacggggucgugaagcugcucaccaagccgugggacgugauccccauggucacccagaucgccaugaccgacacgacccccuucggccagcagcggguguucaaggagaagguggacacccgcacccccaaggccaagcgggggacggcccagaucauggaggucaccgcgaaguggcuguggggcuuccugucccgcaacaagaagccgcggaucugcacccgcgaggaguucacccggaaggugcgcagcaacgccgccaucggcgccguguucgucgacgagaaccaguggaacuccgcgaaggaggccguggaggacgagcgguucugggaccucgugcaccgcgagcgggagcugcacaagcaggggaagugcgccacgugcgucuacaacaugaugggcaagcgcgagaagaagcugggggaguucggcaaggccaaggggagccgggccaucugguacauguggcucggcgcgcgcuuccuggaguucgaggcccugggcuucaugaacgaggaccacugguucucccgggagaacagccucuccgggguggagggcgaggggcugcacaagcugggcuacauccuccgcgacaucagcaagauccccgggggcaacauguacgccgacgacaccgccggcugggacacccggaucaccgaggacgaccugcagaacgaggccaagaucacggacaucauggagcccgagcacgcgcugcucgccaaguccaucuucaagcugaccuaccagaacaaggugguccgcgugcagcggccggccaagaacgggaccgugauggacgucaucagccgccgcgaccagcggggcuccggccaggugggcaccuacggccugaacacguucaccaacauggaggcccagcucauccgccagauggagagcgaggggaucuucucccccagcgagcuggagacccccaaccuggccggccgggugcucgacuggcuggagaagcacggggucgagcgccugaagcggauggcgaucuccggcgacgacugcguggugaagcccaucgacgaccgcuucgccaccgcccucacggcccugaacgacauggggaagguccggaaggacaucccgcagugggagcccagcaagggcuggaacgacuggcagcagguccccuucugcagccaccacuuccaccagcugaucaugaaggacggccgcgagaucgugguccccugccggaaccaggacgagcucguggggcgcgcccgggugucccagggcgcgggguggagccugcgcgagaccgccugccugggcaaguccuacgcccagauguggcagcucauguacuuccaccggcgcgaccugcggcuggccgcgaacgccaucugcagcgccgucccgguggacugggugcccaccucccgcaccacguggagcauccacgcccaccaccaguggaugaccaccgaggacaugcucuccgucuggaaccggguguggaucgaggagaaccccuggauggaggacaagacccacaucagcuccuggggcgacgugcccuaccugggcaagcgcgaggaccaguggugcggcagccugaucgggcucacggcccgggcgaccugggccaccaacauccaggucgccaucaaccaggugcgccgccugaucggcaacgagaacuaccuggacuacaugaccuccaugaagcgguucaagaacgagagcgacccggagggggcccucugguga

SEQ ID NO: 8472 - RNA, 9879 nt, Artificial Sequence
  derived and/or modified CDS sequence (opt1) from DENV-1__FJ898376__SS-prME
agcgugaccaugcugcucaugcugaugcccaccgcccuggccuuccaccucaccacccggggcggggagccccacaugaucgugaccaagcaggagcggggcaagagccugcuguucaagaccagcgcgggggugaacaugugcacccucaucgccauggaccugggcgagcugugcgaggacaccaugaccuacaagugcccccggaucaccgaggccgagcccgacgacguggacugcuggugcaacgccaccgacaccugggugaccuacgggaccugcagccagaccggcgagcaccggcgcgacaagcggagcguggcccucgcgccccacgugggccuggggcuggagacccgcaccgagaccuggauguccagcgagggcgccuggaagcagauccagcgggucgagacgugggcccuccgccaccccggguucaccgugaucgcccuguuccuggcgcacgugaucggcaccuccaucacccagaaggggaucaucuucauccuccugaugcuggucacgcccagcauggccaugcggugcgugggcaucggcucccgcgacuucguggaggggcucagcggcgccaccugggucgacguggugcuggagcacggguccugcgucaccaccauggccaaggacaagcccacgcuggacaucgagcuccugaagaccgaggugaccaaccccgccgugcugcggaagcucugcaucgaggcgaagaucagcaacaccacgaccgacucccgcugccccacccagggcgaggccacccugauggaggagcaggacgccaacuucgucugccggcgcacguucguggaccggggcugggggaacggcugcgggcuguucggcaaggggagccucaucacgugcgccaaguucaagugcgugaccaagcuggagggcaagaucguccaguacgagaaccugaaguacuccgugaucgugaccguccacacgggcgaccagcaccagguggggaacgagagcaccgagcacggcaccaccgccaccaucacgccccaggcgcccaccuccgagauccagcucaccgacuacggggcccugacccuggacugcagcccccgcacgggccucgacuucaacgagaugguccugcugaccaugaaggagaaguccuggcucgugcacaagcagugguuccuggaccugccgcuccccuggaccagcggggccagcaccucccaggagacguggaaccggcaggaccugcuggugaccuucaagaccgcccacgccaagaagcaggaggucguggugcucggcagccaggagggcgcgaugcacaccgcccugacgggggccaccgagauccagaccuccggcaccacgaccaucuucgccgggcaccugaagugccgccucaagauggacaagcugacccugaagggcaugagcuacgucaugugcaccggguccuucaagcucgagaaggagguggccgagacgcagcacggcaccgugcugguccagaucaaguacgagggcaccgacgcgcccugcaagauccccuucagcacccaggacgagaagggggugacgcagaacggccggcugaucaccgccaacccgaucgugaccgacaaggagaagcccgucaacaucgaggccgagccgcccuucggggaguccuacaucgugaucggcgccggcgagaaggcgcugaagcucagcugguucaagaagggguccagcaucggcaagauguucgaggccaccgcccgcggggcccggcgcauggccauccugggcgacacggcgugggacuucggguccaucggcggcguguucaccagcgucgggaagcuggugcaccagaucuucggcaccgccuacgggguccuguucuccggcgucagcuggaccaugaagaucgggaucggcgugcugcugacguggcucggccugaacucccgcagcaccucccugagcaugaccugcaucgccguggggcucgucacccuguaccugggcgugauggugcaggccgacuccgggugcgucaucaacuggaagggccgggagcucaagugcgggagcggcaucuucgugacgaacgaggugcacaccuggaccgagcaguacaaguuccaggccgacagcccgaagcgccuguccgcggccaucggcaaggccugggaggagggggucugcggcauccggagcgccacccgccuggagaacaucauguggaagcagaucuccaacgagcucaaccacauccugcuggagaacgacaugaaguucaccgugguggucggggacguggugggcauccucgcccaggggaagaagaugauccggccccagcccauggagcacaaguacagcuggaaguccuggggcaaggcgaagaucaucggcgccgacguccagaacacgaccuucaucaucgacgggcccaacaccccggagugccccgacgaccagcgcgccuggaacaucugggagguggaggacuacggcuucgggaucuucaccacgaacaucuggcugaagcugcgggacagccacacccaggugugcgaccaccgccucauguccgccgcgaucaaggacagcaaggccguccacgccgacaugggcuacuggaucgaguccgagaagaacgagaccuggaagcuggcccgggccagcuucaucgaggugaagaccugcaucuggcccaagucccacacgcuguggagcaacggcgugcucgaguccgagaugaucauccccaagaucuacgggggcccgaucagccagcacaacuaccgccccggguacuucacccagaccgcgggccccuggcaccuggggaagcuggagcucgacuucgaccugugcgagggcaccacggucgugguggacgagcacugcggcaaccgggggccgucccugcgcaccaccaccgucacgggcaagaucauccacgaguggugcugccggagcugcacccugccgccccuccgcuucaagggggaggacggcugcugguacgggauggagauccggcccgugaaggagaaggaggagaaccuggugaaguccauggucagcgccggcagcggcgagguggacuccuucagccucgggcugcugugcaucuccaucaugaucgaggaggugaugcgcagccgguggucccgcaagaugcucaugaccggcacccuggccgucuuccugcuccugaucauggggcagcugacguggaacgaccucauccggcugugcaucauggugggcgccaacgccagcgaccgcauggggaugggcaccaccuaccuggcgcucauggccaccuucaagaugcgcccgauguucgccguggggcugcuguuccggcgccucacgucccgggagguccugcugcucaccaucgggcugagccugguggccuccgucgagcuccccaacagccuggaggagcugggcgacgggcucgccaugggcaucaugauccugaagcugcucaccgacuuccagucccaccagcugugggcgacccugcucagccugacguucaucaagaccacccugucccuccacuacgccuggaagaccauggccauggugcugagcaucgugucccuguucccccucugccugagcacgaccucccagaagaccaccuggcugcccguccuccugggcagccuggggugcaagccgcucgccauguuccugaucgcggagaacaagaucuggggccgcaaguccuggccccugaacgaggggaucauggccgugggcguggucagcauccuccugagcucccugcucaagaacgacgugccccuggccgggccccugaucgccggcggcaugcucaucgccugcuacgugaucagcggguccagcgcggaccugucccuggagaaggccgccgaggucagcugggaggaggaggccgagcacuccggcgccagccacaacauccucguggaggugcaggacgacgggacgaugaagaucaaggacgaggagcgggacgacacccugaccauccugcucaaggcgacccugcuggccgucuccggcguguacccgcucagcauccccgccacccuguucgugugguacuucuggcagaagaagaagcagcgcuccgggguccugugggacacgcccagcccgcccgagguggagcgggccgugcuggacgacggcaucuaccgcaucaugcagcggggccuccuggggcgcucccaggucggcguggggguguuccaggagaacgucuuccacaccauguggcacgugacccggggcgccgugcugauguaccaggggaagcgccucgagcccagcugggcguccgucaagaaggaccugaucagcuacggcggcggguggcggcugcagggcuccuggaacaccggggaggagguccaggugaucgccgucgagcccggcaagaaccccaagaacgugcagacggcccccgggaccuucaagacccccgagggcgaggugggcgccaucgcccucgacuucaagcccgggaccagcggcucccccaucgucaaccgcgaggggaagaucgugggccuguacggcaacgggguggucacgaccagcggcaccuacgugagcgcgaucgcccaggccaaggccucccaggaggggccgcugcccgagaucgaggacgagguguuccggaagcgcaaccucaccaucauggaccugcaccccggcagcgggaagacgcggcgcuaccugccggcgaucguccgggaggccaucaagcgcaagcuccggacccugauccuggcccccacccgcgugguggccuccgagauggccgaggcgcucaagggcaugcccauccgcuaccagaccacggccgucaagagcgagcacaccggcaaggagaucguggaccugaugugccacgccaccuucaccaugcggcugcucucccccgugcgcgucccgaacuacaacaugaucaucauggacgaggcccacuucacggaccccagcuccaucgccgcgcggggguacaucagcacccgcgugggcaugggggaggccgccgccaucuucaugaccgccacgccgcccggcuccguggaggcguucccgcagagcaacgccgucauccaggacgaggagcgggacauccccgagcgcuccuggaacagcggguacgaguggaucacggacuuccccggcaagaccgugugguucgugcccuccaucaagagcggcaacgacaucgccaacugccugcggaagaacgggaagcgcgucauccagcugucccggaagaccuucgacaccgaguaccagaagacgaagaacaacgacugggacuacguggugaccaccgacaucagcgagaugggcgccaacuuccgcgcggaccgggucaucgacccgcgccggugccucaagcccgugauccugaaggacgggcccgagcgcgucauccuggccggccccaugccggugaccguggccuccgccgcccagcggcgcgggcggaucggccgcaaccacaacaaggagggcgaccaguacaucuacauggggcagccccucaacaacgacgaggaccacgcgcacuggacggaggccaagaugcugcuggacaacaucaacacccccgagggcaucauccccgcccucuucgagccggagcgggagaaguccgccgccaucgacggggaguaccgccugcgcggcgaggcgcggaagaccuucgucgagcugaugcgccgcggggaccuccccguguggcuguccuacaagguggccagcgagggcuuccaguacagcgaccgccgguggugcuucgacggcgagcgcaacaaccagguccuggaggagaacauggacguggagaucuggaccaaggagggggagcggaagaagcuccgcccccgguggcuggacgcccgcacguacuccgacccccuggcccuccgggaguucaaggaguucgccgcgggccgccggagcguguccggggaccugauccuggagaucggcaagcucccgcagcaccugacccagcgcgcccagaacgcccuggacaaccucgucaugcugcacaacagcgagcagggcgggcgggccuaccgccacgcgauggaggagcugcccgacaccaucgagacccucaugcugcuggcccucaucgccgugcugacgggcggggugacccuguucuuccucuccggccgggggcugggcaagaccagcaucggccugcucugcgucauggccuccagcgugcugcuguggauggccuccguggagccccacuggaucgcggccagcaucauccucgaguucuuccugaugguccugcucauccccgagccggaccgccagcggacgccccaggacaaccagcuggccuacguggugaucgggcuccucuucaugauccugaccgucgccgccaacgagaugggccugcucgagacgaccaagaaggaccuggggaucggccacguggcgguggagaaccaccaccacgccaccaugcuggacgucgaccuccaccccgccuccgccuggacccuguacgccguggcgacgaccaucaucaccccgaugaugcgccacaccaucgagaacacgaccgccaacaucagccugaccgccaucgccaaccaggccgcgauccucauggggcuggacaagggcuggcccaucuccaagauggacaucggcgugccccugcucgcccuggggugcuacagccaggucaacccccugacccucacggccgccgugcugaugcugguggcgcacuacgccaucaucggcccggggcuccaggccaaggccacccgggaggcccagaagcgcaccgcggccggcaucaugaagaaccccaccgucgacgggaucguggccaucgaccuggaccccguggucuacgacgccaaguucgagaagcagcugggccagaucaugcuccugauccugugcacgucccagauccuccugaugcgcaccaccugggcccugugcgagagcaucacccucgcgacgggcccccugaccacccugugggagggguccccgggcaaguucuggaacaccacgaucgccgugagcauggccaacaucuuccggggguccuaccucgccggcgccggccuggcguucagccugaugaagucccucgggggcgggcgccggggcaccggggcccagggcgagacccugggcgagaaguggaagcgccagcugaaccagcucuccaagagcgaguucaacaucuacaagcgguccgggaucauggagguggaccgcagcgaggccaaggagggccugaagcgcggggagaccacgcgccacgccgucucccggggcaccgcgaagcugcgcugguucguggagcggaaccuggugaagcccgaggggaaggucaucgaccucggcugcggccgcgggggcuggagcuacuacugcgccgggcugaagaaggugaccgaggugaagggcuacaccaagggcgggcccggccacgaggagcccaucccgauggccacguacggguggaaccuggucaagcuccacuccggcaaggacguguucuucacgccgcccgagaagugcgacacccugcugugcgacaucggggagagcucccccaacccgaccaucgaggagggccggacgcuccgcgugcugaagauggucgagcccuggcugcgggggaaccaguucugcaucaagauccucaaccccuacaugcccagcgugguggagacccuggagcagaugcagcgcaagcacggcggcaugcugguccggaacccgcucucccgcaacagcacccacgagauguacuggguguccugcgggaccggcaacaucgugagcgccgucaacaugaccucccggaugcugcugaaccgcuucacgauggcccaccgcaagcccaccuacgagcgggacguggaccucggggcgggcacccgccacguggccgucgagcccgagguggccaaccuggacaucaucggccagcggaucgagaacaucaagcacgagcacaagagcaccuggcacuacgacgaggacaaccccuacaagacgugggccuaccacggguccuacgaggucaagccgagcggcuccgccagcagcauggugaacgggguggucaagcugcucaccaagcccugggacgugauccccauggugacccagaucgcgaugaccgacacgacccccuucggccagcagcgcgucuucaaggagaagguggacacccggaccccgaaggccaagcgcgggacggcccagaucauggaggugaccgcccgguggcuguggggcuuccugucccgcaacaagaagccccggaucugcacccgcgaggaguucacccggaagguccgcagcaacgccgcgaucggcgccguguucguggacgagaaccaguggaacuccgccaaggaggccgucgaggacgagcgguucugggaccucgugcagaaggagcgcgagcugcacaagcaggggaagugcgcgacgugcguguacaacaugaugggcaagcgggagaagaagcugggggaguucggcaaggccaaggggagccgcgccaucugguacauguggcucggcgcccgguuccuggaguucgaggcccugggcuucaugaacgaggaccacugguucucccgcgagaacagccucuccggggucgagggcgaggggcugcacaagcugggcuacauccuccgggacaucagcaagauccccgggggcaacauguacgcggacgacaccgccggcugggacacccgcaucaccgaggacgaccugcagaacgaggccaagaucacggacaucauggagccggagcacgcccugcucgccaccuccaucuucaagcugaccuaccagaacaagguggugcggguccagcgccccgcgaagaacgggaccgugauggacgugaucagccgccgggaccagcgcggcuccgggcaggucggcacguacggccugaacaccuucaccaacauggaggcccagcucauccggcagauggagagcgaggggaucuuccugcccuccgagcuggagacccagaaccucgccgagcgcgugcuggacuggcuggagaaguacggcguggagcggcucaagcgcauggccaucagcggggacgacugcgucgugaagcccaucgacgaccgguucgccacggcgcugaccgcccugaacgacaugggcaaggugcgcaaggacaucccgcagugggagcccuccaagggguggaacgacuggcagcagguccccuucugcagccaccacuuccaccagcucaucaugaaggacggccgggagaucguggugcccugccgcaaccaggacgagcuggucggccgggcccgcgugucccagggggccggcuggagccugcgggagaccgccugccucggcaagagcuacgcgcagauguggcagcugauguacuuccaccgccgggaccugcgccucgccgccaacgccaacugcuccgcggugccggucgacugggugcccaccagccggacgaccugguccauccacgcccaccaccaguggaugaccaccgaggacaugcugagcguguggaaccgcgucuggaucgaggagaaccccuggauggaggacaagacgcacguguccagcuggggcgacgugcccuaccuggggaagcgggaggaccaguggugcggcucccucaucggccugaccgcccgcgccaccugggccagcaacauccaggucgcgaucaaccaggugcgccggcugaucgggaacgagaacuaccucgacuacaugaccuccaugaagcgcuucaagaacgagggcgacccggagggggcccugugguga

SEQ ID NO: 8473 - RNA, 9879 nt, Artificial Sequence
  derived and/or modified CDS sequence (opt1) from DENV-1__FJ898379__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgagaccgagcccgacgacguggacugcuggugcaacgccacggacaccugggugaccuacgggaccugcagccagacgggcgagcaccggcgggacaagcgguccguggcccucgcgccccacgugggccuggggcuggagacccgcaccgagaccuggaugagcuccgagggcgcguggaagcagauccagcgggucgagacgugggcccuccggcaccccggguucaccgugaucgcccuguuccuggcccacgugaucggcaccagcaucacccagaaggggaucaucuucauccuccugaugcuggucacgcccuccauggcgaugcggugcgugggcaucggcagccgcgacuucguggaggggcucuccggcgccaccugggucgacguggugcuggagcacgggagcugcgucaccaccauggccaaggacaagcccacgcuggacaucgagcuccugaagaccgaggugaccaaccccgccgugcugcggaagcucugcaucgaggccaagaucuccaacaccacgaccgacagccgcugcccgacccagggcgaggcgacccuggucgaggagcaggacgccaacuucgugugccggcgcacguucguggaccggggcugggggaacggcugcgggcuguucggcaaggggucccucaucacgugcgccaaguucaagugcgucaccaagcuggagggcaagaucgugcaguacgagaaccugaaguacagcgugaucgucaccgugcacacgggcgaccagcaccaggucgggaacgaguccaccgagcacggcaccaccgccaccaucacgccccaggcccccaccaccgagauccagcucaccgacuacggggcgcugacgcuggacugcagcccccgcaccggccucgacuucaacgagauggugcugcugaccaugaaggagaaguccuggcucgugcacaagcagugguuccuggaccugccccuccccuggaccagcggggccagcacgucccaggagaccuggaaccggcaggaccugcuggucaccuucaagaccgcccacgccaagaagcaggagguggugguccucggcagccaggagggcgccaugcacacggcgcugaccggggccaccgagauccagaccuccggcacgaccaccaucuucgccgggcaccugaagugccgccucaagauggacaagcugacccugaagggcaugagcuacgugaugugcacgggguccuucaagcucgagaaggagguggccgagacccagcacggcaccguccuggugcagaucaaguacgagggcaccgacgcccccugcaagauccccuucagcacgcaggacgagaagggggugacccagaacggccggcugaucaccgcgaacccgaucgucaccgacaaggagaagcccgugaacaucgaggccgagccgcccuucggggaguccuacaucaucaucggcgccggcgagaaggcccugaagcucagcugguucaagaagggguccagcaucggcaagauguucgaggcgacggcccgcggggcccggcgcauggccauccugggcgacaccgccugggacuucggguccaucggcggcguguucaccagcgucgggaagcuggugcaccagaucuucggcaccgcguacggggugcuguucuccggcgucagcuggacgaugaagaucgggaucggcgugcugcugaccuggcucggccugaacucccgcagcaccucccugagcaugaccugcaucgccguggggcucgucacgcuguaccugggcgugauggugcaggccgacuccgggugcgucaucaacuggaagggccgggagcucaagugcgggagcggcaucuucgugaccaacgaggugcacaccuggaccgagcaguacaaguuccaggccgacagcccgaagcgccuguccgccgcgaucggcaaggccugggaggagggggucugcggcauccggagcgccacccgccuggagaacaucauguggaagcagaucuccaacgagcucaaccacauccugcuggagaacgacaugaaguucacggugguggucggggacguggccggcauccucgcccaggggaagaagaugauccggccccagcccauggaguacaaguacagcuggaaguccuggggcaaggcgaagaucaucggcgccgacgugcagaacaccaccuucaucaucgacgggcccaacaccccggagugccccgacgaccagcgcgccuggaacaucugggaggucgaggacuacggcuucgggaucuucacgaccaacaucuggcugaagcugcgggacagcuacacccaggugugcgaccaccgccucauguccgccgcgaucaaggacagcaaggccgugcacgccgacaugggcuacuggaucgaguccgagaagaacgagaccuggaagcuggcccgggccagcuucaucgaggucaagacgugcaucuggcccaagucccacacccuguggagcaacggcgugcucgaguccgagaugaucauccccaagaucuacgggggcccgaucagccagcacaacuaccgccccggguacuucacccagaccgcgggccccuggcaccuggggaagcuggagcucgacuucgaccugugcgagggcacgaccguggucguggacgagcacugcggcaaccgggggccgucccugcgcaccaccacggugaccggcaagaucauccacgaguggugcugccggagcugcacccugccgccccuccgcuuccgcggggaggacggcugcugguacgggauggagauccgccccgucaaggagaaggaggagaaccuggugaaguccauggugagcgccggcagcggcgaggucgacuccuucagccucgggcugcugugcaucuccaucaugaucgaggaggugaugcggagccgcuggucccggaagaugcucaugaccggcacgcuggccguguucuuccugcucaucauggggcagcugaccuggaacgaccugauccgccucugcaucauggucggcgccaacgccagcgaccgcauggggaugggcaccaccuaccuggcgcugauggccacguucaagaugcggccgauguucgccgugggccuccuguuccgccggcugaccucccgcgaggugcuccugcugaccaucgggcucagccuggucgccuccguggagcugcccaacagccucgaggagcugggcgacgggcuggccaugggcaucaugauccucaagcugcugaccgacuuccagucccaccagcucugggcgacgcugcugagccucaccuucaucaagaccaccuucucccugcacuacgccuggaagacgauggccaugguccugagcaucgugucccucuucccccugugccugagcaccaccucccagaagaccacguggcuccccgugcugcugggcagccucgggugcaagccgcugaccauguuccugaucgccgagaacaagaucuggggccggcgcuccuggccccucaacgaggggaucauggcggucggcaucgugagcauccugcugagcucccuccugaagaacgacgugccccuggccgggccccucaucgccggcggcaugcugaucgccugcuacgucaucagcggguccagcgccgaccugucccucgagaaggcggccgaggugagcugggaggaggaggccgagcacuccggcgccagccacaacauccugguggagguccaggacgacgggaccaugaagaucaaggacgaggagcgggacgacacccugaccauccuccugaaggccacgcugcucgcgguguccggcguguacccgcugagcauccccgccacccuguucgucugguacuucuggcagaagaagaagcagcgcuccggggugcucugggacacccccagcccgcccgagguggagcgggccguccuggacgacggcaucuaccgcaucaugcagcggggccugcuggggcgcucccaggugggcgugggggucuuccaggagaacguguuccacaccauguggcacgugacgcggggcgccguccucauguaccaggggaagcgccuggagcccagcugggccuccgugaagaaggaccugaucagcuacggcggcggguggcggcuccagggcuccuggaacaccggggaggaggugcaggucaucgcgguggagcccggcaagaaccccaagaacgugcagaccgcccccgggaccuucaagacgcccgagggcgaggucggcgccaucgcccuggacuucaagcccgggaccagcggcucccccaucgugaaccgcgaggggaagaucgugggccuguacggcaacggggucgugaccaccagcggcacguacgugagcgccaucgcgcaggccaaggccucccaggaggggccgcuccccgagaucgaggacgaggucuuccggaagcgcaaccugaccaucauggaccugcaccccggcagcgggaagacccggcgcuaccucccggccaucgugcgggaggcgaucaagcgcaagcugcgcacccugauccucgcccccacgcggguggucgccuccgagauggccgaggcccugaagggcaugcccauccgcuaccagaccaccgcggucaagagcgagcacaccggcaaggagaucguggaccugaugugccacgccacguucaccaugcggcuccugucccccguccgcgugccgaacuacaacaugaucaucauggacgaggcccacuucaccgaccccagcuccaucgccgcccggggguacaucagcacccgcgugggcaugggggaggcggccgccaucuucaugacggccacgccgcccggcuccgucgaggccuucccgcagagcaacgcggugauccaggacgaggagcgggacauccccgagcgcuccuggaacagcggguacgaguggaucaccgacuuccccggcaagaccgugugguucguccccuccaucaagagcggcaacgacaucgccaacugccugcggaagaacgggaagcgcgugauccagcucucccggaagacguucgacaccgaguaccagaagaccaagaacaacgacugggacuacguggucaccacggacaucagcgagaugggcgccaacuuccgcgccgaccgggugaucgacccgcgccggugccugaagcccgugauccugaaggacgggcccgagcgcgucauccucgcgggccccaugccggugaccgucgccuccgccgcccagcggcgcgggcggaucggccgcaaccacaacaaggagggcgaccaguacaucuacauggggcagccccugaacaacgacgaggaccacgcccacuggaccgaggcgaagaugcugcucgacaacaucaacacccccgagggcaucauccccgcccuguucgagccggagcgcgagaaguccgccgccaucgacggggaguaccggcugcgcggcgaggcccggaagacguucguggagcucaugcgccgcggggaccugcccguguggcuguccuacaaggucgcgagcgagggcuuccaguacagcgaccgccgguggugcuucgacggcgagcgcaacaaccaggugcucgaggagaacauggacguggagaucuggaccaaggagggggagcggaagaagcugcgcccccgguggcuggacgcccgcaccuacuccgacccccucgcccugcgggaguucaaggaguucgccgccggccgccggagcgucuccggggaccugauccucgagaucggcaagcugccgcagcaccugacccagcgcgcgcagaacgcccucgacaaccuggugaugcugcacaacagcgagcagggcgggcgggccuaccgccacgccauggaggagcuccccgacacgaucgagacccugaugcugcucgcgcugaucgccgugcugaccggcggggucacccucuucuuccuguccggccgggggcugggcaagaccagcaucggccuccugugcgugauggccuccagcgugcugcucuggauggccuccgucgagccccacuggaucgccgcgagcaucauccuggaguucuuccugauggugcuccugauccccgagccggaccgccagcggacgccccaggacaaccagcuggccuacguggucaucgggcuccuguucaugauccugaccguggccgccaacgagaugggccuccuggagaccaccaagaaggaccuggggaucggccacguggccgucgagaaccaccaccacgcggccaugcucgacguggaccugcaccccgccuccgccuggacgcuguacgccguggcgaccaccaucaucaccccgaugaugcgccacacgaucgagaacaccaccgccaacaucagccucaccgccaucgccaaccaggccgcgauccugauggggcuggacaagggcuggcccaucuccaagauggacaucggcgucccccuccuggcccuggggugcuacagccaggugaacccccucacgcugaccgccgccgugcugaugcucgucgcgcacuacgccaucaucggcccggggcugcaggccaaggccacccgcgaggcccagaagcggaccgcggccggcaucaugaagaaccccacgguggacgggaucguggccaucgaccuggaccccgucguguacgacgccaaguucgagaagcagcucggccagaucaugcugcugauccucugcaccucccagauccugcugaugcgcaccaccugggcccucugcgagagcaucacgcuggcgaccggcccccugaccacccucugggagggguccccgggcaaguucuggaacacgaccaucgccgugagcauggccaacaucuuccggggguccuaccuggccggcgccggccuggcguucagccucaugaagucccucgggggcgggcgccgggggaccggggcccagggcgagacccugggcgagaaguggaagcgccagcucaaccagcuguccaagagcgaguucaacacguacaagcgguccgggaucauggaggucgaccgcagcgaggccaaggagggccugaagcgcggggagaccaccaagcacgccgugucccgcggcaccgcgaagcuccggugguucguggagcgcaaccuggucaagcccgaggggaaggugaucgaccugggcugcggccgcgggggcuggagcuacuacugcgccgggcugaagaaggugacggaggucaagggcuacaccaagggcggccccggccacgaggagcccaucccgauggccaccuacggguggaaccucgugaagcugcacuccggcaaggacguguucuucaucccgcccgagaagugcgacacccugcucugcgacaucggggagagcucccccaacccgacgaucgaggagggccgcacccugcggguccugaagaugguggagcccuggcuccgcgggaaccaguucugcaucaagauccugaaccccuacaugcccagcguggucgagacccuggagcagaugcagcggaagcacggcggcaugcucgugcgcaacccgcugucccggaacagcacccacgagauguacuggguguccugcgggaccggcaacaucgucagcgccgugaacaugacgucccgcaugcugcucaaccgcuucaccauggcccaccggaagcccaccuacgagcgcgacguggaccugggggcgggcacccggcacgucgccguggagcccgagguggccaaccuggacaucaucggccagcgcaucgagaacaucaagcacgagcacaagagcacguggcacuacgacgaggacaaccccuacaagaccugggccuaccacggguccuacgaggucaagccgagcggcuccgccagcagcauggugaacggggucgugaagcuccugaccaagcccugggacgugauccccauggucacccagaucgcgaugacggacaccacccccuucggccagcagcggguguucaaggagaagguggacacccgcacgccgaaggccaagcgggggaccgcccagaucauggaggucaccgccaaguggcuguggggcuuccucucccgcaacaagaagccccggaucugcacccgcgaggaguucacgcggaaggugcgcagcaacgccgcgaucggcgccguguucgucgacgagaaccaguggaacuccgccaaggaggccguggaggacgagcgguucugggaccuggugcaccgcgagcgggagcugcacaagcaggggaagugcgcgaccugcgucuacaacaugaugggcaagcgcgagaagaagcucggggaguucggcaaggccaaggggagccgggccaucugguacauguggcugggcgcccgcuuccuggaguucgaggcccucggcuucaugaacgaggaccacugguucucccgggagaacagccuguccgggguggagggcgaggggcugcacaagcucggcuacauccugcgcgacaucagcaagauccccgggggcaacauguacgcggacgacaccgccggcugggacacccggaucacggaggacgaccugcagaacgaggcccgcaucaccgacaucauggagccggagcacgcccuccuggccaaguccaucuucaagcugaccuaccagaacaaggugguccgcgugcagcggcccgcgaagaacgggaccgugauggacgucaucagccgccgggaccagcgcggcuccggccagguggggacguacggccucaacaccuucaccaacauggaggcccagcugauccggcagauggagagcgaggggaucuucucccccagcgagcuggagacccccaaccucgccgagcgcgugcuggacuggcuggagaaguacggcgucgagcggcucaagcgcauggccaucuccggggacgacugcguggugaagccgaucgacgaccgguucgccacggcgcugaccgcccugaacgacaugggcaagguccgcaaggacaucccccagugggagcccagcaagggguggaacgacuggcagcagguccccuucugcucccaccacuuccaccagcucaucaugaaggacggccgggagaucguggucccgugccgcaaccaggacgagcuggugggccgggcccgcgugagccagggggccggcuggagccugcgggagaccgccugccucgggaaguccuacgcgcagauguggcagcugauguacuuccaccgccgggaccugcgccucgccgccaacgccaucugcagcgcgguccccguggacuggauccccaccucccggacgaccuggagcauccacgcccaccaccaguggaugaccaccgaggacaugcuguccguguggaaccgcgucuggaucgaggagaaccccuggauggaggacaagacgcacaucagcuccuggggcgacgugccguaccuggggaagcgcgaggaccaguggugcggcagccucaucggccugaccgcccgggccaccugggccaccaacauccagguggcgaucaaccagguccgccggcugaucgggaacgagaacuaccucgacuacaugaccuccaugaagcgcuucaagaacgagagcgaccccgagggcgcccugugguga

SEQ ID NO: 8474 - RNA, 9879 nt, Artificial Sequence
  derived and/or modified CDS sequence (opt1) from DENV-1__GQ199773__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgaguucugcgaggacacgaugaccuacaagugcccccgcaucaccgaggccgagcccgacgacguggacugcuggugcaacgccaccgacaccugggugaccuacgggaccugcagccagaccggcgagcaccggcgggacaagcgguccguggcccuggcgccccacgugggccucgggcuggagacgcgcaccgagaccuggaugagcuccgagggcgccuggaagcagauccagcggguggagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugcccgacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaagaccguccaguacgagaaccugaaguacagcgugaccgugacgguccacaccggcgaccagcaccagguggggaacgaguccaccgagcacggcaccaccgcgacgaucacgccccaggcccccagcaccgagauccagcugaccgacuacggggcccucacgcuggacugcagcccccggaccggccuggacuucaacgagaugguccuccugaccaugaaggagaaguccuggcuggugcacaagcagugguuccucgaccugccgcugcccuggaccagcggggccuccacgagccaggagaccuggaaccggaaggaccuccuggugaccuucaagaccgcccacgcgaagaagcaggaggucguggugcugggcucccaggagggcgccaugcacacggcccucaccggggccaccgagauccagaccagcggcacgaccaccaucuucgccgggcaccugaagugccgccugaagauggacaagcucacccugaagggcauguccuacgucaugugcacggggagcuucaagcuggagaaggagguggcggagacccagcacggcaccgugcucguccagaucaaguacgagggcaccgacgcccccugcaagauccccuucuccacgcaggacgagaagggggugacccagaacggccggcugaucaccgccaacccgaucgugaccgacaaggagaagcccgucaacaucgaggccgagccgcccuucggggagagcuacaucgugaucggcgcgggcgagaaggcccugaagcuguccugguucaagaaggggagcuccaucggcaagauguucgaggccacggcccgcggggcccggcgcauggcgauccucggcgacaccgccugggacuucgggagcaucggcggcguguucaccuccgucgggaagcuggugcaccagaucuucggcaccgccuacggggugcuguucagcggcgucuccuggacgaugaagaucgggaucggcgugcuccugaccuggcugggccucaacagccgcuccaccagccuguccaugaccugcaucgccguggggcuggucacgcucuaccugggcgugauggugcaggccgacagcgggugcgucaucaacuggaagggccgggagcugaagugcgggagcggcaucuucgugaccaacgaggugcacaccuggaccgagcaguacaaguuccaggcggacuccccgaagcgccucagcgccgccaucggcaaggccugggaggagggggucugcggcauccgguccgccacccgccuggagaacaucauguggaagcagaucagcaacgagcugaaccacauccuccuggagaacgacaugaaguucacggugguggucggggacguggcgggcauccuggcccaggggaagaagaugauccggccccagcccauggaguacaaguacuccuggaaguccuggggcaaggccaagaucaucggcgccgacgugcagaacaccaccuucaucaucgacgggcccaacaccccggagugccccgacgaccagcgcgcguggaacaucugggaggucgaggacuacggcuucgggaucuucacgaccaacaucuggcucaagcugcgggacuccuacacccaggugugcgaccaccgccugaugagcgccgccaucaaggacuccaaggccgugcacgccgacaugggcuacuggaucgagagcgagaagaacgagaccuggaagcucgcgcgggccuccuucaucgaggucaagacgugcaucuggcccaagagccacacccugugguccaacggcgugcuggagagcgagaugaucauccccaagaucuacgggggcccgaucucccagcacaacuaccgccccggguacuucacccagaccgccggccccuggcaccucgggaagcuggagcuggacuucgaccucugcgagggcacgaccguggucguggacgagcacugcggcaaccgggggccgagccugcgcaccaccacggugaccggcaagaucauccacgaguggugcugccgguccugcacccugccgccccugcgcuucaagggggaggacggcugcugguacgggauggagauccggcccgucaaggagaaggaggagaaccuggucaagagcauggugagcgccggcuccggcgaggucgacagcuucucccuggggcuccugugcaucagcaucaugaucgaggaggugaugcgcucccgguggagccgcaagaugcugaugaccggcacgcucgccguguucuuccugcugaucauggggcagcucaccuggaacgaccugauccggcugugcaucauggucggcgcgaacgccuccgaccgcauggggaugggcaccaccuaccucgcccugauggccacguucaagaugcgcccgauguucgccguggggcuccuguuccggcgccugaccagccgggaggugcugcuccugaccaucgggcugucccucgucgcgagcguggagcugcccaacucccuggaggagcucggcgacgggcuggccaugggcaucaugauccugaagcuccugaccgacuuccagagccaccagcugugggccacgcuccugucccugaccuucaucaagaccaccuucagccuccacuacgccuggaagacgauggcgaugguccuguccaucgugagccuguucccccucugccuguccaccaccagccagaagaccacguggcugcccgugcuccugggcucccuggggugcaagccgcucaccauguuccugaucgccgagaacaagaucuggggccgcaagagcuggccccugaacgaggggaucauggccgucggcaucgugagcauccuccuguccagccugcucaagaacgacgugccccuggccgggccccugaucgccggcggcaugcucaucgcgugcuacgucaucuccgggagcuccgccgaccugagccuggagaaggccgccgagguguccugggaggaggaggccgagcacagcggcgcgucccacaacauccucguggagguccaggacgacgggaccaugaagaucaaggacgaggagcgggacgacacccugaccauccugcucaaggccacgcugcuggccgugagcggcguguacccgcucuccauccccgccacccuguucgucugguacuucuggcagaagaagaagcagcgcagcggggugcugugggacacccccagcccgcccgagguggagcgggccguccucgacgacggcaucuaccgcaucaugcagcggggccugcuggggcgcagccaggugggcgugggggucuuccaggagaacguguuccacaccauguggcacgugacgcggggcgcgguccugauguaccaggggaagcgccucgagcccuccugggccagcgugaagaaggaccugaucuccuacggcggcggguggcggcugcagggcagcuggaacaccggggaggaggugcaggucaucgccguggagcccggcaagaaccccaagaacgugcagaccgcccccgggaccuucaagacguccgagggcgaggucggcgccaucgcgcucgacuucaagcccgggaccagcggcagccccaucgugaaccgcgaggggaagaucgugggccuguacggcaacggggucgugaccaccuccggcacguacgugagcgccaucgcccaggccaaggcgucccaggaggggccccugccggagaucgaggacgaggucuuccggaagcgcaaccucaccaucauggaccugcaccccggcagcgggaagacccggcgcuaccugcccgccaucgugcgggaggccaucaagcgcaagcuccggacccugauccuggccccgacgcgcguggucgccuccgagauggcggaggcccucaagggcaugcccauccgcuaccagaccaccgccgucaagagcgagcacaccggcaaggagaucguggaccugaugugccacgccacguucaccaugcggcugcucucccccguccgcgugcccaacuacaacaugaucaucauggacgaggcccacuucaccgacccgagcuccaucgcggcccggggguacaucagcacccgcgugggcaugggggaggccgccgccaucuucaugacggcgacgccgcccggcuccgucgaggccuucccccagagcaacgccgugauccaggacgaggagcgggacaucccggagcgcuccuggaacagcggguacgaguggaucaccgacuuccccggcaagaccgugugguucguccccuccaucaagagcggcaacgacaucgccaacugccugcggaagaacgggaagcgcgugauccagcugucccggaagacguucgacaccgaguaccagaagaccaagaacaacgacugggacuacguggucaccacggacaucagcgagaugggcgcgaacuuccgcgccgaccgggugaucgacccccgccggugccucaagccggugauccugaaggacgggcccgagcgcgucauccuggccggccccaugcccgugaccgucgccuccgccgcgcagcggcgcgggcggaucggccgcaaccacaacaaggagggcgaccaguacaucuacauggggcagccgcucaacaacgacgaggaccacgcccacuggaccgaggccaagaugcugcuggacaacaucaacacccccgagggcaucauccccgcccucuucgagcccgagcgggagaaguccgccgcgaucgacggggaguaccgccugcgcggcgaggcccggaagacguucguggagcugaugcgccgcggggaccucccgguguggcugagcuacaaggucgccuccgagggcuuccaguacagcgaccgccgguggugcuucgacggcgagcgcaacaaccaggugcuggaggagaacauggacguggagaucuggaccaaggagggggagcggaagaagcuccgcccccgguggcuggacgcccgcaccuacuccgacccccuggcccuccgggaguucaaggaguucgcggccggccgccggagcgucuccggggaccugauccuggagaucggcaagcucccccagcaccugacccagcgcgcccagaacgcccuggacaaccucgugaugcugcacaacagcgagcagggcgggcgggcguaccgccacgccauggaggagcugccggacacgaucgagacccucaugcugcuggcccucaucgccgugcugaccggcggggucacccuguucuuccucuccggccgggggcugggcaagaccagcaucggccugcucugcgugauggccuccagcgugcugcuguggauggcguccgucgagccccacuggaucgccgccagcaucauccucgaguucuuccugauggugcugcucauccccgagcccgaccgccagcggacgccgcaggacaaccagcuggccuacguggucaucgggcuccucuucaugauccugaccguggccgcgaacgagaugggccugcucgagaccaccaagaaggaccuggggaucggccacguggccgucgagaaccaccaccacgccgccaugcuggacguggaccuccaccccgccuccgcguggacgcuguacgccguggccaccaccaucaucacccccaugaugcgccacacgaucgagaacaccaccgccaacaucagccugaccgccaucgcgaaccaggccgccauccucauggggcuggacaagggcuggccgaucuccaagauggacaucggcgucccccugcucgcccuggggugcuacagccaggugaacccccugacgcucaccgcggccgugcugaugcuggucgcccacuacgccaucaucggccccgggcuccaggccaaggcgacccgggaggcccagaagcgcaccgccgccggcaucaugaagaacccgacgguggacgggaucguggccaucgaccuggaccccgucguguacgacgcgaaguucgagaagcagcugggccagaucaugcuccugauccugugcaccucccagauccuccugaugcgcaccaccugggcccugugcgagagcaucacgcucgccaccggcccccugaccacccugugggaggggucccccggcaaguucuggaacacgaccaucgccgugagcauggccaacaucuuccgggggagcuaccucgcgggcgccggccuggccuucucccugaugaagucccucgggggcgggcgccggggcaccggggcccagggcgagacccugggcgagaaguggaagcgccagcugaaccagcucuccaagagcgaguucaacacguacaagcgguccgggaucauggaggucgaccgcagcgaggcgaaggagggccugaagcgcggggagaccaccaagcacgccgugucccgcggcaccgccaagcugcggugguucguggagcgcaaccucgucaagccggaggggaaggugaucgaccugggcugcggccgcggcggguggagcuacuacugcgccgggcugaagaaggugacggaggucaagggguacaccaagggcgggcccggccacgaggagcccauccccauggccaccuacggguggaaccuggugaagcuccacuccggcaaggacguguucuucaucccgcccgagaagugcgacacccugcugugcgacaucggggagagcucccccaaccccacgaucgaggagggccgcacccuccggguccugaagaugguggagccguggcugcgcgggaaccaguucugcaucaagauccucaaccccuacaugcccagcguggucgagacccuggagcagaugcagcggaagcacggcggcaugcuggugcgcaacccccucucccggaacagcacccacgagauguacuggguguccugcgggaccggcaacaucgucagcgcggugaacaugacgucccgcaugcugcugaaccgguucaccauggcccaccgcaagccgaccuacgagcgcgacguggaccucggggccggcacccggcacgucgccguggagcccgagguggccaaccuggacaucaucggccagcgcaucgagaacaucaagcacgagcacaagagcacguggcacuacgacgaggacaaccccuacaagaccugggcguaccacggguccuacgaggucaagcccagcggcagcgccuccagcauggugaacggggucgugaagcugcucaccaagccgugggacgugauccccauggucacccagaucgccaugacggacaccacccccuucggccagcagcggguguucaaggagaagguggacacccgcacgcccaaggccaagcgggggaccgcccagaucauggaggucaccgcgaaguggcuguggggcuuccugucccgcaacaagaagccgcggaucugcacccgcgaggaguucacgcggaaggugcgcagcaacgccgccaucggcgccguguucgucgacgagaaccaguggaacuccgcgaaggaggccguggaggacgagcgguucuggaaccucgugcaccgcgagcgggagcugcacaagcaggggaagugcgcgaccugcgucuacaacaugaugggcaagcgcgagaagaagcugggggaguucggcaaggccaaggggagccgggccaucugguacauguggcucggcgcgcgcuuccuggaguucgaggcccugggcuucaugaacgaggaccacugguucucccgggagaacagccucuccgggguggagggcgaggggcugcacaagcugggcuacauccuccgcgacaucagcaagauccccgggggcaacauguacgccgacgacaccgccggcugggacacccggaucacggaggacgaccugcagaacgaggccaagaucaccgacaucauggagcccgagcacgcgcugcucgccaaguccaucuucaagcugaccuaccagaacaaggugguccgcgugcagcggccggccaagaacgggaccgugauggacgucaucagccgccgcgaccagcggggcuccggccaggugggcacguacggccugaacaccuucaccaacauggaggcccagcucauccgccagauggagagcgaggggaucuucucccccagcgagcuggagacccccaaccuggccggccgggugcucgacuggcuggagaagcacggggucgagcgccugaagcggauggcgaucuccggcgacgacugcguggugaagcccaucgacgaccgcuucgccacggcccucaccgcccugaacgacauggggaagguccggaaggacaucccgcagugggagcccagcaagggcuggaacgacuggcagcagguccccuucugcagccaccacuuccaccagcugaucaugaaggacggccgcgagaucgugguccccugccggaaccaggacgagcucguggggcgcgcccgggugucccagggcgcgggguggagccugcgcgagaccgccugccugggcaaguccuacgcccagauguggcagcucauguacuuccaccggcgcgaccugcggcuggccgcgaacgccaucugcagcgccgucccgguggacugggugcccaccucccgcacgaccuggagcauccacgcccaccaccaguggaugaccaccgaggacaugcucuccgucuggaaccggguguggaucgaggagaaccccuggauggaggacaagacgcacaucagcuccuggggcgacgugcccuaccugggcaagcgcgaggaccaguggugcggcagccugaucgggcucaccgcccgggcgaccugggccaccaacauccaggucgccaucaaccaggugcgccgccugaucggcaacgagaacuaccuggacuacaugaccuccaugaagcgguucaagaacgagagcgacccggagggggcccucugguga

SEQ ID NO: 8475 - RNA, 9879 nt, Artificial Sequence
  derived and/or modified CDS sequence (opt1) from DENV-1__JF937596__SS-prME
agcgugaccaugcugcucaugcugaugcccaccgcccuggccuuccaccucaccacccggggcggggagccccacaugaucgugaccaagcaggagcggggcaagagccugcuguucaagaccagcgcgggggugaacaugugcacccucaucgccauggaccugggcgagcugugcgaggacaccaugaccuacaagugcccccggaucaccgaggccgagcccgacgacguggacugcuggugcaacgccacggacaccugggugaccuacgggaccugcagccagacgggcgagcaccggcgcgacaagcggagcguggcccucgcgccccacgugggccuggggcuggagacccgcaccgagaccuggauguccagcgagggcgccuggaagcagauccagcgggucgagacgugggcccuccgccaccccggguucaccgugaucgcccuguuccuggcgcacgccaucggcaccuccaucacccagaaggggaucaucuucauccuccugaugcuggugacgcccagcauggccaugcggugcgucggcaucggcucccgcgacuucguggaggggcucagcggcgccaccuggguggacgucgugcuggagcacggguccugcgugaccaccauggccaaggacaagcccacgcuggacaucgagcuccugaagaccgaggucaccaaccccgcggugcugcggaagcucugcaucgaggccaagaucagcaacaccacgaccgacucccgcugccccacccagggcgaggccacccugauggaggagcaggacgccaacuucgugugccggcgcacguucgucgaccggggcugggggaacggcugcgggcuguucggcaaggggagccucaucacgugcgccaaguucaagugcgugaccaagcuggagggcaagaucgugcaguacgagaaccugaaguacuccgucaucgugaccgugcacacgggcgaccagcaccaggucgggaacgagagcaccgagcacggcaccaccgcgaccaucacgccccaggcccccaccuccgagauccagcucaccgacuacggggcccugacccuggacugcagcccccgcacgggccucgacuucaacgagauggugcugcugaccaugaaggagaaguccuggcucguccacaagcagugguuccuggaccugccgcuccccuggaccagcggggccagcaccucccaggagacguggaaccggcaggaccugcuggugaccuucaagaccgcccacgcgaagaagcaggagguggucgugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgugaugugcaccggguccuucaagcucgagaaggaggucgcggagacgcagcacggcaccgugcuggugcagaucaaguacgagggcaccgacgcccccugcaagauccccuucagcacccaggacgagaagggggucauccagaacggccggcugaucacggccaacccgaucgugaccgacaaggagaagcccgugaacaucgaggccgagccgcccuucggggaguccuacaucgucaucggcgugggcgagaaggcgcugaagcucagcugguucaagaagggguccagcaucggcaagauguucgaggccaccgcccgcggggcccggcgcauggccauccugggcgacaccgcgugggacuucggguccaucggcggcguguucacgagcgucgggaagcuggugcaccagaucuucggcaccgccuacgggguccuguucuccggcgucagcuggaccaugaagaucgggaucggcgugcugcugaccuggcucggccugaacucccgcagcacgucccugagcaugaccugcaucgccguggggcucgucacccuguaccugggcgugauggugcaggccgacuccgggugcgucaucaacuggaagggccgggagcucaagugcgggagcggcaucuucgugaccaacgaggugcacacguggaccgagcaguacaaguuccaggccgacagcccgaagcgccuguccgcggccaucggcaaggccugggaggagggggucugcggcauccggagcgccacccgccuggagaacaucauguggaagcagaucuccaacgagcucaaccacauccugcuggagaacgacaugaaguucaccgugguggucggggacguggugggcauccucgcccaggggaagaagaugauccggccccagcccauggagcacaaguacagcuggaaguccuggggcaaggcgaagaucaucggcgccgacguccagaacaccacguucaucaucgacgggcccaacaccccggagugccccgacgaccagcgcgccuggaacaucugggagguggaggacuacggcuucgggaucuucaccaccaacaucuggcugaagcugcgggacagcuacacgcaggccugcgaccaccgccucauguccgcggccaucaaggacagcaaggccgugcacgccgacaugggcuacuggaucgaguccgagaagaacgagaccuggaagcuggcccgggcgagcuucaucgaggucaagaccugcaucuggcccaagucccacacccuguggagcaacggcgugcucgaguccgagauggugauccccaagaucuacgggggcccgaucagccagcacaacuaccgccccggguacuucacgcagaccgccggccccuggcaccuggggaagcuggagcucgacuucgaccugugcgagggcaccaccgucgugguggacgagcacugcggcaaccgggggccgucccugcgcacgaccaccgucaccggcaagaucauccacgaguggugcugccggagcugcacgcugccgccccuccgcuucaagggggaggacggcugcugguacgggauggagauccggcccgugaaggagaaggaggagaaccuggugaaguccauggucagcgccggcagcggcgagguggacuccuucagccucgggcugcugugcaucuccaucaugaucgaggaggugaugcgcagccgguggucccgcaagaugcucaugaccggcacccuggccgucuuccugcuccugaucauggggcagcugaccuggaacgaccucauccggcugugcaucauggugggcgccaacgcgagcgaccgcauggggaugggcacgaccuaccuggcccucauggccaccuucaagaugcgcccgauguucgccguggggcugcuguuccggcgccucaccucccgggagguccugcugcucacgaucgggcugagccugguggccuccgucgagcuccccaacagccuggaggagcugggcgacgggcucgccaugggcaucaugauccugaagcugcucaccgacuuccagucccaccagcugugggccacccugcucagccugaccuucaucaagacgacccugucccuccacuacgccuggaagaccauggccauggugcugagcaucgugucccuguucccccucugccugagcaccacgucccagaagaccaccuggcugcccguccuccugggcagccuggggugcaagccgcucaccauguuccugaucgcggagaacaagaucuggggccgcaaguccuggccccugaacgaggggaucauggccgugggcguggucagcauccuccugagcucccugcucaagaacgacgugccccuggccgggccccugaucgccggcggcaugcucaucgccugcuacgugaucagcggguccagcgcggaccugucccuggagaaggccgccgaggucagcugggaggaggaggccgagcacuccggcgccagccacaacauccucguggaggugcaggacgacgggacgaugaagaucaaggacgaggagcgggacgacacccugaccauccugcucaaggcgacccugcuggccgucuccggcguguacccgcucagcauccccgccacccuguucgugugguacuucuggcagaagaagaagcagcgcuccgggguccugugggacacgcccagcccgcccgagguggagcgggccgugcuggacgacggcaucuaccgcaucaugcagcggggccuccuggggcgcucccaggucggcguggggguguuccaggagaacgucuuccacaccauguggcacgugacccggggcgccgugcugauguaccaggggaagcgccucgagcccagcugggcguccgucaagaaggaccugaucagcuacggcggcggguggcggcugcagggcuccuggaacaccggggaggagguccaggugaucgccgucgagcccggcaagaaccccaagaacgugcagacggcccccgggaccuucaagacccccgagggcgaggugggcgccaucgcccucgacuucaagcccgggaccagcggcucccccaucgucaaccgcgaggggaagaucgugggccuguacggcaacgggguggucacgaccagcggcaccuacgugagcgcgaucgcccagaccaaggccucccaggaggggccgcugcccgagaucgaggacgagguguuccggaagcgcaaccucacgaucauggaccugcaccccggcagcgggaagacccggcgcuaccugccggccaucguccgggaggcgaucaagcgcaagcuccggacccugauccuggcccccacccgcgugguggccuccgagauggccgaggcccucaagggcaugcccauccgcuaccagacgaccgcggucaagagcgagcacaccggcaaggagaucguggaccugaugugccacgccaccuucacgaugcggcugcucucccccgugcgcgucccgaacuacaacaugaucaucauggacgaggcccacuucaccgaccccagcuccaucgccgcccggggguacaucagcacccgcgugggcaugggggaggcggccgccaucuucaugaccgccacgccgcccggcuccguggaggccuucccgcagagcaacgcggucauccaggacgaggagcgggacauccccgagcgcuccuggaacagcgggcacgaguggaucaccgacuuccccggcaagaccgugugguucgugcccuccaucaagagcggcaacgacaucgccaacugccugcggaagaacgggaagcgcgucauccagcugucccggaagaccuucgacacggaguaccagaagaccaagaacaacgacugggacuacguggugaccaccgacaucagcgagaugggcgccaacuuccgcgccgaccgggucaucgacccgcgccggugccucaagcccgugauccugaaggacgggcccgagcgcgucauccuggcgggccccaugccggugacgguggccuccgccgcccagcggcgcgggcggaucggccgcaaccacaacaaggagggcgaccaguacaucuacauggggcagccccucaacaacgacgaggaccacgcccacuggaccgaggcgaagaugcugcuggacaacaucaacacccccgagggcaucauccccgcccucuucgagccggagcgggagaaguccgccgccaucgacggggaguaccgccugcgcggcgaggcccggaagaccuucgucgagcugaugcgccgcggggaccuccccguguggcuguccuacaagguggcgagcgagggcuuccaguacagcgaccgccgguggugcuucgacggcgagcgcaacaaccagguccuggaggagaacauggacguggagaucuggacgaaggagggggagcggaagaagcuccgcccccgguggcuggacgcccgcaccuacuccgacccccuggcccuccgggaguucaaggaguucgccgccggccgccggagcguguccggggaccugauccuggagaucggcaagcucccgcagcaccugacccagcgcgcgcagaacgcccuggacaaccucgucaugcugcacaacagcgagcagggcgggcgggccuaccgccacgccauggaggagcugcccgacaccaucgagacgcucaugcugcuggcgcucaucgccgugcugaccggcggggugacccuguucuuccucuccggccgggggcugggcaagaccagcaucggccugcucugcgucauggccuccagcgugcugcuguggauggccuccguggagccccacuggaucgccgcgagcaucauccucgaguucuuccugaugguccugcucauccccgagccggaccgccagcggacgccccaggacaaccagcuggccuacguggugaucgggcuccucuucaugauccugacggucgccgccaacgagaugggccugcucgagaccaccaagaaggaccuggggaucggccacguggccguggagaaccaccaccacgcgaccaugcuggacgucgaccuccaccccgccuccgccuggacgcuguacgccguggccaccaccaucaucaccccgaugaugcgccacacgaucgagaacaccaccgcgaacaucagccugaccgccaucgccaaccaggccgccauccucauggggcuggacaagggcuggcccaucuccaagauggacaucggcgugccccugcucgcgcuggggugcuacagccaggucaacccccugacgcucaccgccgccgugcugaugcugguggcccacuacgcgaucaucggcccggggcuccaggccaaggccacccgggaggcccagaagcgcaccgccgcgggcaucaugaagaaccccacggucgacgggaucguggccaucgaccuggaccccguggucuacgacgccaaguucgagaagcagcugggccagaucaugcuccugauccugugcaccucccagauccuccugaugcgcaccaccugggcccugugcgagagcaucacgcucgccaccggcccccugaccacccugugggagggguccccgggcaaguucuggaacacgaccaucgcggugagcauggccaacaucuuccggggguccuaccucgccggcgccggccuggccuucagccugaugaagucccucgggggcgggcgccggggcaccggggcgcagggcgagacccugggcgagaaguggaagcgccagcugaaccagcucuccaagagcgaguucaacaucuacaagcgguccgggaucauggagguggaccgcagcgaggccaaggagggccugaagcgcggggagacgacccgccacgccgucucccggggcaccgccaagcugcgcugguucguggagcggaaccuggugaagcccgaggggaaggucaucgaccucggcugcggccgcgggggcuggagcuacuacugcgcggggcugaagaaggugaccgaggugaagggcuacacgaagggcgggcccggccacgaggagcccaucccgauggccaccuacggguggaaccuggucaagcuccacuccggcaaggacguguucuucgcgccgcccgagaagugcgacacccugcugugcgacaucggggagagcucccccaacccgaccaucgaggagggccggacgcuccgcgugcugaagauggucgagcccuggcugcgggggaaccaguucugcaucaagauccucaaccccuacaugcccagcgugguggagacccuggagcagaugcagcgcaagcacggcggcaugcugguccggaacccgcucucccgcaacagcacccacgagauguacuggguguccugcgggaccggcaacaucgugagcgccgucaacaugaccucccggaugcugcugaaccgcuucacgauggcccaccgcaagcccaccuacgagcgggacguggaccucggggcgggcacccgccacguggccgucgagcccgagguggccaaccuggacaucaucggccagcggaucgagaacaucaagcacgagcacaagagcaccuggcacuacgacgaggacaaccccuacaagacgugggccuaccacggguccuacgaggucaagccgagcggcuccgccagcagcauggugaacgggguggucaagcugcucaccaagcccugggacgugauccccauggugacccagaucgcgaugaccgacacgacccccuucggccagcagcgcgucuucaaggagaagguggacacccggaccccgaaggccaagcgcgggacggcccagaucauggaggugaccgcccgguggcuguggggcuuccugucccgcaacaagaagccccggaucugcacccgcgaggaguucacccggaagguccgcagcaacgccgcgaucggcgccguguucguggacgagaaccaguggaacuccgccaaggaggccgucgaggacgagcgguucugggaccucgugcagaaggagcgcgagcugcacaagcaggggaagugcgcgacgugcguguacaacaugaugggcaagcgggagaagaagcugggggaguucggcaaggccaaggggagccgcgccaucugguacauguggcucggcgcccgguuccuggaguucgaggcccugggcuucaugaacgaggaccacugguucucccgcgagaacagccucuccggggucgagggcgaggggcugcacaagcugggcuacauccuccgggacaucagcaagauccccgggggcaacauguacgcggacgacaccgccggcugggacacccgcaucaccgaggacgaccugcagaacgaggccaagaucacggacaucauggagccggagcacgcccugcucgccaccuccaucuucaagcugaccuaccagaacaagguggugcggguccagcgccccgcgaagaacgggaccgugauggacgugaucagccgccgggaccagcgcggcuccgggcaggucggcacguacggccugaacaccuucaccaacauggaggcccagcucauccggcagauggagagcgaggggaucuuccugcccuccgagcuggagacccccaaccucgccgagcgcgugcuggacuggcuggagaagcacggcguggagcggcucaagcgcauggccaucagcggggacgacugcgucgugaagccgaucgacgaccgguucgccacggcgcugaccgcccugaacgacaugggcaaggugcgcaaggacaucccccagugggagcccuccaagggguggaacgacuggcagcagguccccuucugcagccaccacuuccaccagcucaucaugaaggacggccgggagaucguggugccgugccgcaaccaggacgagcuggucggccgggcccgcgugucccagggggccggcuggagccugcgggagaccgccugccucggcaagagcuacgcgcagauguggcagcugauguacuuccaccgccgggaccugcgccucgccgccaacgccaucugcuccgcggugcccgucgacugggugcccaccagccggacgaccugguccauccacgcccaccaccaguggaugaccaccgaggacaugcugagcguguggaaccgcgucuggaucgaggagaaccccuggauggaggacaagacgcacguguccagcuggggcgacgugccguaccuggggaagcgggaggaccaguggugcggcucccucaucggccugaccgcccgcgccaccugggccagcaacauccaggucgcgaucaaccaggugcgccggcugaucgggaacgagaacuaccucgacuacaugaccuccaugaagcgcuucaagaacgagggcgaccccgagggggcccugugguga

SEQ ID NO: 8476 - RNA, 9879 nt, Artificial Sequence
  derived and/or modified CDS sequence (opt1) from DENV-1__FJ898380__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgagaccgagcccgacgacguggacugcuggugcaacgccacggacaccugggugaccuacgggaccugcagccagacgggcgagcaccggcgcgacaagcgguccguggcccucgcgccccacgugggccuggggcuggagacccggaccgagaccuggaugagcuccgagggcgcguggaagcagauccagcgggucgagacgugggcccuccgccaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagguggccgagacccagcacggcaccgugcugguccagaucaaguacgagggcaccgacgcgcccugcaagauccccuucagcacgcaggacgagaagggggugacccagaacggccggcugaucaccgccaacccgaucgugaccgacaaggagaagcccgucaacaucgaggccgagccgcccuucggggaguccuacaucgugaucggcgccggcgagaaggcgcugaagcucagcugguucaagaagggguccagcaucggcaagauguucgaggccacggcccgcggggcccggcgcauggccauccugggcgacaccgcgugggacuucggguccaucggcggcguguucaccagcgucgggaagcuggugcaccagaucuucggcaccgccuacggggugcuguucuccggcgucagcuggacgaugaagaucgggaucggcgugcugcugaccuggcucggccugaacucccgcagcaccucccugagcaugaccugcaucgccguggggcucgucacgcuguaccugggcgugauggugcaggccgacuccgggugcgucaucaacuggaagggccgggagcucaagugcgggagcggcaucuucgugaccaacgaggugcacaccuggaccgagcaguacaaguuccaggccgacagcccgaagcgccuguccgcggccaucggcaaggccugggaggagggggucugcggcauccggagcgccacccgccuggagaacaucauguggaagcagaucuccaacgagcucaaccacauccugcuggagaacgacaugaaguucacggugguggucggggacguggccggcauccucgcgcaggggaagaagaugauccggccccagcccauggaguacaaguacagcuggaaguccuggggcaaggccaagaucaucggcgccgacgugcagaacaccaccuucaucaucgacgggcccaacaccccggagugccccgacgaccagcgcgccuggaacaucugggaggucgaggacuacggcuucgggaucuucacgaccaacaucuggcugaagcugcgggacagcuacacccaggugugcgaccaccgccucauguccgcggccaucaaggacagcaaggccgugcacgccgacaugggcuacuggaucgaguccgagaagaacgagaccuggaagcuggcccgggcgagcuucaucgaggucaagacgugcaucuggcccaagucccacacccuguggagcaacggcgugcucgaguccgagaugaucauccccaagaucuacgggggcccgaucagccagcacaacuaccgccccggguacuucacccaggccgccggccccuggcaccuggggaagcuggagcucgacuucgaccugugcgagggcaccacgguggucguggacgagcacugcggcaaccgggggccgucccugcgcaccaccaccgugacgggcaagaucauccacgaguggugcugccggagcugcacccugccgccccuccgcuucaagggggaggacggcugcugguacgggauggagauccggcccgucaaggagaaggaggagaaccuggugaaguccauggugagcgccggcagcggcgaggucgacuccuucagccucgggcugcugugcaucuccaucaugaucgaggaggugaugcgcagccgguggucccgccggaugcucaugaccggcacccuggccguguucuuccugcucaucauggggcagcugacguggaacgaccugauccgccucugcaucauggucggcgcgaacgccagcgaccgcauggggaugggcaccaccuaccuggcccugauggccaccuucaagaugcggccgauguucgccgugggccuccuguuccgccggcugacgucccgcgaggugcuccugcugaccaucgggcucagccuggucgcguccguggagcugcccaacagccucgaggagcugggcgacgggcuggccaugggcaucaugauccucaagcugcugaccgacuuccagucccaccagcucugggccacccugcugagccucacguucaucaagaccaccuucucccugcacuacgccuggaagaccauggcgaugguccugagcaucgugucccucuucccccugugccugagcacgaccucccagaagaccaccuggcuccccgugcugcugggcagccucgggugcaagccgcugacgauguuccugaucgccgagaacaagaucuggggccggcgcuccuggccccucaacgaggggaucauggccgucggcaucgugagcauccugcugagcucccuccugaagaacgacgugccccuggccgggccccucaucgccggcggcaugcugaucgcgugcuacgucaucagcggguccagcgccgaccugucccucgagaaggccgccgaggugagcugggaggaggaggccgagcacuccggcgcgagccacaacauccugguggagguccaggacgacgggaccaugaagaucaaggacgaggagcgggacgacacccugaccauccuccugaaggccacccugcucgccguguccggcguguacccgcugagcauccccgccacgcuguucgucugguacuucuggcagaagaagaagcagcgcuccggggugcucugggacacccccagcccgcccgagguggagcgggccguccuggacgacggcaucuaccgcaucaugcagcggggccugcuggggcgcucccaggugggcgugggggucuuccaggagaacguguuccacaccauguggcacgugacccggggcgcgguccucauguaccaggggaagcgccuggagcccagcugggccuccgugaagaaggaccugaucagcuacggcggcggguggcggcuccagggcuccuggaacacgggggaggaggugcaggucaucgccguggagcccggcaagaaccccaagaacgugcagaccgcccccgggaccuucaagacccccgagggcgaggucggcgccaucgcgcuggacuucaagcccgggacgagcggcucccccaucgugaaccgcgaggggaagaucgugggccuguacggcaacggggucgugaccaccagcggcaccuacgugagcgccaucgcccaggccaaggcgucccaggaggggccgcuccccgagaucgaggacgaggucuuccggaagcgcaaccugacgaucauggaccugcaccccggcagcgggaagacccggcgcuaccucccggccaucgugcgggaggccaucaagcgcaagcugcgcacccugauccucgcccccacccggguggucgccuccgagauggcggaggcccugaagggcaugcccauccgcuaccagacgaccgccgucaagagcgagcacaccggcaaggagaucguggaccugaugugccacgccaccuucacgaugcggcuccugucccccguccgcgugccgaacuacaacaugaucaucauggacgaggcccacuucaccgaccccagcuccaucgcggcccggggguacaucagcacccgcgugggcaugggggaggccgccgccaucuucaugaccgcgacgccgcccggcuccgucgaggccuucccgcagagcaacgccgugauccaggacgaggagcgggacauccccgagcgcuccuggaacagcggguacgaguggaucaccgacuuccccggcaagaccgugugguucguccccuccaucaagagcggcaacgacaucgccaacugccugcggaagaacgggaagcgcgugauccagcucucccggaagaccuucgacacggaguaccagaagaccaagaacaacgacugggacuacguggucaccaccgacaucagcgagaugggcgcgaacuuccgcgccgaccgggugaucgacccgcgccggugccugaagcccgugauccugaaggacgggcccgagcgcgucauccucgccggccccaugccggugacggucgccuccgccgcgcagcggcgcgggcggaucggccgcaaccacaacaaggagggcgaccaguacaucuacauggggcagccccugaacaacgacgaggaccacgcccacuggaccgaggccaagaugcugcucgacaacaucaacacccccgagggcaucauccccgcccuguucgagccggagcgcgagaaguccgccgcgaucgacggggaguaccggcugcgcggcgaggcccggaagaccuucguggagcucaugcgccgcggggaccugcccguguggcuguccuacaaggucgccagcgagggcuuccaguacagcgaccgccgguggugcuucgacggcgagcgcaacaaccaggugcucgaggagaacauggacguggagaucuggacgaaggagggggagcggaagaagcugcgcccccgguggcuggacgcccgcaccuacuccgacccccucgcccugcgggaguucaaggaguucgcggccggccgccggagcgucuccggggaccugauccucgagaucggcaagcugccgcagcaccugacccagcgcgcccagaacgcccucgacaaccuggugaugcugcacaacagcgagcagggcgggcgggcguaccgccacgccauggaggagcuccccgacaccaucgagacgcugaugcugcucgcccugaucgccgugcugaccggcggggucacccucuucuuccuguccggccgggggcugggcaagaccagcaucggccuccugugcgugauggccuccagcgugcugcucuggauggcguccgucgagccccacuggaucgccgccagcaucauccuggaguucuuccugauggugcuccugauccccgagccggaccgccagcggacgccccaggacaaccagcuggccuacguggucaucgggcuccuguucaugauccugacgguggccgcgaacgagaugggccuccuggagaccaccaagaaggaccuggggaucggccacguggccgucgagaaccaccaccacgccgccaugcucgacguggaccugcaccccgccuccgcguggacccuguacgccguggccacgaccaucaucaccccgaugaugcgccacaccaucgagaacacgaccgccaacaucagccucaccgccaucgcgaaccaggccgccauccugauggggcuggacaagggcuggcccaucuccaagauggacaucggcgucccccuccuggcccuggggugcuacagccaggugaacccccucacccugacggcggccgugcugaugcucgucgcccacuacgccaucaucggcccggggcugcaggccaaggcgacccgcgaggcccagaagcggaccgccgccggcaucaugaagaaccccaccguggacgggaucguggccaucgaccuggaccccgucguguacgacgcgaaguucgagaagcagcucggccagaucaugcugcugauccucugcacgucccagauccugcugaugcgcaccaccugggcccucugcgagagcaucacccuggccacgggcccccugaccacccucugggagggguccccgggcaaguucuggaacaccacgaucgccgugagcauggccaacaucuuccggggguccuaccuggcgggcgccggccuggccuucagccucaugaagucccucgggggcgggcgccgggggaccggggcccagggcgagacccugggcgagaaguggaagcgccagcucaaccagcuguccaagagcgaguucaacaccuacaagcgguccgggaucauggaggucgaccgcagcgaggcgaaggagggccugaagcgcggggagacgaccaagcacgccgugucccgcggcaccgccaagcuccggugguucguggagcgcaaccuggucaagcccgaggggaaggugaucgaccugggcugcggccgcggcggguggagcuacuacugcgccgggcugaagaaggugaccgaggucaagggguacacgaagggcggccccggccacgaggagcccaucccgauggccaccuacggguggaaccucgugaagcugcacuccggcaaggacguguucuucaucccgcccgagaagugcgacacccugcucugcgacaucggggagagcucccccaacccgaccaucgaggagggccgcacgcugcggguccugaagaugguggagcccuggcuccgcgggaaccaguucugcaucaagauccugaaccccuacaugcccagcguggucgagacccuggagcagaugcagcggaagcacggcggcaugcucgugcgcaacccgcugucccggaacagcacccacgagauguacuggguguccugcgggaccggcaacaucgucagcgcggugaacaugaccucccgcaugcugcucaaccgcuucacgauggcccaccggaagcccaccuacgagcgcgacguggaccugggggccggcacccggcacgucgccguggagcccgagguggccaaccuggacaucaucggccagcgcaucgagaacaucaagcacgagcacaagagcaccuggcacuacgacgaggacaaccccuacaagacgugggcguaccacggguccuacgaggucaagccgagcggcuccgccagcagcauggugaacggggucgugaagcuccugaccaagcccugggacgugauccccauggucacccagaucgccaugaccgacacgacccccuucggccagcagcggguguucaaggagaagguggacacccgcaccccgaaggccaagcgggggacggcccagaucauggaggucaccgcgaaguggcuguggggcuuccucucccgcaacaagaagccccggaucugcacccgcgaggaguucacccggaaggugcgcagcaacgccgccaucggcgccguguucgucgacgagaaccaguggaacuccgcgaaggaggccguggaggacgagcgguucugggaccuggugcaccgcgagcgggagcugcacaagcaggggaagugcgccacgugcgucuacaacaugaugggcaagcgcgagaagaagcucggggaguucggcaaggccaaggggagccgggccaucugguacauguggcugggcgcgcgcuuccuggaguucgaggcccucggcuucaugaacgaggaccacugguucucccgggagaacagccuguccgggguggagggcgaggggcugcacaagcucggcuacauccugcgcgacaucagcaagauccccgggggcaacauguacgccgacgacaccgccggcugggacacccggaucaccgaggacgaccugcagaacgaggcccgcaucacggacaucauggagccggagcacgcgcuccuggccaaguccaucuucaagcugaccuaccagaacaaggugguccgcgugcagcggcccgccaagaacgggaccgugauggacgucaucagccgccgggaccagcgcggcuccggccaggugggcaccuacggccucaacacguucaccaacauggaggcccagcugauccggcagauggagagcgaggggaucuucucccccagcgagcuggagacccccaaccucgccgagcgcgugcuggacuggcuggagaaguacggcgucgagcggcucaagcgcauggcgaucuccggggacgacugcguggugaagccgaucgacgaccgguucgccaccgcccugacggcccugaacgacaugggcaagguccgcaaggacaucccccagugggagcccagcaagggguggaacgacuggcagcagguccccuucugcucccaccacuuccaccagcucaucaugaaggacggccgggagaucguggucccgugccgcaaccaggacgagcuggugggccgggcccgcgugagccagggggcgggcuggagccugcgggagaccgccugccucgggaaguccuacgcccagauguggcagcugauguacuuccaccgccgggaccugcgccucgccgcgaacgccaucugcagcgccguccccguggacuggauccccaccucccggaccacguggagcauccacgcccaccaccaguggaugaccaccgaggacaugcuguccguguggaaccgcgucuggaucgaggagaaccccuggauggaggacaagacccacaucagcuccuggggcgacgugccguaccuggggaagcgcgaggaccaguggugcggcagccucaucggccugacggcccgggcgaccugggccaccaacauccagguggccaucaaccagguccgccggcugaucgggaacgagaacuaccucgacuacaugaccuccaugaagcgcuucaagaacgagagcgaccccgagggcgcccugugguga

SEQ ID NO: 8477 - RNA, 9879 nt, Artificial Sequence
  derived and/or modified CDS sequence (opt1) from DENV-1__FJ898382__SS-prME
agcgugaccaugcugcucaugcugaugcccaccgcccuggccuuccaccucaccacccggggcggggagccccacaugaucgugagcaagcaggagcggggcaagagccugcuguucaagaccuccgccggggugaacaugugcacccucaucgccauggaccugggcgagcugugcgaggacaccaugaccuacaagugcccccgcaucaccgagaccgagcccgacgacguggacugcuggugcaacgccacggacaccugggugaccuacgggaccugcagccagacgggcgagcaccggcgcgacaagcgguccguggcccucgcgccccacgugggccuggggcuggagacccgcaccgagaccuggaugagcuccgagggcgcguggaagcagauccagcggguggagacgugggcccuccgccaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagguggccgagacccagcacggcaccgugcugguccagaucaaguacgagggcaccgacgcgcccugcaagauccccuucagcacgcaggacgagaagggggugacccagaacggccggcugaucaccgccaacccgaucgugaccgacaaggagaagcccgucaacaucgaggccgagccgcccuucggggaguccuacaucgugaucggcgccggcgagaaggcgcugaagcucagcugguucaagaagggguccagcaucggcaagauguucgaggccacggcccgcggggcccggcgcauggccauccugggcgacaccgcgugggacuucggguccaucggcggcguguucaccagcgucgggaagcuggugcaccagaucuucggcaccgccuacgggguccucuucuccggcgucagcuggacgaugaagaucgggaucggcgugcugcugaccuggcucggccugaacucccgcagcaccucccugagcaugaccugcaucgccguggggcucgucacgcuguaccugggcgugauggugcaggccgacuccgggugcgucaucaacuggaagggccgggagcucaagugcgggagcggcaucuucgugaccaacgaggugcacaccuggaccgagcaguacaaguuccaggccgacagcccgaagcgccuguccgcggccaucggcaaggccugggaggagggggucugcggcauccggagcgccacccgccuggagaacaucauguggaagcagaucuccaacgagcucaaccacauccugcuggagaacgacaugaaguucacggugguggucggggacguggccggcauccucgcgcaggggaagaagaugauccggccccagcccauggaguacaaguacagcuggaaguccuggggcaaggccaagaucaucggcgccgacgugcagaacaccaccuucaucaucgacgggcccaacaccccggagugccccgacgaccagcgcgccuggaacaucugggaggucgaggacuacggcuucgggaucuucacgaccaacaucuggcugaagcugcgggacagcuacacccaggugugcgaccaccgccucauguccgcggccaucaaggacagcaaggccgugcacgccgacaugggcuacuggaucgaguccgagaagaacgagaccuggaagcuggcccgggcgagcuucaucgaggucaagacgugcaucuggcccaagucccacacccuguggagcaacggcgugcucgaguccgagaugaucauccccaagaucuacgggggcccgaucagccagcacaacuaccgccccggguacuucacccaggccgccggccccuggcaccuggggaagcuggagcucgacuucgaccugugcgagggcaccacgguggucguggacgagcacugcggcaaccgggggccgucccugcgcaccaccaccgugacgggcaagaucauccacgaguggugcugccggagcugcacccugccgccccuccgcuuccgcggggaggacggcugcugguacgggauggagauccgccccgucaaggagaaggaggagaaccuggugaaguccauggugagcgccggcagcggcgaggucgacuccuucagccucgggcugcugugcaucuccaucaugaucgaggaggugaugcggagccgcuggucccggcgcaugcucaugaccggcacccuggccguguucuuccugcucaucauggggcagcugacguggaacgaccugauccgccucugcaucauggucggcgcgaacgccagcgaccggauggggaugggcaccaccuaccuggcccugauggccaccuucaagaugcgcccgauguucgccguggggcuccuguuccggcgccugacgucccgggaggugcuccugcugaccaucgggcucagccuggucgcguccguggagcugcccaacagccucgaggagcugggcgacgggcuggccaugggcaucaugauccucaagcugcugaccgacuuccagucccaccagcucugggccacccugcugagccucacguucaucaagaccaccuucucccugcacuacgccuggaagaccauggcgaugguccugagcaucgugucccucuucccccugugccugagcacgaccucccagaagaccaccuggcuccccgugcugcugggcagccucgggugcaagccgcugacgauguuccugaucgccgagaacaagaucuggggccgccgguccuggccccucaacgaggggaucauggccgucggcaucgugagcauccugcugagcucccuccugaagaacgacgugccccuggccgggccccucaucgccggcggcaugcugaucgcgugcuacgucaucagcggguccagcgccgaccugucccucgagaaggccgccgaggugagcugggaggaggaggccgagcacuccggcgcgagccacaacauccugguggagguccaggacgacgggaccaugaagaucaaggacgaggagcgcgacgacacccugaccauccuccugaaggccacccugcucgccguguccggcguguacccgcugagcauccccgccacgcuguucgucugguacuucuggcagaagaagaagcagcgguccggggugcucugggacacccccagcccgcccgagguggagcgcgccguccuggacgacggcaucuaccggaucaugcagcgcggccugcuggggcggucccaggugggcgugggggucuuccaggagaacguguuccacaccauguggcacgugacccgcggcgcgguccucauguaccaggggaagcggcuggagcccagcugggccuccgugaagaaggaccugaucagcuacggcggcggguggcgccuccagggcuccuggaacacgggggaggaggugcaggucaucgccguggagcccggcaagaaccccaagaacgugcagaccgcccccgggaccuucaagacccccgagggcgaggucggcgccaucgcgcuggacuucaagcccgggacgagcggcucccccaucgugaaccgggaggggaagaucgugggccuguacggcaacggggucgugaccaccagcggcaccuacgugagcgccaucgcccaggccaaggcgucccaggaggggccgcuccccgagaucgaggacgaggucuuccgcaagcggaaccugacgaucauggaccugcaccccggcagcgggaagacccgccgguaccucccggccaucgugcgcgaggccaucaagcgcaagcugcggacccugauccucgcccccacccgcguggucgccuccgagauggcggaggcccugaagggcaugcccauccgguaccagacgaccgccgucaagagcgagcacaccggcaaggagaucguggaccugaugugccacgccaccuucacgaugcgccuccugucccccguccgggugccgaacuacaacaugaucaucauggacgaggcccacuucaccgaccccuucagcaucgcggcccgcggguacaucuccacccgggugggcaugggggaggccgccgccaucuucaugaccgcgacgccgcccggcagcgucgaggccuucccgcaguccaacgccgugauccaggacgaggagcgcgacauccccgagcggagcuggaacuccggguacgaguggaucaccgacuuccccggcaagaccgugugguucguccccagcaucaaguccggcaacgacaucgccaacugccugcgcaagaacgggaagcgggugauccagcucagccgcaagaccuucgacacggaguaccagaagaccaagaacaacgacugggacuacguggucaccaccgacaucuccgagaugggcgcgaacuuccgggccgaccgcgugaucgacccgcggcgcugccugaagcccgugauccugaaggacgggcccgagcgggucauccucgccggccccaugccggugacggucgccagcgccgcgcagcgccgggggcgcaucggccgcaaccacaacaaggagggcgaccaguacaucuacauggggcagccccugaacaacgacgaggaccacgcccacuggaccgaggccaagaugcugcucgacaacaucaacacccccgagggcaucauccccgcccuguucgagccggagcgggagaaguccgccgcgaucgacggggaguaccgccugcggggcgaggcccgcaagaccuucguggagcucaugcggcgcggggaccugcccguguggcugagcuacaaggucgccuccgagggcuuccaguacagcgaccggcgcuggugcuucgacggcgagcggaacaaccaggugcucgaggagaacauggacguggagaucuggacgaaggagggggagcgcaagaagcugcggccccgcuggcuggacgcccggaccuacagcgacccccucgcccugcgcgaguucaaggaguucgcggccggccggcgcuccgucagcuccgaccugauccucgagaucgggaagcugccgcagcaccugacccagcgggcccagaacgcccucgacaaccuggugaugcugcacaacagcgagcagggcggccgcgcguaccggcacgccauggaggagcuccccgacaccaucgagacgcugaugcugcucgcccugaucgccgugcugaccgggggcgucacccucuucuuccuguccgggcgcggccuggggaagaccagcaucggccuccugugcgugauggccuccagcgugcugcucuggauggcguccgucgagccccacuggaucgccgccagcaucauccuggaguucuuccugauggugcuccugauccccgagccggaccggcagcgcacgccccaggacaaccagcuggccuacguggucaucggccuccuguucaugauccugacgguggccgcgaacgagauggggcuccuggagaccaccaagaaggaccugggcaucgggcacguggccgucgagaaccaccaccacgccgccaugcucgacguggaccugcaccccgccuccgcguggacccuguacgccguggccacgaccaucaucaccccgaugaugcgccacaccaucgagaacacgaccgccaacaucagccucaccgccaucgcgaaccaggccgccauccugaugggccuggacaagggguggcccaucuccaagauggacaucggcgucccccuccuggcccugggcugcuacagccaggugaacccccucacccugacggcggccgugcugaugcucgucgcccacuacgccaucaucgggccgggccugcaggccaaggcgacccgggaggcccagaagcgcaccgccgccgggaucaugaagaaccccaccguggacggcaucguggccaucgaccuggaccccgucguguacgacgcgaaguucgagaagcagcucgggcagaucaugcugcugauccucugcacgucccagauccugcugaugcggaccaccugggcccucugcgagagcaucacccuggccacgggcccccugaccacccucugggagggcuccccggggaaguucuggaacaccacgaucgccgugagcauggccaacaucuuccgcggcuccuaccuggcgggggccggccuggccuucagccucaugaagucccugggcgggggccggcgcgggaccggcgcccagggggagacccugggcgagaaguggaagcggcagcucaaccagcuguccaagagcgaguucaacaccuacaagcgcuccggcaucauggaggucgaccggagcgaggcgaaggaggggcugaagcgcggcgagacgaccaagcacgccgugucccgggggaccgccaagcuccgcugguucguggagcggaaccuggucaagcccgagggcaaggugaucgaccuggggugcggccgcggcggguggagcuacuacugcgccggccugaagaaggugaccgaggucaagggguacacgaagggcgggcccggccacgaggagcccaucccgauggccaccuacggcuggaaccucgugaagcugcacuccgggaaggacguguucuucaucccgcccgagaagugcgacacccugcucugcgacaucggcgagagcucccccaacccgaccaucgaggaggggcggacgcugcgcguccugaagaugguggagcccuggcuccggggcaaccaguucugcaucaagauccugaaccccuacaugcccagcguggucgagacccuggagcagaugcagcgcaagcacgggggcaugcucgugcggaacccgcugucccgcaacagcacccacgagauguacuggguguccugcggcaccgggaacaucgucagcgcggugaacaugaccucccgcaugcugcucaaccgguucacgauggcccaccgcaagcccaccuacgagcgggacguggaccugggcgccgggacccgccacgucgccguggagcccgagguggccaaccuggacaucaucggccagcggaucgagaacaucaagcacgagcacaagagcaccuggcacuacgacgaggacaaccccuacaagacgugggcguaccacggcuccuacgaggucaagccgagcggguccgccagcagcauggugaacggcgucgugaagcuccugaccaagcccugggacgugauccccauggucacccagaucgccaugaccgacacgacccccuucgggcagcagcgcguguucaaggagaagguggacacccggaccccgaaggccaagcgcggcacggcccagaucauggaggucaccgcgaaguggcuguggggguuccucucccggaacaagaagccccgcaucugcacccgggaggaguucacccgcaaggugcggagcaacgccgccaucggcgccguguucgucgacgagaaccaguggaacuccgcgaaggaggccguggaggacgagcgcuucugggaccuggugcaccgggagcgcgagcugcacaagcagggcaagugcgccacgugcgucuacaacaugauggggaagcgggagaagaagcucggcgaguucgggaaggccaagggcagccgcgccaucugguacauguggcugggggcgcgguuccuggaguucgaggcccucggcuucaugaacgaggaccacugguucucccgcgagaacagccuguccggcguggagggggagggccugcacaagcucggguacauccugcgggacaucagcaagauccccggcgggaacauguacgccgacgacaccgccggcugggacacccgcaucaccgaggacgaccugcagaacgaggcccgcaucacggacaucauggagccggagcacgcgcuccuggccaaguccaucuucaagcugaccuaccagaacaaggugguccgggugcagcgccccgccaagaacggcaccgugauggacgucaucagccggcgcgaccagcggggguccggccagguggggaccuacggccucaacacguucaccaacauggaggcccagcugauccgccagauggagagcgagggcaucuucucccccagcgagcuggagacccccaaccucgccgagcgggugcuggacuggcuggagaaguacggggucgagcgccucaagcggauggcgaucuccggcgacgacugcguggugaagccgaucgacgaccgcuucgccaccgcccugacggcccugaacgacauggggaagguccggaaggacaucccccagugggagcccagcaagggcuggaacgacuggcagcagguccccuucugcucccaccacuuccaccagcucaucaugaaggacgggcgcgagaucguggucccgugccggaaccaggacgagcuggugggccgcgcccgggugagccagggcgcgggguggagccugcgcgagaccgccugccucggcaaguccuacgcccagauguggcagcugauguacuuccaccggcgcgaccugcggcucgccgcgaacgccaucugcagcgccguccccguggacuggauccccaccucccgcaccacguggagcauccacgcccaccaccaguggaugaccaccgaggacaugcuguccguguggaaccgcgucuggaucgaggagaaccccuggauggaggacaagacccacaucagcuccuggggcgacgugccguaccugggcaagcgggaggaccaguggugcgggagccucaucggccugacggcccgcgcgaccugggccaccaacauccagguggccaucaaccagguccggcgccugaucggcaacgagaacuaccucgacuacaugaccuccaugaagcgguucaagaacgagagcgaccccgagggggcccugugguga

SEQ ID NO: 8478 - RNA, 9879 nt, Artificial Sequence
  derived and/or modified CDS sequence (opt1) from DENV-1__FJ898383__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccgcaucaccgagaccgagcccgacgacguggacugcuggugcaacgccacggacaccugggucaccuacgggaccugcagccagacgggcgagcaccggcgcgacaagcgguccguggcccucgcgccccacgugggccuggggcuggagacccgcaccgagaccuggaugagcuccgagggcgcguggaagcagauccagcgggucgagacgugggcccuccgccaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagguggccgagacccagcacggcaccgugcugguccagaucaaguacgagggcaccgacgcgcccugcaagauccccuucagcacgcaggacgagaagggggugacccagaacggccggcugaucaccgccaacccgaucgugaccgacaaggagaagcccaucaacaucgaggccgagccgcccuucggggaguccuacaucgucaucggcgccggcgagaaggcgcugaagcucagcugguucaagaagggguccagcaucggcaagauguucgaggccacggcccgcggggcccggcgcauggccauccugggcgacaccgcgugggacuucggguccaucggcggcguguucaccagcguggggaagcugguccaccagaucuucggcaccgccuacggggugcuguucuccggcgugagcuggacgaugaagaucgggaucggcguccugcugaccuggcucggccugaacucccgcagcaccucccugagcaugaccugcaucgccguggggcucgugacgcuguaccugggcgucauggugcaggccgacuccgggugcgugaucaacuggaagggccgggagcucaagugcgggagcggcaucuucgucaccaacgaggugcacaccuggaccgagcaguacaaguuccaggccgacagcccgaagcgccuguccgcggccaucggcaaggccugggaggagggggugugcggcauccggagcgccacccgccuggagaacaucauguggaagcagaucuccaacgagcucaaccacauccugcuggagaacgacaugaaguucacggucguggugggggacgucgccggcauccucgcgcaggggaagaagaugauccggccccagcccauggaguacaaguacagcuggaaguccuggggcaaggccaagaucaucggcgccgacgugcagaacaccaccuucaucaucgacgggcccaacaccccggagugccccgacgaccagcgcgccuggaacaucugggagguggaggacuacggcuucgggaucuucacgaccaacaucuggcugaagcugcgggacagcuacacccaggucugcgaccaccgccucauguccgcggccaucaaggacagcaaggccgugcacgccgacaugggcuacuggaucgaguccgagaagaacgagaccuggaagcuggcccgggcgagcuucaucgaggugaagacgugcaucuggcccaagucccacacccuguggagcaacggcguccucgaguccgagaugaucauccccaagaucuacgggggcccgaucagccagcacaacuaccgccccggguacuucacccaggccgccggccccuggcaccuggggaagcuggagcucgacuucgaccugugcgagggcaccacggugguggucgacgagcacugcggcaaccgggggccgucccugcgcaccaccaccgugacgggcaagaucauccacgaguggugcugccggagcugcacccugccgccccuccgcuuccgcggggaggacggcugcugguacgggauggagauccgccccgugaaggagaaggaggagaaccuggucaaguccauggugagcgccggcagcggcgagguggacuccuucagccucgggcugcugugcaucuccaucaugaucgaggaggucaugcggagccgcuggucccggcgcaugcucaugaccggcacccuggccguguucuuccugcucaucauggggcagcugacguggaacgaccugauccgccucugcaucauggugggcgcgaacgccagcgaccggauggggaugggcaccaccuaccuggcccugauggccaccuucaagaugcgcccgauguucgccgucggccuccuguuccggcgccugacgucccgggaggugcuccugcugaccaucgggcucagccugguggcguccgucgagcugcccaacagccucgaggagcugggcgacgggcuggccaugggcaucaugauccucaagcugcugaccgacuuccagucccaccagcucugggccacccugcugagccucacguucaucaagaccaccuucucccugcacuacgccuggaagaccauggcgauggugcugagcaucgucucccucuucccccugugccugagcacgaccucccagaagaccaccuggcuccccgugcugcugggcagccucgggugcaagccgcugacgauguuccugaucgccgagaacaagaucuggggccgccgguccuggccccucaacgaggggaucauggccgugggcaucgucagcauccugcugagcucccuccugaagaacgacgugccccuggccgggccccucaucgccggcggcaugcugaucgcgugcuacgugaucagcggguccagcgccgaccugucccucgagaaggccgccgaggucagcugggaggaggaggccgagcacuccggcgcgagccacaacauccugguggaggugcaggacgacgggaccaugaagaucaaggacgaggagcgcgacgacacccugaccauccuccugaaggccacccugcucgccgucuccggcguguacccgcugagcauccccgccacgcuguucgugugguacuucuggcagaagaagaagcagcgguccgggguccucugggacacccccagcccgcccgagguggagcgcgccgugcuggacgacggcaucuaccggaucaugcagcgcggccugcuggggcggucccaggucggcguggggguguuccaggagaacgucuuccacaccauguggcacgugacccgcggcgcggugcucauguaccaggggaagcggcuggagcccagcugggccuccgucaagaaggaccugaucagcuacggcggcggguggcgccuccagggcuccuggaacacgggggaggagguccaggugaucgccgucgagcccggcaagaaccccaagaacgugcagaccgcccccgggaccuucaagacccccgagggcgaggugggcgccaucgcgcuggacuucaagcccgggacgagcggcucccccaucgucaaccgggaggggaagaucgugggccuguacggcaacgggguggucaccaccagcggcaccuacgugagcgccaucgcccaggccaaggcgucccaggaggggccgcuccccgagaucgaggacgagguguuccgcaagcggaaccugacgaucauggaccugcaccccggcagcgggaagacccgccgguaccucccggccaucguccgcgaggccaucaagcgcaagcugcggacccugauccucgcccccacccgcgugguggccuccgagauggcggaggcccugaagggcaugcccauccgguaccagacgaccgccgucaagagcgagcacaccggcaaggagaucguggaccugaugugccacgccaccuucacgaugcgccuccugucccccgugcgggucccgaacuacaacaugaucaucauggacgaggcccacuucaccgaccccagcuccaucgcggcccgcggguacaucagcacccgggugggcaugggggaggccgccgccaucuucaugaccgcgacgccgcccggcuccguggaggccuucccgcagagcaacgccgucauccaggacgaggagcgcgacauccccgagcgguccuggaacagcggguacgaguggaucaccgacuuccccggcaagaccgugugguucgugcccuccaucaagagcggcaacgacaucgccaacugccugcgcaagaacgggaagcgggucauccagcucucccgcaagaccuucgacacggaguaccagaagaccaagaacaacgacugggacuacguggugaccaccgacaucagcgagaugggcgcgaacuuccgggccgaccgcgucaucgacccgcggcgcugccugaagcccgugauccugaaggacgggcccgagcgggugauccucgccggccccaugccggucacgguggccuccgccgcgcagcgccgggggcgcaucggccgcaaccacaacaaggagggcgaccaguacaucuacauggggcagccccugaacaacgacgaggaccacgcccacuggaccgaggccaagaugcugcucgacaacaucaacacccccgagggcaucauccccgcccuguucgagccggagcgggagaaguccgccgcgaucgacggggaguaccgccugcggggcgaggcccgcaagaccuucgucgagcucaugcggcgcggggaccugcccguguggcuguccuacaagguggccagcgagggcuuccaguacagcgaccggcgcuggugcuucgacggcgagcggaacaaccagguccucgaggagaacauggacguggagaucuggacgaaggagggggagcgcaagaagcugcggccccgcuggcuggacgcccggaccuacuccgacccccucgcccugcgcgaguucaaggaguucgcggccggccggcgcagcguguccggggaccugauccucgagaucggcaagcugccgcagcaccugacccagcgggcccagaacgcccucgacaaccuggucaugcugcacaacagcgagcagggcgggcgcgcguaccggcacgccauggaggagcuccccgacaccaucgagacgcugaugcugcucgcccugaucgccgugcugaccggcggggugacccucuucuuccuguccggccgcgggcugggcaagaccagcaucggccuccugugcgucauggccuccagcgugcugcucuggauggcguccguggagccccacuggaucgccgccagcaucauccuggaguucuuccugaugguccuccugauccccgagccggaccggcagcgcacgccccaggacaaccagcuggccuacguggugaucgggcuccuguucaugauccugacggucgccgcgaacgagaugggccuccuggagaccaccaagaaggaccuggggaucggccacguggccguggagaaccaccaccacgccgccaugcucgacgucgaccugcaccccgccuccgcguggacccuguacgccguggccacgaccaucaucaccccgaugaugcgccacaccaucgagaacacgaccgccaacaucagccucaccgccaucgcgaaccaggccgccauccugauggggcuggacaagggcuggcccaucuccaagauggacaucggcgugccccuccuggcccuggggugcuacagccaggucaacccccucacccugacggcggccgugcugaugcucguggcccacuacgccaucaucggcccggggcugcaggccaaggcgacccgggaggcccagaagcgcaccgccgccggcaucaugaagaaccccaccgucgacgggaucguggccaucgaccuggaccccguggucuacgacgcgaaguucgagaagcagcucggccagaucaugcugcugauccucugcacgucccagauccugcugaugcggaccaccugggcccucugcgagagcaucacccuggccacgggcccccugaccacccucugggagggguccccgggcaaguucuggaacaccacgaucgccgugagcauggccaacaucuuccgcggguccuaccuggcgggcgccggccuggccuucagccucaugaagucccucgggggcgggcggcgcgggaccggggcccagggcgagacccugggcgagaaguggaagcggcagcucaaccagcuguccaagagcgaguucaacaccuacaagcgcuccgggaucauggagguggaccggagcgaggcgaaggagggccugaagcgcggggagacgaccaagcacgccgucucccggggcaccgccaagcuccgcugguucguggagcggaaccuggugaagcccgaggggaaggucaucgaccugggcugcggccgcgggggcuggagcuacuacugcgccgggcugaagaaggugaccgaggugaagggcuacacgaagggcggccccggccacgaggagcccaucccgauggccaccuacggguggaaccucgucaagcugcacuccggcaaggacguguucuucaucccgcccgagaagugcgacacccugcucugcgacaucggggagagcucccccaacccgaccaucgaggagggccggacgcugcgcgugcugaagauggucgagcccuggcuccgggggaaccaguucugcaucaagauccugaaccccuacaugcccagcgugguggagacccuggagcagaugcagcgcaagcacggcggcaugcucguccggaacccgcugucccgcaacagcacccacgagauguacuggguguccugcgggaccggcaacaucgugagcgcggucaacaugaccucccgcaugcugcucaaccgguucacgauggcccaccgcaagcccaccuacgagcgggacguggaccugggggccggcacccgccacguggccgucgagcccgagguggccaaccuggacaucaucggccagcggaucgagaacaucaagcacgagcacaagagcaccuggcacuacgacgaggacaaccccuacaagacgugggcguaccacggguccuacgaggugaagccgagcggcuccgccagcagcauggucaacgggguggucaagcuccugaccaagcccugggacgugauccccauggugacccagaucgccaugaccgacacgacccccuucggccagcagcgcgucuucaaggagaagguggacacccggaccccgaaggccaagcgcgggacggcccagaucauggaggugaccgcgaaguggcuguggggcuuccucucccggaacaagaagccccgcaucugcacccgggaggaguucacccgcaagguccggagcaacgccgccaucggcgccguguucguggacgagaaccaguggaacuccgcgaaggaggccgucgaggacgagcgcuucugggaccuggugcaccgggagcgcgagcugcacaagcaggggaagugcgccacgugcguguacaacaugaugggcaagcgggagaagaagcucggggaguucggcaaggccaaggggagccgcgccaucugguacauguggcugggcgcgcgguuccuggaguucgaggcccucggcuucaugaacgaggaccacugguucucccgcgagaacagccuguccggggucgagggcgaggggcugcacaagcucggcuacauccugcgggacaucagcaagauccccgggggcaacauguacgccgacgacaccgccggcugggacacccgcaucaccgaggacgaccugcagaacgaggcccgcaucacggacaucauggagccggagcacgcgcuccuggccaaguccaucuucaagcugaccuaccagaacaagguggugcggguccagcgccccgccaagaacgggaccgugauggacgugaucagccggcgcgaccagcggggcuccgggcaggucggcaccuacggccucaacacguucaccaacauggaggcccagcugauccgccagauggagagcgaggggaucuucucccccagcgagcuggagacccccaaccucgccgagcgggugcuggacuggcuggagaaguacggcguggagcgccucaagcggauggcgaucuccggggacgacugcgucgugaagccgaucgacgaccgcuucgccaccgcccugacggcccugaacgacaugggcaaggugcggaaggacaucccccagugggagcccagcaagggguggaacgacuggcagcagguccccuucugcucccaccacuuccaccagcucaucaugaaggacggccgcgagaucguggugccgugccggaaccaggacgagcuggucggccgcgcccgggugagccagggggcgggcuggagccugcgcgagaccgccugccucgggaaguccuacgcccagauguggcagcugauguacuuccaccggcgcgaccugcggcucgccgcgaacgccaucugcagcgccgugcccgucgacuggauccccaccucccgcaccacguggagcauccacgcccaccaccaguggaugaccaccgaggacaugcuguccguguggaaccgcguguggaucgaggagaaccccuggauggaggacaagacccacaucagcuccuggggcgacgucccguaccuggggaagcgggaggaccaguggugcggcagccucaucggccugacggcccgcgcgaccugggccaccaacauccagguggccaucaaccaggugcggcgccugaucgggaacgagaacuaccucgacuacaugaccuccaugaagcgguucaagaacgagagcgaccccgagggcgcccugugguga

SEQ ID NO: 8479 - RNA, 9879 nt, Artificial Sequence
  derived and/or modified CDS sequence (opt1) from DENV-1__FJ898384__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggggaguucugcgaggacacgaugaccuacaagugcccccggaucaccgaggccgagcccgacgacguggacugcuggugcaacgccaccgacaccugggugaccuacgggaccugcagccagaccggggagcaccggcgggacaagcgguccguggcccuggcgccccacgugggccucgggcuggagacgcgcaccgagaccuggaugagcuccgagggcgccuggaagcagauccagcggguggagaccugggcccugcgccaccccggguucacggugaucgccaucuuccucgcgcacgccaucggcaccagcaucacccagaaggggaucaucuucauccugcugaugcucgugacccccuccauggccaugcggugcgucggcaucggcagccgcgacuucguggaggggcuguccggcgccacguggguggacgucgugcuggagcacgggagcugcgugaccaccauggccaaggacaagcccacccucgacaucgagcugcugaagacggaggucaccaaccccgcggugcuccggaagcugugcaucgaggccaagaucuccaacaccaccacggacagccgcugcccgacccagggcgaggccacccugguggaggagcaggacgccaacuucgucugccggcgcaccuucguggaccggggcugggggaacggcugcggccuguucggcaaggggucccugaucacgugcgccaaguucaagugcgugaccaagcuggagggcaagaucguccaguacgagaaccucaaguacagcgugaucgugaccguccacaccggcgaccagcaccagguggggaacgaguccacggagcacggcaccaccgcgaccaucacgccccaggcccccagcacggagauccagcugaccgacuacggggcccugacccucgacugcagcccccggaccggccuggacuucaacgagaugguccugcucacgaugaaggagaaguccuggcuggugcacaagcagugguuccuggaccucccgcugcccuggaccagcggggccuccaccagccaggagaccuggaaccggcaggaccugcucgugacguucaagaccgcccacgcgaagaagcaggaggucguggugcugggcucccaggagggcgccaugcacaccgcccugaccggggccacggagauccagaccagcggcaccaccacgaucuucgccgggcaccucaagugccgccugaagauggacaagcugacccucaagggcauguccuacgucaugugcaccgggagcuucaagcuggagaaggagguggcggagacccagcacggcacggugcugguccagaucaaguacgagggcaccgacgcccccugcaagauccccuucuccacccaggacgagaagggggugacccagaacggccggcucaucacggccaacccgaucgugaccgacaaggagaagcccgucaacaucgaggccgagccgcccuucggggagagcuacaucgugaucggcgcgggcgagaaggcccugaagcuguccugguucaagaaggggagcuccaucggcaagauguucgaggccaccgcccgcggggcccggcgcauggcgauccugggcgacaccgccugggacuucgggagcaucggcggcguguucacguccgucgggaagcucgugcaccagaucuucggcaccgccuacggggugcuguucagcggcgucuccuggaccaugaagaucgggaucggcgugcugcucaccuggcugggccugaacagccgcuccacgagccucuccaugaccugcaucgccguggggcuggucacccuguaccucggcgugauggugcaggccgacagcgggugcgucaucaacuggaagggccgggagcugaagugcgggagcggcaucuucgugaccaacgaggugcacacguggaccgagcaguacaaguuccaggcggacuccccgaagcgccugagcgccgccaucggcaaggccugggaggagggggucugcggcauccgguccgccacccgccucgagaacaucauguggaagcagaucagcaacgagcugaaccacauccugcucgagaacgacaugaagcugaccgugguggucggggacguggcgggcauccuggcccaggggaagaagaugauccggccccagcccauggaguacaaguacuccuggaaguccuggggcaaggccaagaucaucggcgccgacgugcagaacaccacguucaucaucgacgggcccaacaccccggagugccccgacgaccagcgcgcguggaacaucugggaggucgaggacuacggcuucgggaucuucaccaccaacaucuggcucaagcugcgggacuccuacacccaggugugcgaccaccgccugaugagcgccgccaucaaggacuccaaggccgugcacgccgacaugggcuacuggaucgagagcgagaagaacgagacguggaagcucgcgcgggccuccuucaucgaggucaagaccugcaucuggcccaagagccacacccugugguccaacggcgugcuggagagcgagaugaucauccccaagaucuacgggggcccgaucucccagcacaacuaccgccccggguacuucacgcagaccgccggccccuggcaccucgggaagcuggagcuggacuucgaccucugcgagggcaccaccguggucguggacgagcacugcggcaaccgggggccgagccugcgcacgaccaccgugaccggcaagaucauccacgaguggugcugccgguccugcacgcugccgccccugcgcuucaagggggaggacggcugcugguacgggauggagauccggcccgucaaggagaaggaggagaaccuggucaagagcauggugagcgccggcuccggcgaggucgacagcuucucccuggggcuccugugcaucagcaucaugaucgaggaggugaugcgcucccgguggagccgcaagaugcugaugaccggcacccucgccguguucuuccugcugaucauggggcagcucaccuggaacgaccugauccggcugugcaucauggucggcgcgaacgccuccgaccgcauggggaugggcacgaccuaccucgcccugauggccaccuucaagaugcgcccgauguucgccgugggccuccucuuccggcgccugaccagccgggaggugcugcuccugacgaucgggcugucccucgucgcgagcguggagcugcccaacucccuggaggagcucggcgacgggcuggccaugggcaucaugauccugaagcuccugaccgacuuccagagccaccagcugugggccacccuccugucccugaccuucauccgcacgaccuucagccuccacuacgccuggaagaccauggcgaugguccuguccaucgugagccuguucccccucugccuguccaccacgagccagaagaccaccuggcugcccgugcuccugggcucccuggggugcaagccgcucaccauguuccugaucgccgagaacaagaucuggggccgcaagagcuggccccugaacgaggggaucauggccgucggcaucgugagcauccuccuguccagccugcucaagaacgacgugccccuggccgggccccugaucgccggcggcaugcucaucgcgugcuacgucaucuccgggagcuccgccgaccugagccuggagaaggccgccgagguguccugggaggaggaggccgagcacagcggcgcgucccacaacauccucguggagguccaggacgacgggacgaugaagaucaaggacgaggagcgcgacgacacccugaccauccugcucaaggccacccugcuggccgugagcggcguguacccgcucuccauccccgccacccuguucgucugguacuucuggcagaagaagaagcagcggagcggggugcugugggacacgcccagcccgcccgagguggagcgcgccguccucgacgacggcaucuaccggaucaugcagcgcggccugcuggggcggagccaggugggcgugggggucuuccaggagaacguguuccacaccauguggcacgugacccgcggcgcgguccugauguaccaggggaagcggcucgagcccuccugggccagcgugaagaaggaccugaucuccuacggcggcggguggcgccugcagggcagcuggaacaccggggaggaggugcaggucaucgccguggagcccggcaagaaccccaagaacgugcagacggcccccgggaccuucaagaccuccgagggcgaggucggcgccaucgcgcucgacuucaagcccgggaccagcggcagccccaucgugaaccgggaggggaagaucgugggccuguacggcaacggggucgugacgaccuccggcaccuacgugagcgccaucgcccaggccaaggcgucccaggaggggccccugccggagaucgaggacgaggucuuccgcaagcggaaccucaccaucauggaccugcaccccggcagcgggaagacgcgccgguaccugcccgccaucgugcgcgaggccaucaagcggcgccuccgcacccugauccuggccccgacccggguggucgccuccgagauggcggaggcccucaagggcaugcccauccgcuaccagaccacggccgucaagagcgagcacaccggcaaggagaucguggaccugaugugccacgccaccuucaccaugcggcugcucucccccguccgcgugcccaacuacaacaugaucaucauggacgaggcccacuucacggacccgagcuccaucgcggcccggggguacaucagcacccgcgugggcaugggggaggccgccgccaucuucaugaccgcgacgccgcccggcuccgucgaggccuucccccagagcaacgccgugauccaggacgaggagcgggacaucccggagcgcuccuggaacagcggguacgaguggaucacggacuuccccggcaagaccgugugguucguccccuccaucaagagcggcaacgacaucgccaacugccugcggaagaacgggaagcgcgugauccagcugucccggaagaccuucgacaccgaguaccagaagacgaagaacaacgacugggacuacguggucaccaccgacaucagcgagaugggcgcgaacuuccgcgccgaccgggugaucgacccccgccggugccucaagccggugauccugaaggacgggcccgagcgcgucauccuggccggccccaugcccgugaccgucgccuccgccgcgcagcggcgcgggcggaucggccgcaaccacaacaaggagggcgaccaguacaucuacauggggcagccgcucaacaacgacgaggaccacgcccacuggacggaggccaagaugcugcuggacaacaucaacacccccgagggcaucauccccgcccucuucgagcccgagcgcgagaaguccgccgcgaucgacggggaguaccggcugcgcggcgaggcccggaagaccuucguggagcugaugcgccgcggggaccucccgguguggcugagcuacaaggucgccuccgagggcuuccaguacagcgaccgccgguggugcuucgacggcgagcgcaacaaccaggugcuggaggagaacauggacguggagaucuggaccaaggagggggagcggaagaagcuccgcccccgguggcuggacgcccgcacguacuccgacccccuggcccuccgggaguucaaggaguucgcggccggccgccggagcgucuccggggaccugauccuggagaucggcaagcucccccagcaccugacccagcgcgcccagaacgcccuggacaaccucgugaugcugcacaacagcgagcagggcgggcgggcguaccgccacgccauggaggagcugccggacaccaucgagacccucaugcugcuggcccucaucgccgugcugacgggcggggucacccuguucuuccucuccggccgggggcugggcaagaccagcaucggccugcucugcgugauggccuccagcgugcugcuguggauggcguccgucgagccccacuggaucgccgccagcaucauccucgaguucuuccugauggugcugcucauccccgagcccgaccgccagcggaccccgcaggacaaccagcuggccuacguggucaucgggcuccucuucaugauccugaccguggccgcgaacgagaugggccugcucgagacgaccaagaaggaccuggggaucggccacguggccgucgagaaccaccaccacgccgccaugcuggacguggaccuccaccccgccuccgcguggacccuguacgccguggccaccacgaucaucacccccaugaugcgccacaccaucgagaacaccacggccaacaucagccugaccgccaucgcgaaccaggccgccauccucauggggcuggacaagggcuggccgaucuccaagauggacaucggcgucccccugcucgcccuggggugcuacagccaggugaacccccugacccucaccgcggccgugcugaugcuggucgcccacuacgccaucaucggccccgggcuccaggccaaggcgacgcgcgaggcccagaagcggaccgccgccggcaucaugaagaacccgaccguggacgggaucguggccaucgaccuggaccccgucguguacgacgcgaaguucgagaagcagcugggccagaucaugcuccugauccugugcaccucccagauccuccugaugcgcacgaccugggcccugugcgagagcaucacccucgccaccggcccccugacgacccugugggaggggucccccggcaaguucuggaacaccaccaucgccgugagcauggccaacaucuuccgggggagcuaccucgcgggcgccggccuggccuucucccugaugaagucccucgggggcgggcgccggggcacgggggcccagggcgagacccugggcgagaaguggaagcgccagcugaaccagcucuccaagagcgaguucaacaccuacaagcgguccgggaucauggaggucgaccgcagcgaggcgaaggagggccugaagcgcggggagaccacgaagcacgccgugucccgcggcaccgccaagcugcggugguucguggagcgcaaccucgucaagccggaggggaaggugaucgaccugggcugcggccgcggcggguggagcuacuacugcgccgggcugaagaaggugaccgaggucaagggguacaccaagggcgggcccggccacgaggagcccauccccauggccacguacggguggaaccuggugaagcuccacuccggcaaggacguguucuucaucccgcccgagaagugcgacacccugcugugcgacaucggggagagcucccccaaccccaccaucgaggagggccgcacccuccggguccugaagaugguggagccguggcugcgcgggaaccaguucugcaucaagauccucaaccccuacaugcccagcguggucgagacgcuggagcagaugcagcggaagcacggcggcaugcuggugcgcaacccccucucccggaacagcacccacgagauguacuggguguccugcgggaccggcaacaucgucagcgcggugaacaugaccucccgcaugcugcugaaccgcuucaccauggcccaccggaagccgacguacgagcgcgacguggaccucggggccggcacccggcacgucgccguggagcccgagguggccaaccuggacaucaucggccagcgcaucgagaacaucaagcacgagcacaagagcaccuggcacuacgacgaggacaaccccuacaagaccugggcguaccacggguccuacgaggucaagcccagcggcagcgccuccagcauggugaacggggucgugaagcugcucacgaagccgugggacgugauccccauggucacccagaucgccaugaccgacaccacgcccuucggccagcagcggguguucaaggagaagguggacacccgcacccccaaggccaagcgggggaccgcccagaucauggaggucacggcgaaguggcuguggggcuuccugucccgcaacaagaagccgcggaucugcacccgcgaggaguucacccggaaggugcgcagcaacgccgccaucggcgccguguucgucgacgagaaccaguggaacuccgcgaaggaggccguggaggacgagcgguucugggaccucgugcaccgcgagcgggagcugcacaagcaggggaagugcgcgaccugcgucuacaacaugaugggcaagcgcgagaagaagcugggggaguucggcaaggccaaggggagccgggccaucugguacauguggcucggcgcgcgcuuccuggaguucgaggcccugggcuucaugaacgaggaccacugguucucccgggagaacagccucuccgggguggagggcgaggggcugcacaagcugggcuacauccuccgcgacaucagcaagauccccgggggcaacauguacgccgacgacacggccggcugggacacccggaucaccgaggacgaccugcagaacgaggccaagaucaccgacaucauggagcccgagcacgcgcugcucgccaaguccaucuucaagcugacguaccagaacaaggugguccgcgugcagcgcccggccaagaacgggaccgugauggacgucaucagccggcgcgaccagcggggcuccggccaggugggcaccuacggccugaacaccuucacgaacauggaggcccagcucauccgccagauggagagcgaggggaucuucucccccagcgagcuggagacccccaaccuggccggccgggugcucgacuggcuggagaagcacggggucgagcgccugaagcggauggcgaucuccggcgacgacugcguggugaagcccaucgacgaccgcuucgccaccgcccucaccgcccugaacgacauggggaagguccggaaggacaucccgcagugggagcccagcaagggcuggaacgacuggcagcagguccccuucugcagccaccacuuccaccagcugaucaugaaggacggccgcgagaucgugguccccugccggaaccaggacgagcucguggggcgcgcccgggugucccagggcgcgggguggagccugcgcgagacggccugccugggcaaguccuacgcccagauguggcagcucauguacuuccaccggcgcgaccugcggcuggccgcgaacgccaucugcagcgccgucccgguggacugggugcccaccucccgcaccaccuggagcauccacgcccaccaccaguggaugacgaccgaggacaugcucuccgucuggaaccggguguggaucgaggagaaccccuggauggaggacaagacccacgugagcuccuggggcgacguccccuaccugggcaagcgcgaggaccaguggugcggcagccugaucgggcucaccgcccgcgcgacgugggccaccaacauccagguggccaucaaccaggugcggcgccugcugggcaacgagaacuaccucgacuacaugaccuccaugaagcgguucaagaacgagagcgacccggagggggcccugugguga

SEQ ID NO: 8480 - RNA, 9879 nt, Artificial Sequence
  derived and/or modified CDS sequence (opt1) from DENV-1__FJ898385__SS-prME
agcgugaccaugcugcucaugcugaugcccaccgcccuggccuuccaccucaccacccggggcggggagccccacaugaucgugaccaagcaggagcggggcaagagccugcuguucaagaccagcgcgggggugaacaugugcacccucaucgccauggaccugggcgagcugugcgaggacaccaugaccuacaagugcccccgcaucaccgaggccgagcccgacgacguggacugcuggugcaacgccaccgacaccugggugaccuacgggaccugcagccagacgggcgagcaccggcgcgacaagcggagcguggcccucgcgccccacgugggccuggggcuggagacccgcaccgagaccuggauguccagcgagggcgccuggaagcagauccagcggguggagacgugggcccuccgccaccccggguucaccgugaucgcccuguuccuggcgcacgccaucggcaccuccaucacccagaaggggaucaucuucauccuccugaugcuggugacgcccagcauggccaugcggugcgugggcaucggcucccgcgacuucguggaggggcucagcggcgccaccuggguggacgucgugcuggagcacggguccugcgugaccaccauggccaaggacaagcccacgcuggacaucgagcuccugaagaccgaggucaccaaccccgcggugcugcggaagcucugcaucgaggccaagaucagcaacaccacgaccgacucccgcugccccacccagggcgaggccacccugauggaggagcaggacgccaacuucgugugccggcgcacguucgucgaccggggcugggggaacggcugcgggcuguucggcaaggggagccucaucacgugcgccaaguucaagugcgugaccaagcuggagggcaagaucgugcaguacgagaaccugaaguacuccgucaucgugaccgugcacacgggcgaccagcaccaggucgggaacgagagcaccgagcacggcaccaccgcgaccaucacgccccaggcccccaccuccgagauccagcucaccgacuacggggcccugacccuggacugcagcccccgcacgggccucgacuucaacgagauggugcugcugaccaugaaggagaaguccuggcucguccacaagcagugguuccuggaccugccgcuccccuggaccagcggggccagcaccucccaggagacguggaaccggcaggaccugcuggugaccuucaagaccgcccacgcgaagaagcaggagguggucgugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgugaugugcaccggguccuucaagcucgagaaggaggucgcggagacgcagcacggcaccgugcuggugcagaucaaguacgagggcaccgacgcccccugcaagauccccuucagcacccaggacgagaagggggucacgcagaacggccggcugaucaccgccaacccgaucgugaccgacaaggagaagcccgugaacaucgaggccgagccgcccuucggggaguccuacaucgucaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcguggggaagcugguccaccagaucuucggcaccgccuacgggguccuguucuccggcgugagcuggaccaugaagaucgggaucggcguccugcugacguggcucggccugaacucccgcagcaccucccugagcaugaccugcaucgccguggggcucgugacccuguaccugggcgucauggugcaggccgacuccgggugcgugaucaacuggaagggccgggagcucaagugcgggagcggcaucuucgucacgaacgaggugcacaccuggaccgagcaguacaaguuccaggcggacagcccgaagcgccuguccgccgccaucggcaaggccugggaggagggggugugcggcauccggagcgccacccgccuggagaacaucauguggaagcagaucuccaacgagcucaaccacauccugcuggagaacgacaugaaguucaccgucguggucggcggggucguggggauccucgcgcaggggaagaagaugauccggccccagcccauggagcacaaguacagcuggaaguccuggggcaaggccaagaucaucggggccgacgugcagaacacgaccuucaucaucgacggccccaacaccccggagugccccgacgaccagcgcgccuggaacaucugggaggucgaggacuacggguucggcaucuucaccacgaacaucuggcugaagcugcgggacagcuacacccaggugugcgaccaccgccucauguccgcggccaucaaggacagcaaggccgugcacgccgacaugggcuacuggaucgaguccgagaagaacgagaccuggaagcuggcccgggcgagcuucaucgaggucaagaccugcaucuggcccaagucccacacgcuguggagcaacggggugcucgaguccgagaugaucauccccaagaucuacggcgggccgaucagccagcacaacuaccgccccggcuacuucacccagaccgccgggcccuggcaccugggcaagcuggagcucgacuucgaccugugcgagggcaccacgguggucguggacgagcacugcgggaaccggggcccgucccugcgcaccaccaccgugacggggaagaucauccacgaguggugcugccggagcugcacccugccgccccuccgcuucaagggcgaggacgggugcugguacggcauggagauccggcccgucaaggagaaggaggagaaccuggugaaguccauggugagcgccggcagcggggaggucgacuccuucagccucggccugcugugcaucuccaucaugaucgaggaggugaugcgcagccgguggucccgcaagaugcucaugaccgggacccuggccguguuccugcuccugaucaugggccagcugacguggaacgaccucauccggcugugcaucauggucggggccaacgcgagcgaccgcaugggcaugggcaccaccuaccuggcccucauggccaccuucaagaugcgcccgauguucgccguggggcugcuguuccggcgccucacgucccgggaggugcugcugcucaccaucggccugagccuggucgccuccguggagcuccccaacagccuggaggagcugggggacggccucgcgaugggcaucaugauccugaagcugcucaccgacuuccagucccaccagcugugggccacccugcucagccugacguucaucaagaccacccugucccuccacuacgccuggaagaccauggccaugauccugagcaucgucucccuguucccccucugccugagcacgaccucccagaagaccaccuggcugcccgugcuccuggggagccugggcugcaagccgcucacgauguuccugaucgcggagaacaagaucugggggcgcaaguccuggccccugaacgagggcaucauggccgugggggucgugagcauccuccugagcucccugcucaagaacgacgugccccuggccggcccccugaucgccggcgggaugcucaucgccugcuacgucaucagcggcuccagcgcggaccugucccuggagaaggccgccgaggugagcugggaggaggaggccgagcacuccggggccagccacaacauccucguggagguccaggacgacggcaccaugaagaucaaggacgaggagcgggacgacacccugaccauccugcucaaggcgacccugcuggccguguccgggguguacccgcucagcauccccgccacgcuguucgucugguacuucuggcagaagaagaagcagcgcuccggcgugcugugggacacccccagcccgcccgagguggagcgggccguccuggacgacggcaucuaccgcaucaugcagcgggggcuccugggccgcucccaggugggggugggcgucuuccaggagaacguguuccacaccauguggcacgugacccgcggggccguccugauguaccagggcaagcgccucgagcccagcugggcguccgugaagaaggaccugaucagcuacggcgggggcuggcggcugcagggguccuggaacaugggcgaggaggugcaggucaucgccguggagcccgggaagaaccccaagaacgugcagacggcccccggcaccuucaagacccccgagggcgaggucggggccaucgcccucgacuucaagcccggcaccagcgggucccccaucgugaaccgcgagggcaagaucgugggccuguacgggaacggcgucgugacgaccagcgggaccuacgugagcgcgaucgcccaggccaaggccucccaggagggcccgcugcccgagaucgaggacgaggucuuccggaagcgcaaccucaccaucauggaccugcaccccgggagcggcaagacgcggcgcuaccugccggcgaucgugcgggaggccaucaagcgcaagcuccggacccugauccuggcccccacccgcguggucgccuccgagauggccgaggcgcucaagggcaugcccauccgcuaccagaccacggccgucaagagcgagcacaccgggaaggagaucguggaccugaugugccacgccaccuucaccaugcggcugcucucccccguccgcgugccgaacuacaacaugaucaucauggacgaggcccacuucacggaccccagcuccaucgccgcgcggggcuacaucagcacccgcguggggaugggcgaggccgccgccaucuucaugaccgccacgccgcccggguccgucgaggcguucccgcagagcaacgccgugauccaggacgaggagcgggacauccccgagcgcuccuggaacagcggcuacgaguggaucacggacuuccccggcaagaccgugugguucguccccuccaucaagagcgggaacgacaucgccaacugccugcggaagaacggcaagcgcgugauccagcugucccggaagaccuucgacaccgaguaccagaagacgaagaacaacgacugggacuacguggucaccaccgacaucagcgagaugggggccaacuuccgcgcggaccgggugaucgacccgcgccggugccucaagcccgugauccugaaggacggccccgagcgcgucauccuggccgggcccaugccggugaccgucgccuccgccgcccagcggcgcggccggaucggccgcaaccacaacaaggagggggaccaguacaucuacaugggccagccccucaacaacgacgaggaccacgcgcacuggacggaggccaagaugcugcuggacaacaucaacacccccgaggggaucauccccgcccucuucgagccggagcgggagaaguccgccgccaucgacggcgaguaccgccugcgcggggaggcgcggaagaccuucguggagcugaugcgccggggcgaccuccccguguggcuguccuacaaggucgccagcgagggcuuccaguacagcgaccgccgguggugcuucgacggggagcgcaacaaccaggugcuggaggagaacauggacguggagaucuggaccaaggagggcgagcggaagaagcuccgcccccgguggcuggacgcccgcacguacuccgacccccuggcccuccgggaguucaaggaguucgccgcggggcgccggagcgucuccggcgaccugauccuggagaucggcaagcucccgcagcaccugacccagcgcgcccagaacgcccuggacaaccucgugaugcugcacaacagcgagcagggcgggcgggccuaccgccacgcgauggaggagcugcccgacaccaucgagacccucaugcugcuggcccucaucgccgugcugaccgggggcgucacccuguucuuccucuccgggcggggccugggcaagaccagcaucgggcugcucugcgugauggccuccagcgugcugcuguggauggccuccgucgagccccacuggaucgcggccagcaucauccucgaguucuuccugauggugcugcucauccccgagccggaccgccagcggacgccccaggacaaccagcuggccuacguggucaucggccuccucuucaugauccugaccguggccgccaacgagauggggcugcucgagacgaccaagaaggaccugggcaucgggcacguggcggucgagaaccaccaccacgccaccaugcuggacguggaccuccaccccgccuccgccuggacccuguacgccguggcgacgaccaucaucaccccgaugaugcgccacaccaucgagaacacgaccgccaacaucagccugaccgccaucgccaaccaggccgcgauccucaugggccuggacaagggcuggcccaucuccaagauggacaucggggucccccugcucgcccugggcugcuacagccaggugaacccccugacccucacggccgccgugcugaugcuggucgcgcacuacgccaucaucgggccgggccuccaggccaaggccacccgggaggcccagaagcgcaccgcggccgggaucaugaagaaccccaccguggacggcaucguggccaucgaccuggaccccgucguguacgacgccaaguucgagaagcagcugggccagaucaugcuccugauccugugcacgucccagauccuccugaugcgcaccaccugggcccugugcgagagcaucacccucgcgacggggccccugaccacccugugggagggcuccccggggaaguucuggaacaccacgaucgccgugagcauggccaacaucuuccggggcuccuaccucgccggcgccgggcuggcguucagccugaugaagucccucggcgggggccgccgggggaccggcgcccagggcgagacccugggggagaaguggaagcgccagcugaaccagcucuccaagagcgaguucaacaucuacaagcgguccggcaucauggaggucgaccgcagcgaggccaaggaggggcugaagcggggcgagaccacgcgccacgccgugucccgggggaccgcgaagcugcgcugguucguggagcggaaccuggucaagcccgagggcaaggugaucgaccucggcugcgggcgcggcggguggagcuacuacugcgccggccugaagaaggugaccgaggucaagggguacaccaagggcggccccgggcacgaggagcccaucccgauggccacguacggcuggaaccuggugaagcuccacuccgggaaggacguguucuucacgccgcccgagaagugcgacacccugcugugcgacaucggcgagagcucccccaacccgaccaucgaggaggggcggacgcuccgcguccugaagaugguggagcccuggcugcggggcaaccaguucugcaucaagauccucaaccccuacaugcccagcguggucgagacccuggagcagaugcagcgcaagcacggcgggaugcuggugcggaacccgcucucccgcaacagcacccacgagauguacuggguguccugcggcaccgggaacaucgucagcgccgugaacaugaccucccggaugcugcugaaccgcuucacgauggcccaccgcaagcccaccuacgagcgggacguggaccucggcgcgggcacccgccacgucgccguggagcccgagguggccaaccuggacaucaucgggcagcggaucgagaacaucaagcacgagcacaagagcaccuggcacuacgacgaggacaaccccuacaagacgugggccuaccacggcuccuacgaggucaagccgagcggguccgccagcagcauggugaacggcgucgugaagcugcucaccaagcccugggacgugauccccauggucacccagaucgcgaugaccgacacgacccccuucgggcagcagcgcguguucaaggagaagguggacacccggaccccgaaggccaagcgcggcacggcccagaucauggaggucaccgcccgguggcuguggggcuuccugucccgcaacaagaagccccggaucugcacccgcgaggaguucacccggaaggugcgcagcaacgccgcgaucggggccguguucgucgacgagaaccaguggaacuccgccaaggaggccguggaggacgagcgguucugggaccucgugcagaaggagcgcgagcugcacaagcagggcaagugcgcgacgugcgucuacaacaugauggggaagcgggagaagaagcugggcgaguucgggaaggccaagggcagccgcgccaucugguacauguggcucggcgcccgguuccuggaguucgaggcccugggguucaugaacgaggaccacugguucucccgcgagaacagccucuccggcguggagggggagggccugcacaagcugggguacauccuccgggacaucagcaagauccccggcggcaacauguacgcggacgacaccgccgggugggacacccgcaucaccgaggacgaccugcagaacgaggccaagaucacggacaucauggagccggagcacgcccugcucgccaccuccaucuucaagcugaccuaccagaacaaggugguccgggugcagcgccccgcgaagaacggcaccgugauggacgucaucagccgccgggaccagcgcggguccggccaggugggcacguacgggcugaacaccuucaccaacauggaggcccagcucauccggcagauggagagcgagggcaucuucucccccagcgagcuggagauccccaaccuggccgagcgcgugcucgacuggcuggagaaguacggggucgagcggcugaagcgcauggccaucuccggcgacgacugcguggugaagccgaucgacgaccgguucgccaccgcgcucacggcccugaacgacauggggaagguccgcaaggacgugccccagugggagcccagcaagggcuggaacgacuggcagcagguccccuucugcucccaccacuuccaccagcugaucaugaaggacggccgggagaucgucgugccgugccgcaaccaggacgagcucguggggcgggcccgcgucagccagggcgccggguggagccugcgggagaccgccugccugggcaaguccuacgcgcagauguggcagcucauguacuuccaccgccgggaccugcgccuggccgccaacgccaucugcagcgcggugcccguggacuggguccccaccucccggaccacguggagcauccacgcccaccaccaguggaugaccaccgaggacaugcucuccguguggaaccgcguguggaucgaggagaaccccuggauggaggacaagacccacgucagcuccuggggcgacgugccguaccugggcaagcgggaggaccaguggugcggcagccugaucgggcucacggcccgcgccaccugggccuccaacauccagguggcgaucaaccagguccgccggcugaucggcaacgagaacuaccuggacuacaugaccagcaugaagcgcuucaagaacgagggggaccccgagggcgcccucugguga

SEQ ID NO: 8481 - RNA, 9879 nt, Artificial Sequence
  derived and/or modified CDS sequence (opt1) from DENV-1__GQ868608__SS-prME
agcgugaccaugcugcucaugcugaugcccaccgcccuggccuuccaccucaccacccggggcggggagccccacaugaucguguccaagcaggagcggggcaagagccugcuguucaagaccuccgcgggggugaacaugugcacccucaucgccauggaccugggcgaguucugcgaggacacgaugaccuacaagugcccccgcaucaccgaggccgagcccgacgacguggacugcuggugcaacgccaccgacacgugggucaccuacgggaccugcagccagaccggcgagcaccggcgggacaagcgguccguggcccuggcgccccacgugggccucgggcuggagacgcgcaccgagaccuggaugagcuccgagggcgccuggaagcagauccagcgggucgagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugcccgacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaagaccguccaguacgagaaccugaaguacagcgugaucgugaccguccacacgggcgaccagcaccagguggggaacgaguccaccgagcacggcaccaccgcgaccaucacgccccaggcccccagcaccgagauccagcugaccgacuacggggcccucacccuggacugcagcccccggacgggccuggacuucaacgagaugguccuccugaccaugaaggagaaggccuggcuggugcacaagcagugguuccucgaccugccgcugcccuggaccagcggggccagcaccucccaggagacguggaaccggaaggaccuccuggugaccuucaagaccgcgcacgccaagaagcaggaggucguggugcugggcagccaggagggcgccaugcacaccgcccucacgggggccaccgagauccagaccuccggcaccacgaccaucuucgcggggcaccugaagugccgccugaagauggacaagcucacccugaagggcaugagcuacgucaugugcaccggguccuucaagcuggagaaggagguggccgagacgcagcacggcaccgugcucguccagaucaaguacgagggcaccgacgcccccugcaagauccccuucagcacccaggacgagaagggggugacgcagaacggccggcugaucaccgccaacccgaucgugaccgacaaggagaagcccgucaacaucgaggcggagccgcccuucggggaguccuacaucgugaucggcgccggcgagaaggcccugaagcugagcugguucaagaagggguccagcaucggcaagauguucgaggccaccgcccgcggggcgcggcgcauggccauccucggcgacacggccugggacuucggguccaucggcggcguguucaccagcgucgggaagcuggugcaccagaucuucggcaccgccuacggggugcuguucuccggcgucagcuggaccaugaagaucgggaucggcgugcuccugacguggcugggccucaacucccgcagcaccucccugagcaugaccugcaucgccguggggcuggucacccucuaccugggcgugauggugcaggcggacuccgggugcgucaucaacuggaagggccgggagcugaagugcgggagcggcaucuucgugacgaacgaggugcacaccuggaccgagcaguacaaguuccaggccgacagcccgaagcgccucuccgccgccaucggcaaggccuggaaggagggggucugcggcauccggagcgcgacccgccuggagaacaucauguggaagcagaucuccaacgagcugaaccacauccuccuggagaacgacaugaaguucaccgugguggucggggacguggccggcauccuggcccaggggaagaagaugauccggccccagcccauggaguacaaguacagcuggaaguccuggggcaaggccaagaucaucggcgcggacgugcagaacgccacguucaucaucgacgggcccaacaccccggagugccccgacgaccagcgcgccuggaacaucugggaggucgaggacuacggcuucgggaucuucaccaccaacaucuggcucaagcugcgggacagcuacacccaggugugcgaccaccgccugauguccgccgccaucaaggacagcaaggcggugcacgccgacaugggcuacuggaucgaguccgagaagaacgagaccuggaagcucgcccgggccagcuucaucgaggucaagaccugcaucuggcccaagucccacacccuguggagcaacggcgugcuggaguccgagaugaucauccccaagaucuacgggggcccgaucagccagcacaacuaccgccccggguacuucacgcagaccgccggccccuggcaccucgggaagcuggagcuggacuucgaccucugcgagggcaccaccguggucguggacgagcacugcggcaaccgggggccgucccugcgcacgaccaccgugaccggcaagaucauccacgaguggugcugccggagcugcacgcugccgccccugcgcuucaagggggaggacggcugcugguacgggauggagauccggcccgucaaggagaaggaggagaaccuggugaaguccauggugagcgcgggcagcggcgaggucgacuccuucagccuggggcuccugugcaucuccaucaugaucgaggaggugaugcgcagccgguggucccgcaagaugcugaugaccggcacccucgccguguucuuccugcugaucauggggcagcucaccuggaacgaccugauccggcugugcaucauggucggcgccaacgccagcgaccgcauggggaugggcacgacguaccucgcccugauggcgaccuucaagaugcgcccgauguucgccguggggcuccuguuccggcgccugaccucccgggaggugcugcuccugacgaucgggcugagccucgucgccuccguggagcugcccaacagccuggaggagcucggcgacgggcuggccaugggcaucaugauccugaagcuccugaccgacuuccagucccaccagcugugggcgacccuccugagccugaccuucaucaagacgaccuucucccuccacuacgccuggaagaccauggccaugguccugagcaucgugucccuguucccccucugccugagcaccacgucccagaagaccaccuggcugcccgugcuccugggcagccuggggugcaagccgcucaccauguuccugaucgccgagaacaagaucuggggccgcaaguccuggccccugaacgaggggaucauggccgucggcaucgugagcauccuccugagcucccugcucaagaacgacgugccccuggcggggccccugaucgccggcggcaugcucaucgccugcuacgucaucagcggguccagcgccgaccugucccuggagaaggccgcggaggugagcugggaggaggaggccgagcacuccggcgccagccacaacauccucguggagguccaggacgacgggacgaugaagaucaaggacgaggagcgggacgacaugcugaccauccugcucaaggccacccugcuggccguguccggcguguacccgcucagcauccccgcgacccuguucgucugguacuucuggcagaagaagaagcagcgcuccggggugcugugggacacccccuccccgcccgagguggagcgggccguccucgacgacggcaucuaccgcaucaugcagcggggccugcuggggcgcucccaggugggcgugggggucuuccaggagaacguguuccacacgauguggcacgugacccggggcgccguccugauguaccaggggaagcgccucgagcccagcugggccuccgugaagaaggaccugaucagcuacggcggcggguggcggcugcagggcuccuggaacaccggggaggaggugcaggucaucgccguggagcccggcaagaaccccaagaacgugcagaccgcgcccgggacguucaagaccagcgagggcgaggucggcgccaucgcccucgacuucaagcccgggaccuccggcagccccaucgugaaccgcgaggggaagaucgugggccuguacggcaacggggucgugaccacgagcggcaccuacguguccgccaucgcgcaggccaaggccagccaggaggggccccugccggagaucgaggacgaggucuuccggaagcgcaaccucaccaucauggaccugcaccccggcuccgggaagacccggcgcuaccugcccgccaucgugcgggaggccaucaagcgcaagcuccggacgcugauccuggcgccgacccgcguggucgccagcgagauggccgaggcccucaagggcaugcccauccgcuaccagaccaccgccgugaaguccgagcacacgggcaaggagaucguggaccugaugugccacgcgaccuucaccaugcggcugcucagccccguccgcgugcccaacuacaacaugaucaucauggacgaggcccacuucaccgacccguccagcaucgccgcccggggguacaucuccacgcgcgugggcaugggggaggccgcggccaucuucaugaccgccacgccgcccggcagcgucgaggccuucccccaguccaacgcggugauccaggacgaggagcgggacaucccggagcgcagcuggaacuccggguacgaguggaucaccgacuuccccggcaagacggugugguucguccccagcaucaaguccggcaacgacaucgccaacugccugcggaagaacgggaagcgcgugauccagcugagccggaagaccuucgacaccgaguaccagaagaccaagaacaacgacugggacuacguggucacgaccgacaucuccgagaugggcgccaacuuccgcgccgaccgggugaucgacccccgccggugccucaagccggugauccugaaggacgggcccgagcgcgucauccuggccggccccaugcccgugaccgucgcgagcgccgcccagcggcgcgggcggaucggccgcaaccacaacaaggagggcgaccaguacaucuacauggggcagccgcucaacaacgacgaggaccacgcccacuggaccgaggccaagaugcugcuggacaacaucaacacgcccgagggcaucauccccgcccucuucgagcccgagcgggagaaguccgccgccaucgacggggaguaccgccugcgcggcgaggcccggaagaccuucguggagcugaugcgccgcggggaccucccgguguggcugagcuacaaggucgccagcgagggcuuccaguacuccgaccgccgguggugcuucgacggcgagcgcaacaaccaggugcuggaggagaacauggacguggagaucuggaccaaggagggggagcggaagaagcuccgcccccgguggcuggacgcgcgcaccuacagcgacccccuggcccuccgggaguucaaggaguucgccgccggccgccgguccgucagcggggaccugauccuggagaucggcaagcucccccagcaccugacgcagcgcgcgcagaacgcccuggacaaccucgugaugcugcacaacuccgagcagggcgggcgggccuaccgccacgccauggaggagcugccggacaccaucgagacccucaugcugcuggcccucaucgcggugcugaccggcggggucacgcuguucuuccucagcggccgggggcugggcaagaccuccaucggccugcucugcgugauggccagcuccgugcugcuguggauggccagcgucgagccccacuggaucgccgccuccaucauccucgaguucuuccugauggugcugcucauccccgagcccgaccgccagcggaccccgcaggacaaccagcuggcguacguggucaucgggcuccucuucaugauccugaccguggccgccaacgagaugggccugcucgagaccacgaagaaggaccuggggaucggccacguggccgucgagaaccaccaccacgccgcgaugcuggacguggaccuccaccccgccagcgccuggacccuguacgccguggccaccaccaucaucacgcccaugaugcgccacaccaucgagaacaccaccgcgaacaucucccugacggccaucgccaaccaggccgcgauccucauggggcuggacaagggcuggccgaucagcaagauggacaucggcgucccccugcucgcccuggggugcuacucccaggugaacccccugacccucaccgccgccgugcugaugcuggucgcccacuacgcgaucaucggccccgggcuccaggccaaggccacccgggaggcccagaagcgcacggccgcgggcaucaugaagaacccgaccguggacgggaucguggccaucgaccuggaccccgucguguacgacaccaaguucgagaagcagcugggccagaucaugcuccugauccugugcaccagccagauccuccugaugcgcacgaccugggcccugugcgaguccaucacccucgccaccggcccccugacgacccugugggaggggagccccggcaaguucuggaacaccaccaucgccguguccauggcgaacaucuuccgggggagcuaccucgccggcgccggccuggccuucagccugaugaagucccucgggggcgggcgccggggcacgggggcgcagggcgagacccugggcgagaaguggaagcgccagcugaaccagcucagcaaguccgaguucaacaccuacaagcggagcgggaucauggaggucgaccgcuccgaggccaaggagggccugaagcgcggggagaccacgaagcacgccgugagccgcggcaccgccaagcugcggugguucguggagcgcaaccucgucaagccggaggggaaggugaucgaccugggcugcggccgcggcgggugguccuacuacugcgccgggcugaagaaggugaccgaggucaagggguacaccaagggcgggcccggccacgaggagcccauccccauggcgacguacggguggaaccuggugaagcuccacagcggcaaggacguguucuucaucccgcccgagaagugcgacacccugcugugcgacaucggggaguccagccccaaccccaccaucgaggagggccgcacccuccggguccugaagaugguggagccguggcugcgcgggaaccaguucugcaucaagauccucaaccccuacaugcccuccguggucgagacgcuggagcagaugcagcggaagcacggcggcaugcuggugcgcaacccccucagccggaacuccacccacgagauguacugggugagcugcgggaccggcaacaucgucuccgccgugaacaugaccagccgcaugcugcugaaccgguucaccauggcccaccgcaagccgacguacgagcgcgacguggaccucggggccggcacccggcacgucgccguggagcccgagguggcgaaccuggacaucaucggccagcgcaucgagaacaucaagcacgagcacaaguccaccuggcacuacgacgaggacaaccccuacaagaccugggccuaccacgggagcuacgaggucaagcccuccggcagcgccagcuccauggugaacggggucgugaagcugcucacgaagccgugggacgugauccccauggucacccagaucgccaugaccgacaccacgcccuucggccagcagcggguguucaaggagaagguggacacccgcacccccaaggccaagcgggggaccgcgcagaucauggaggucacggccaaguggcuguggggcuuccugagccgcaacaagaagccgcggaucugcacccgcgaggaguucacccggaaggugcgcuccaacgccgccaucggcgcgguguucgucgacgagaaccaguggaacagcgccaaggaggccguggaggacgagcgguucugggaccucgugcaccgcgagcgggagcugcacaagcaggggaagugcgcgaccugcgucuacaacaugaugggcaagcgcgagaagaagcugggggaguucggcaaggccaaggggucccgggcgaucugguacauguggcucggcgcccgcuuccuggaguucgaggcccugggcuucaugaacgaggaccacugguucagccgggagaacucccucagcgggguggagggcgaggggcugcacaagcugggcuacauccuccgcgacaucuccaagauccccgggggcaacauguacgccgacgacacggccggcugggacacccggaucaccgaggacgaccugcagaacgaggcgaagaucaccgacaucauggagcccgagcacgcccugcucgccaagagcaucuucaagcugacguaccagaacaaggugguccgcgugcagcggccggccaagaacgggaccgugauggacgucaucucccgccgcgaccagcggggcagcggccaggugggcaccuacggccugaacaccuucacgaacauggaggcccagcucauccgccagauggaguccgaggggaucuucagccccuccgagcuggagacccccaaccuggcgggccgggugcucgacuggcuggagaagcacggggucgagcgccugaagcggauggccaucagcggcgacgacugcguggugaagcccaucgacgaccgcuucgccaccgcccucaccgcccugaacgacauggggaagguccggaaggacaucccgcagugggagcccuccaagggcuggaacgacuggcagcagguccccuucugcagccaccacuuccaccagcugaucaugaaggacggccgcgagaucgugguccccugccggaaccaggacgagcucguggggcgcgcgcgggugagccagggcgccggguggucccugcgcgagacggccugccugggcaagagcuacgcccagauguggcagcucauguacuuccaccggcgcgaccugcggcuggcggccaacgccaucugcuccgccgucccgguggacugggugcccaccagccgcaccaccugguccauccacgcccaccaccaguggaugacgaccgaggacaugcucagcgucuggaaccggguguggaucgaggagaaccccuggauggaggacaagacccacaucuccagcuggggcgacgugcccuaccugggcaagcgcgaggaccaguggugcggcucccugaucgggcucaccgcgcgggccacgugggccaccaacauccaggucgccaucaaccaggugcgccgccugaucggcaacgagaacuaccuggacuacaugaccagcaugaagcgguucaagaacgagaucgacccggagggggcccucugguga

SEQ ID NO: 8482 - RNA, 9879 nt, Artificial Sequence
  derived and/or modified CDS sequence (opt1) from DENV-1__GQ199774__SS-prME
agcgugaccaugcugcucaugcugaugcccaccgcccuggccuuccaccucaccacccggggcggggagccccacaugaucguguccaagcaggagcggggcaagagccugcuguucaagaccuccgccggggugaacaugugcacccucaucgccauggaccugggcgagcugugcgaggacaccaugaccuacaagugcccccggaucaccgagguggagcccgacgacguggacugcuggugcaacaccaccgacaccugggugaccuacgggaccugcagccagacgggcgagcaccggcgcgacaagcgguccguggcccucgcgccccacgucggccuggggcuggagacccgcgccgagaccuggaugagcuccgagggcgcguggaagcagauccagaagguggagaccugggcccuccggcaccccggguucacggugaucgcccuguuccuggcccacgcgaucggcaccagcaucacccagaaggggaucaucuucauccuccugaugcuggucacccccuccauggccaugcgcugcgugggcaucggcagccgggacuucguggaggggcucuccggcgccacgugggucgacguggugcuggagcacgggagcugcgucaccaccauggccaaggacaagcccacccuggacaucgagcuccugaagacggaggugaccaaccccgccgugcugcgcaagcucugcaucgaggcgaagaucuccaacaccaccacggacagccggugcccgacccagggcgaggccacccuggucgaggagcaggacgccaacuucgugugccgccggaccuucguggaccgcggcugggggaacggcugcgggcuguucggcaaggggucccucaucacgugcgccaaguucaagugcgucaccaagcuggagggcaagaucgugcaguacgagaaccugaaguacagcgugaucgucaccgugcacaccggcgaccagcaccaggucgggaacgaguccacggagcacggcaccaucgccaccaucacgccccaggcgcccaccagcgagauccagcucacggacuacggggcccugacccuggacugcagcccccggaccggccucgacuucaacgagauggugcugcugaccaugaaggagaaguccuggcucgugcacaagcagugguuccuggaccugccccuccccuggacgagcggggccuccaccagccaggagaccuggaaccgccaggaccugcuggucaccuucaagacggcccacgccaagaagcaggagguggugguccucggcucccaggagggcgcgaugcacaccgcccugaccggggccaccgagauccagacgaccggcaccaccacgaucuucgccgggcaccugaagugccggcucaagauggacaagcugacccugaagggcaugagcuacgugaugugcaccggguccuucaagcucgagaaggagguggccgagacccagcacggcacgguccuggugcagaucaaguacgagggcaccgacgcgcccugcaagauccccuucagcacccaggacgagaagggggugacccagaacggccgccugaucacggccaacccgaucgucaccgacaaggagaagcccgugaacaucgaggccgagccgcccuucggggaguccuacaucgugaucggcgccggcgagaaggcgcugaagcucagcugguucaagaagggguccagcaucggcaagauguucgaggccaccgcccgcggggcccgccggauggccauccugggcgacaccgcgugggacuucggguccaucggcggcgucuucacgagcguggggaagcuggugcaccagaucuucggcaccgccuacgggguccucuucuccggcgugagcuggaccaugaagaucgggaucggcgugcugcugaccuggcucggccugaacucccgcagcacgucccugagcaugaccugcaucgccgucgggcucaucacccuguaccugggcgugauggugcaggccgacuccgggugcgucaucaacuggaagggccgcgagcucaagugcgggagcggcaucuucgugaccaacgaggugcacacguggaccgagcaguacaaguuccaggccgacagcccgaagcggcuguccgcggccaucggcaaggccugggaggagggggucugcggcauccgcagcgccacccggcuggagaacaucauguggcgccagaucuccaacgagcucaaccacauccugcuggagaacgacaugaaguucaccgugguggucggggacguggugggcauccucgcccaggggaagaagaugguccggccccagcccauggagcacaaguacagcuggaaguccuggggcaaggcgaagaucaucggcgccgacgugcagaacaccacguucaucaucgacgggcccaacaccccggagugccccgacgaccagcgcgccuggaacaucugggagguggaggacuacggcuucgggaucuucaccaccaacaucuggcugaagcugcgggacagcuacacgcaggucugcgaccaccgccucauguccgccgcgaucaaggacagcaaggccgugcacgccgacaugggcuacuggaucgaguccgagaagaacgagaccuggaagcuggcccgggccagcuucaucgaggugaagaccugcaucuggcccaagucccacacccuguggagcaacggcguccucgaguccgagaugaucauccccaagaucuacgggggcccgaucagccagcacaacuaccgccccggguacuucacgcagaccgcgggccccuggcaccuggggaagcuggagcucgacuucgaccugugcgagggcaccaccgugguggucgacgagcacugcggcaaccgggggccgucccugcgcacgaccaccgugaccggcaagaucauccacgaguggugcugccggagcugcacgcugccgccccuccgcuucaagggggaggacggcugcugguacgggauggagauccggcccgugcgcgagaaggaggagaaccuggucaaguccauggugagcgccggcagcggcgagguggacuccuucagccucgggcugcugugcaucuccaucaugaucgaggaggucaugcggagccgcuggucccggaagaugcucaugaccggcacccuggccguguucuuccugcucaucauggggcagcugaccuggaacgaccugauccgcagcugcaucauggugggcgccaacgccuccgaccgcauggggaugggcacgaccuaccucgcgcugauggccaccuucaagaugcggccgauguucgccgucgggcugcuguuccgccggcugaccagccgcgaggugcugcuccugacgaucgggcugucccucgucgccagcguggagcugcccaacucccuggaggagcucggcgacgggcuggccaugggcaucaugauccugaagcuccugaccgacuuccagagcuaccagcugugggcgacccuccugucccugaccuucaucaagacgaccuucagccuccacuacgccuggaagaccauggccauggugcuguccaucgucagccugcucccccugugccuguccaccacgagccagaagaccaccuggcuccccgugcugcugggcucccucgggugcaagccgcugaccauguuccugaucgccgagaacaagaucuggggccggaaguccuggccccucaacgaggggaucauggcggugggcaucgucagcauccugcuguccagccuccugaagaacgacgugccccuggccgggccccucaucgccggcggcaugcugaucgccugcuacgugaucuccgggagcuccgccgaccugagccucgagaaggcggccgaggucuccugggaggaggaggccgagcacagcggcgccucccacaacauccugguggaggugcaggacgacgggacgaugaagaucaaggacgaggagcgcgacgacacccugaccauccuccugaaggccacccugcucgcggucagcggcguguacccgcuguccauccccgccacccuguucgugugguacuucuggcagaagaagaagcagcggagcgggguccucugggacacgcccagcccgcccgagguggagcgcgccgugcuggacgacggcaucuaccggaucaugcagcgcggccugcuggggcggagccaggucggcguggggguguuccaggagaacgucuuccacaccauguggcacgugacccgcggcgccgugcucauguaccaggggaagcggcuggagcccuccugggccagcgucaagaaggaccugaucuccuacggcggcggguggcgccuccagggcagcuggaacaccggggaggagguccaggugaucgcggucgagcccggcaagaaccccaagaacgugcagacggcccccgggaccuucaagacccccgagggcgaggugggcgccaucgcccuggacuucaagcccgggaccuccggcagccccaucgucaaccgggaggggaagaucgugggccuguacggcaacgggguggucacgaccagcggcaccuacguguccgccaucgcgcaggccaaggccagccaggaggggccgcuccccgagaucgaggacgagguguuccgcaagcggaaccugaccaucauggaccugcaccccggcuccgggaagacgcgccgguaccucccggccaucguccgcgaggcgaucaagcggaagcugcgcacccugauccucgcccccacccgcgugguggccagcgagauggccgaggcccugaagggcaugcccauccgguaccagaccacggcggucaaguccgagcacaccggccgcgagaucguggaccugaugugccacgccaccuucaccaugcggcuccugagccccgugcgcgucccgaacuacaacaugaucaucauggacgaggcccacuucacggaccccuccagcaucgccgcccggggguacaucuccacccgcgugggcaugggggaggcggccgccaucuucaugaccgccacgccgcccggcagcguggaggccuucccgcaguccaacgcggucauccaggacgaggagcgggacauccccgagcgcagcuggaacuccggguacgaguggaucacggacuuccccggcaagaccgugugguucgugcccagcaucaaguccggcaacgacaucgccaacugccugcggaagaacgggaagcgcgucauccagcucagccggaagaccuucgacaccgaguaccagaagacgaagaacaacgacugggacuacguggugaccaccgacaucuccgagaugggcgccaacuuccgcgccgaccgggucaucgacccgcgccggugccugaagcccgugauccugaaggacgggcccgagcgcgucauccucgcgggccccaugccggugaccguggccagcgccgcccagcggcgcgggcggaucggccgcaaccacaacaaggagggcgaccaguacaucuacauggggcagccccugaacaacgacgaggaccacgcccacuggacggaggcgaagaugcugcucgacaacaucaacacccccgagggcaucauccccgcccuguucgagccggagcgcgagaaguccgccgccaucgacggggaguaccggcugcgcggcgaggcccggaagaccuucgucgagcucaugcgccgcggggaccugcccguguggcugagcuacaagguggcgagcgagggcuuccaguacuccgaccgccgguggugcuucgacggcgagcgcaacaaccagguccucgaggagaacauggacguggagaucuggaccaaggagggggagcggaagaagcugcgcccccgguggcuggacgcccgcacguacagcgacccccucgcccugcgggaguucaaggaguucgccgccggccgccgguccgugagcggggaccugauccucgagaucggcaagcugccgcagcaccugacccagcgcgcgcagaacgcccucgacaaccuggucaugcugcacaacuccgagcagggcgggcgggccuaccgccacgccauggaggagcuccccgacaccaucgagacccugaugcugcucgcgcugaucgccgugcugacgggcggggugacccucuucuuccugagcggccgggggcugggcaagaccuccaucggccuccugugcgucauggccagcuccgcccugcucuggauggccagcguggagccccacuggaucgcggccuccaucauccuggaguucuuccugauggugcuccugauccccgagccggaccgccagcggacgccccaggacaaccagcuggccuacgucgugaucgggcuccuguucaugauccugaccguggccgccaacgagaugggccuccuggagacgaccaagaaggaccuggggaucggccacgucgcgguggagaaccaccaccacgccaccaugcucgacguggaccugcaccccgccagcgccuggacccuguacgccgucgcgacgaccaucaucaccccgaugaugcgccacaccaucgagaacacgaccgccaacaucucccucaccgccaucgccaaccaggccgcgauccugauggggcuggacaagggcuggcccaucagcaagauggacaucggcgugccccuccuggcccuggggugcuacucccaggugaacccccucacccugacggccgccguccugaugcucguggcgcacuacgccaucaucggcccggggcugcaggccaaggccacccgcgaggcccagaagcggaccgcggccggcaucaugaagaaccccaccguggacgggaucgucgccaucgaccuggaccccgugguguacgacgccaaguucgagaagcagcucggccagaucaugcugcugauccucugcacgagccagauccugcugaugcgcaccaccugggcccucugcgaguccaucacccuggcgacgggcccccugaccacccucugggaggggagcccgggcaaguucuggaacaccacgaucgccgucuccauggccaacaucuuccgggggagcuaccuggccggcgccggccuggcguucagccucaugaagucccucgggggcgggcgccgggggaccggggcccagggcgagacccugggcgagaaguggaagcgccagcucaaccagcugagcaaguccgaguucaacaccuacaagcggagcgggaucauggagguggaccgcuccgaggccaaggagggccugcggcgcggggagacgaccaagcacgccgugagccggggcaccgcgaagcuccgcugguucgucgagcggaaccuggugaagcccgaggggaaggugaucgaccugggcugcggccgcgggggcugguccuacuacugcgccgggcugaagaaggucaccgaggugaagggcuacacgaagggcgggcccggccacgaggagcccaucccgauggccaccuacggguggaaccucgugaagcugcacagcggcaaggacgucuucuucaucccgcccgagaagugcgacacccugcucugcgacaucggggaguccagccccaacccgaccaucgaggagggccggacgcugcgcgugcugaagaugguggagcccuggcuccgggggaaccaguucugcaucaagauccugaaccccuacaugcccuccgucguggagacccuggagcacaugcagcgcaagcacggcggcaugcucgugcggaacccgcugagccgcaacuccacccacgagauguacugggucagcugcgggaccggcaacaucguguccgccgugaacaugaccagccgcaugcugcucaaccgguucacgauggcccaccgcaagcccaccuacgagcgggacgucgaccugggggcgggcacccgccacguggccguggagcccgaggucgccaaccuggacaucaucggccagcggaucgagaacaucaagcacgagcacaaguccaccuggcacuacgacgaggacaaccccuacaagacgugggccuaccacgggagcuacgaggugaagccguccggcagcgccagcuccauggucaacgggguggugaagcuccugaccaagcccugggacgucauccccauggugacccagaucgcgaugaccgacacgacccccuucggccagcagcgcguguucaaggagaaggucgacacccggaccccgaaggccaagcgcgggacggcccagaucauggaggugaccgcccgguggcuguggggcuuccucagccgcaacaagaagccccggaucugcacccgcgaggaguucacccggaaggugcgcuccaacgccgcgaucggcgccgucuucguggacgagaaccaguggaacagcgccaaggaggccguggaggacgagcgguucugggaccugguccaccgcgagcgggagcugcacaagcaggggaagugcgcgacgugcguguacaacaugaugggcaagcgcgagaagaagcucggggaguucggcaaggccaaggggucccgggccaucugguacauguggcugggcgcccgcuuccuggaguucgaggcccucggcuucaugaacgaggaccacugguucagccgggagaacucccugagcgggguggagggcgaggggcugcacaagcucggcuacauccugcgcgacaucuccaagauccccgggggcaacauguacgcggacgacaccgccggcugggacacccgcaucaccgaggacgaccugcagaacgaggccaagaucacggacaucauggagccggagcacgcccuccuggccaccagcaucuucaagcugaccuaccagaacaaggucgugcgggugcagcgccccgcgaagaacgggaccgucauggacgugaucucccggcgcgaccagcggggcagcggccaggugggcacguacggccucaacaccuucaccaacauggaggcccagcugauccgccagauggaguccgaggggaucuucagccccuccgagcuggagacccccaaccucgccgagcggguccuggacuggcuggagaaguacggcguggagcgccucaagcggauggccaucagcggggacgacugcguggucaagccgaucgacgaccgcuucgccacggcgcugaccgcccugaacgacaugggcaaggugcggaaggacaucccccagugggagcccuccaagggguggaacgacuggcagcagguccccuucugcagccaccacuuccaccagcucaucaugaaggacggccgcgagaucgucgugccgugccggaaccaggacgagcuggugggccgcgcccgggucagccagggggccggcuggucccugcgcgagaccgccugccucggcaagagcuacgcgcagauguggcagcugauguacuuccaccggcgcgaccugcggcucgccgccaacgccaucugcuccgcggugcccguggacuggguccccaccagccgcacgaccugguccauccacgcccaccaccaguggaugaccaccgaggacaugcugagcguguggaaccgcguguggaucgaggagaaccccuggauggaggacaagacgcacaucuccagcuggggcgacgucccguaccuggggaagcgggaggaccaguggugcggcucccucaucggccugaccgcccgcgccaccugggccaccaacauccagguggcgaucaaccaggugcggcgccugaucgggaacgagaacuaccucgacuacaugaccagcaugaagcgguucaagaacgaguccgaccccgagggcgcccugugguga

SEQ ID NO: 8483 - RNA, 9879 nt, Artificial Sequence
  derived and/or modified CDS sequence (opt1) from DENV-1__GQ199775__SS-prME
agcgugaccaugcugcucaugcugaugcccaccgcccuggccuuccaccucaccacccggggcggggagccccacaugaucguguccaagcaggagcggggcaagagccugcuguucaagaccuccgccggggugaacaugugcacccucaucgccauggaccugggcgagcugugcgaggacaccaugaccuacaagugcccccggaucaccgagguggagcccgacgacguggacugcuggugcaacaccaccgacaccugggugaccuacgggaccugcagccagacgggcgagcaccggcgcgacaagcgguccguggcccucgcgccccacgucggccuggggcuggagacccgcgccgagaccuggaugagcuccgagggcgcguggaagcagauccagaagguggagaccugggcccuccggcaccccggguucacggugaucgcccuguuccuggcccacgcgaucggcaccagcaucacccagaaggggaucaucuucauccuccugaugcuggucacccccuccauggccaugcgcugcgugggcaucggcagccgggacuucguggaggggcucuccggcgccacgugggucgacguggugcuggagcacgggagcugcgucaccaccauggccaaggacaagcccacccuggacaucgagcuccugaagacggaggugaccaaccccgccgugcugcgcaagcucugcaucgaggcgaagaucuccaacaccaccacggacagccggugcccgacccagggcgaggccacccuggucgaggagcaggacgccaacuucgugugccgccggaccuucguggaccgcggcugggggaacggcugcgggcuguucggcaaggggucccucaucacgugcgccaaguucaagugcgucaccaagcuggagggcaagaucgugcaguacgagaaccugaaguacagcgugaucgucaccgugcacaccggcgaccagcaccaggucgggaacgaguccacggagcacggcaccaucgccaccaucacgccccaggcgcccaccagcgagauccagcucacggacuacggggcccugacccuggacugcagcccccggaccggccucgacuucaacgagauggugcugcugaccaugaaggagaaguccuggcucgugcacaagcagugguuccuggaccugccccuccccuggacgagcggggccuccaccagccaggagaccuggaaccgccaggaccugcuggucaccuucaagacggcccacgccaagaagcaggagguggugguccucggcucccaggagggcgcgaugcacaccgcccugaccggggccaccgagauccagacgaccggcaccaccacgaucuucgccgggcaccugaagugccggcucaagauggacaagcugacccugaagggcaugagcuacgugaugugcaccggguccuucaagcucgagaaggagguggccgagacccagcacggcacgguccuggugcagaucaaguacgagggcaccgacgcgcccugcaagauccccuucagcacccaggacgagaagggggugacccagaacggccgccugaucacggccaacccgaucgucaccgacaaggagaagcccgugaacaucgaggccgagccgcccuucggggaguccuacaucgugaucggcgccggcgagaaggcgcugaagcucagcugguucaagaagggguccagcaucggcaagauguucgaggccaccgcccgcggggcccgccggauggccauccugggcgacaccgcgugggacuucggguccaucggcggcgucuucacgagcguggggaagcuggugcaccagaucuucggcaccgccuacgggguccucuucuccggcgugagcuggaccaugaagaucgggaucggcgugcugcugaccuggcucggccugaacucccgcagcacgucccugagcaugaccugcaucgccgucgggcucaucacccuguaccugggcgugauggugcaggccgacuccgggugcgucaucaacuggaagggccgcgagcucaagugcgggagcggcaucuucgugaccaacgaggugcacacguggaccgagcaguacaaguuccaggccgacagcccgaagcggcuguccgcggccaucggcaaggccugggaggagggggucugcggcauccgcagcgccacccggcuggagaacaucauguggcgccagaucuccaacgagcucaaccacauccugcuggagaacgacaugaaguucaccgugguggucggggacguggugggcauccucgcccaggggaagaagaugguccggccccagcccauggagcacaaguacagcuggaaguccuggggcaaggcgaagaucaucggcgccgacgugcagaacaccacguucaucaucgacgggcccaacaccccggagugccccgacgaccagcgcgccuggaacaucugggagguggaggacuacggcuucgggaucuucaccaccaacaucuggcugaagcugcgggacagcuacacgcaggucugcgaccaccgccucauguccgccgcgaucaaggacagcaaggccgugcacgccgacaugggcuacuggaucgaguccgagaagaacgagaccuggaagcuggcccgggccagcuucaucgaggugaagaccugcaucuggcccaagucccacacccuguggagcaacggcguccucgaguccgagaugaucauccccaagaucuacgggggcccgaucagccagcacaacuaccgccccggguacuucacgcagaccgcgggccccuggcaccuggggaagcuggagcucgacuucgaccugugcgagggcaccaccgugguggucgacgagcacugcggcaaccgggggccgucccugcgcacgaccaccgugaccggcaagaucauccacgaguggugcugccggagcugcacgcugccgccccuccgcuucaagggggaggacggcugcugguacgggauggagauccggcccgugcgcgagaaggaggagaaccuggucaaguccauggugagcgccggcagcggcgagguggacuccuucagccucgggcugcugugcaucuccaucaugaucgaggaggucaugcggagccgcuggucccggaagaugcucaugaccggcacccuggccguguucuuccugcucaucauggggcagcugaccuggaacgaccugauccgcagcugcaucauggugggcgccaacgccuccgaccgcauggggaugggcacgaccuaccucgcgcugauggccaccuucaagaugcggccgauguucgccgucggccugcuguuccgccggcugaccagccgcgaggugcugcuccugacgaucgggcugucccucgucgccagcguggagcugcccaacucccuggaggagcucggcgacgggcuggccaugggcaucaugauccugaagcuccugaccgacuuccagagcuaccagcugugggcgacccuccugucccugaccuucaucaagacgaccuucagccuccacuacgccuggaagaccauggccauggugcuguccaucgucagccugcucccccugugccuguccaccacgagccagaagaccaccuggcuccccgugcugcugggcucccucgggugcaagccgcugaccauguuccugaucgccgagaacaagaucuggggccggaaguccuggccccucaacgaggggaucauggcggugggcaucgucagcauccugcuguccagccuccugaagaacgacgugccccuggccgggccccucaucgccggcggcaugcugaucgccugcuacgugaucuccgggagcuccgccgaccugagccucgagaaggcggccgaggucuccugggaggaggaggccgagcacagcggcgccucccacaacauccugguggaggugcaggacgacgggacgaugaagaucaaggacgaggagcgcgacgacacccugaccauccuccugaaggccacccugcucgcggucagcggcguguacccgcuguccauccccgccacccuguucgugugguacuucuggcagaagaagaagcagcggagcgggguccucugggacacgcccagcccgcccgagguggagcgcgccgugcuggacgacggcaucuaccggaucaugcagcgcggccugcuggggcggagccaggucggcguggggguguuccaggagaacgucuuccacaccauguggcacgugacccgcggcgccgugcucauguaccaggggaagcggcuggagcccuccugggccagcgucaagaaggaccugaucuccuacggcggcggguggcgccuccagggcagcuggaacaccggggaggagguccaggugaucgcggucgagcccggcaagaaccccaagaacgugcagacggcccccgggaccuucaagacccccgagggcgaggugggcgccaucgcccuggacuucaagcccgggaccuccggcagccccaucgucaaccgggaggggaagaucgugggccuguacggcaacgggguggucacgaccagcggcaccuacguguccgccaucgcgcaggccaaggccagccaggaggggccgcuccccgagaucgaggacgagguguuccgcaagcggaaccugaccaucauggaccugcaccccggcuccgggaagacgcgccgguaccucccggccaucguccgcgaggcgaucaagcggaagcugcgcacccugauccucgcccccacccgcgugguggccagcgagauggccgaggcccugaagggcaugcccauccgguaccagaccacggcggucaaguccgagcacaccggccgcgagaucguggaccugaugugccacgccaccuucaccaugcggcuccugagccccgugcgcgucccgaacuacaacaugaucaucauggacgaggcccacuucacggaccccuccagcaucgccgcccggggguacaucuccacccgcgugggcaugggggaggcggccgccaucuucaugaccgccacgccgcccggcagcguggaggccuucccgcaguccaacgcggucauccaggacgaggagcgggacauccccgagcgcagcuggaacuccggguacgaguggaucacggacuuccccggcaagaccgugugguucgugcccagcaucaaguccggcaacgacaucgccaacugccugcggaagaacgggaagcgcgucauccagcucagccggaagaccuucgacaccgaguaccagaagacgaagaacaacgacugggacuacguggugaccaccgacaucuccgagaugggcgccaacuuccgcgccgaccgggucaucgacccgcgccggugccugaagcccgugauccugaaggacgggcccgagcgcgucauccucgcgggccccaugccggugaccguggccagcgccgcccagcggcgcgggcggaucggccgcaaccacaacaaggagggcgaccaguacaucuacauggggcagccccugaacaacgacgaggaccacgcccacuggacggaggcgaagaugcugcucgacaacaucaacacccccgagggcaucauccccgcccuguucgagccggagcgcgagaaguccgccgccaucgacggggaguaccggcugcgcggcgaggcccggaagaccuucgucgagcucaugcgccgcggggaccugcccguguggcugagcuacaagguggcgagcgagggcuuccaguacuccgaccgccgguggugcuucgacggcgagcgcaacaaccagguccucgaggagaacauggacguggagaucuggaccaaggagggggagcggaagaagcugcgcccccgguggcuggacgcccgcacguacagcgacccccucgcccugcgggaguucaaggaguucgccgccggccgccgguccgugagcggggaccugauccucgagaucggcaagcugccgcagcaccugacccagcgcgcgcagaacgcccucgacaaccuggucaugcugcacaacuccgagcagggcgggcgggccuaccgccacgccauggaggagcuccccgacaccaucgagacccugaugcugcucgcgcugaucgccgugcugacgggcggggugacccucuucuuccugagcggccgggggcugggcaagaccuccaucggccuccugugcgucauggccagcuccgcccugcucuggauggccagcguggagccccacuggaucgcggccuccaucauccuggaguucuuccugauggugcuccugauccccgagccggaccgccagcggacgccccaggacaaccagcuggccuacgucgugaucgggcuccuguucaugauccugaccguggccgccaacgagaugggccuccuggagacgaccaagaaggaccuggggaucggccacgucgcgguggagaaccaccaccacgccaccaugcucgacguggaccugcaccccgccagcgccuggacccuguacgccgucgcgacgaccaucaucaccccgaugaugcgccacaccaucgagaacacgaccgccaacaucucccucaccgccaucgccaaccaggccgcgauccugauggggcuggacaagggcuggcccaucagcaagauggacaucggcgugccccuccuggcccuggggugcuacucccaggugaacccccucacccugacggccgccguccugaugcucguggcgcacuacgccaucaucggcccggggcugcaggccaaggccacccgcgaggcccagaagcggaccgcggccggcaucaugaagaaccccaccguggacgggaucgucgccaucgaccuggaccccgugguguacgacgccaaguucgagaagcagcucggccagaucaugcugcugauccucugcacgagccagauccugcugaugcgcaccaccugggcccucugcgaguccaucacccuggcgacgggcccccugaccacccucugggaggggagcccgggcaaguucuggaacaccacgaucgccgucuccauggccaacaucuuccgggggagcuaccuggccggcgccggccuggcguucagccucaugaagucccucgggggcgggcgccgggggaccggggcccagggcgagacccugggcgagaaguggaagcgccagcucaaccagcugagcaaguccgaguucaacaccuacaagcggagcgggaucauggagguggaccgcuccgaggccaaggagggccugcggcgcggggagacgaccaagcacgccgugagccggggcaccgcgaagcuccgcugguucgucgagcggaaccuggugaagcccgaggggaaggugaucgaccugggcugcggccgcgggggcugguccuacuacugcgccgggcugaagaaggucaccgaggugaagggcuacacgaagggcgggcccggccacgaggagcccaucccgauggccaccuacggguggaaccucgugaagcugcacagcggcaaggacgucuucuucaucccgcccgagaagugcgacacccugcucugcgacaucggggaguccagccccaacccgaccaucgaggagggccggacgcugcgcgugcugaagaugguggagcccuggcuccgggggaaccaguucugcaucaagauccugaaccccuacaugcccuccgucguggagacccuggagcacaugcagcgcaagcacggcggcaugcucgugcggaacccgcugagccgcaacuccacccacgagauguacugggucagcugcgggaccggcaacaucguguccgccgugaacaugaccagccgcaugcugcucaaccgguucacgauggcccaccgcaagcccaccuacgagcgggacgucgaccugggggcgggcacccgccacguggccguggagcccgaggucgccaaccuggacaucaucggccagcggaucgagaacaucaagcacgagcacaaguccaccuggcacuacgacgaggacaaccccuacaagacgugggccuaccacgggagcuacgaggugaagccguccggcagcgccagcuccauggucaacgggguggugaagcuccugaccaagcccugggacgucauccccauggugacccagaucgcgaugaccgacacgacccccuucggccagcagcgcguguucaaggagaaggucgacacccggaccccgaaggccaagcgcgggacggcccagaucauggaggugaccgcccgguggcuguggggcuuccucagccgcaacaagaagccccggaucuggacccgcgaggaggugacccggaagguccgcuccaacgccggcaucggggcgggcgugggggacgagaaccaguggaacagcgccaagaagggcguggaggacgagcgguucugggaccugguccaccgcgagcgggagcugcacaagcaggggaagugcgccacgugcguguacaacaugaugggcaagcgcgagaagaagcucggcgaguucgggaaggccaagggcucccgggcgaucugguacauguggcugggggcccgcuuccuggaguucgaggcccucggcuucaugaacgaggaccacugguucagccgggagaacucccugagcgggguggagggcgagggccugcacaagcucggguacauccugcgcgacaucuccaagauccccggcgggaacauguacgccgacgacaccgccggcugggacacccgcaucaccgaggacgaccugcagaacgaggcgaagaucacggacaucauggagccggagcacgcccuccuggccaccagcaucuucaagcugaccuaccagaacaaggucgugcgggugcagcgccccgccaagaacggcaccgucauggacgugaucucccggcgcgaccagcgggggagcggccagguggggacguacggccucaacaccuucaccaacauggaggcccagcugauccgccagauggaguccgaggggaucuucagccccuccgagcuggagacccccaaccucgcggagcggguccuggacuggcuggagaaguacggcguggagcgccucaagcggauggccaucagcggcgacgacugcguggucaagccgaucgacgaccgcuucgccacggcccugaccgcccugaacgacauggggaaggugcggaaggacaucccccagugggagcccuccaagggcuggaacgacuggcagcagguccccuucugcagccaccacuuccaccagcucaucaugaaggacgggcgcgagaucgucgugccgugccggaaccaggacgagcuggugggccgcgcgcgggucagccagggggccggcuggucccugcgcgagaccgccugccucggcaagagcuacgcccagauguggcagcugauguacuuccaccggcgcgaccugcggcucgccgcgaacgccaucugcuccgccgugcccguggacuggguccccaccagccgcacgaccugguccauccacgcccaccaccaguggaugaccaccgaggacaugcugagcguguggaaccgcguguggaucgaggagaaccccuggauggaggacaagacgcacaucuccagcuggggcgacgucccguaccugggcaagcgggaggaccaguggugcgggucccucaucggccugaccgcgcgcgccaccugggccaccaacauccagguggccaucaaccaggugcggcgccugaucgggaacgagaacuaccucgacuacaugaccagcaugaagcgguucaagaacgaguccgaccccgagggcgcccugugguga

SEQ ID NO: 8484 - RNA, 9876 nt, Artificial Sequence
  derived and/or modified CDS sequence (opt1) from DENV-1__FJ882546__SS-prME
agcgugaccaugcugcucaugcugaugcccaccgcccuggccuuccaccucaccacccgcggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccgcaucaccgaggccgagcccgacgacguggacugcuggugcaacgccaccgacacgugggugaccuacgggaccugcagccagaccggcgagcaccggcgcgacaagcgguccguggcccucgcgccccacgugggccuggggcuggagacgcgcaccgagaccuggaugagcuccgagggcgccuggaagcagauccagcggguggagaccugggcccuccgccaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcggugcugcggaagcucugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacaccggcgaccagcaccagguggggaacgaguccacggagcacggcaccaccgcgaccaucacgccccaggcccccacgaccgagauccagcucaccgacuacggggcccugacccuggacugcagcccccgcacgggccucgacuucaacgagaugguccugcugaccaugaaggagaaguccuggcucgugcacaagcagugguuccuggaccugccccuccccuggaccagcggggccagcaccucccaggagacguggaaccggcaggaccugcuggugaccuucaagaccgcccacgcgaagaagcaggaggucguggugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgucaugugcaccggguccuucaagcucgagaaggagguggcggagacgcagcacggcaccgugcugguccagaucaaguacgagggcaccgacgcccccugcaagauccccuucagcacccaggacgagaagggggugacgcagaacggccggcugaucaccgccaacccgaucgugaccgacaaggagaagcccgucaacaucgaggccgagccgcccuucggggaguccuacaucgugaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcgucgggaagcuggugcaccagaucuucggcaccgccuacgggguccucuucuccggcgucagcuggaccaugaagaucgggaucggcgugcugcugacguggcucggccugaacucccgcagcaccucccugagcaugaccugcaucgccguggggcucgucacccuguaccugggcgugauggugcaggccgacuccgggugcgucaucaacuggaagggccgggagcucaagugcgggagcggcaucuucgugacgaacgaggugcacaccuggaccgagcaguacaaguuccaggcggacagcccgaagcgccuguccgccgccaucggcaaggccugggaggagggggucugcggcauccggagcgccacccgccuggagaacaucauguggaagcagaucuccaacgagcucaaccacauccugcuggagaacgacaugaagcucaccgugguggucggggacguggcgggcauccuggggcagggcaagaagaugauccggccccagcccauggaguacaaguacagcuggaaguccuggggcaaggccaagaucaucggggccgacgcccagaacacgaccuucaucaucgacggccccaacaccccggagugccccgacgaccagcgcgcguggaacaucugggagguggaggacuacggguucggcaucuucaccacgaacaucuggcugaagcuccgggacagcuacacccaggucugcgaccaccgccugauguccgccgccaucaaggacagcaaggccgugcacgccgacaugggcuacuggaucgaguccgagaagaacgagaccuggaagcuggcgcgggccagcuucaucgaggugaagaccugcaucuggcccaagucccacacgcucuggagcaacgggguccuggaguccgagaugaucauccccaagaucuacggcgggccgaucagccagcacaacuaccgccccggcuacuucacccagaccgccgggcccuggcaccugggcaagcucgagcuggacuucgaccugugcgagggcaccacggugguggucgacgagcacugcgggaaccggggcccgucccuccgcaccaccaccgugacggggaagaucauccacgaguggugcugccggagcugcacccugccgccccugcgcuuccggggcgaggacgggugcugguacggcauggagauccgccccgugaaggagaaggaggagaaccucgucaaguccauggugagcgccggcagcggggagguggacuccuucagccugggccugcucugcaucuccaucaugaucgaggaggucaugcggagccgcuggucccggaagaugcugaugaccgggacccuggccguguucuuccuccugaucaugggccagcugacguggaacgaccucauccgccugugcaucauggugggggcgaacgccagcgaccgcaugggcaugggcaccaccuaccuggcccucauggccaccuucaagaugcggccgauguucgccgucgggcugcuguuccgccggcucacgucccgcgaggugcugcugcucaccaucgggcugagccugguggcguccgucgagcuccccaacagccuggaggagcugggggacggccucgccaugggcaucaugauccugaagcugcucaccgacuuccagucccaccagcugugggccacccugcucagccugacguucaucaagaccaccuucucccugcacuacgccuggaagaccauggcgauggugcucagcaucgucucccuguucccccugugccucagcacgaccucccagaagaccaccuggcugcccgugcugcucgggagccugggcugcaagccgcugacgauguuccucaucgccgagaacaagaucugggggcggaaguccuggccccugaacgagggcaucauggccguggggaucgucagcauccugcucagcucccugcugaagaacgacgugccccucgccggcccccugaucgccggcgggaugcugaucgcgugcuacgugaucagcggcuccagcgccgaccucucccuggagaaggccgccgaggucagcugggaggaggaggccgagcacuccggggcgagccacaacauccugguggaggugcaggacgacggcaccaugaagaucaaggacgaggagcgcgacgacacccucaccauccugcugaaggccacccuccuggccgucuccgggguguacccgcugagcauccccgccacccucuucgugugguacuucuggcagaagaagaagcagcgguccggcguccugugggacacccccagcccgcccgagguggagcgcgccgugcuggacgacggcaucuaccggaucaugcagcgcgggcugcucggccggucccaggucggggugggcguguuccaggagaacgucuuccacaccauguggcacgugacccgcggggcggugcugauguaccagggcaagcggcuggagcccagcugggccuccgucaagaaggaccucaucagcuacggcgggggcuggcgccugcggggguccuggaacacgggcgaggagguccaggugaucgccgucgagcccgggaagaaccccaagaacgugcagaccgcccccggcaccuucaagacccccgagggcgaggugggggccaucgcgcuggacuucaagcccggcacgagcgggucccccaucgucaaccgcgagggcaagaucgugggccucuacgggaacggcguggucaccaccagcgggaccuacgugagcgccaucgcccaggccaaggcgucccaggagggcccgcugcccgagaucgaggacgagguguuccggaagcgcaaccugacgaucauggaccuccaccccgggagcggcaagacccggcgcuaccugccggccaucguccgggaggccaucaagcgcaagcugcgcacccucauccuggcccccacccgggugguggccuccgagauggcggaggcccugaagggcaugcccauccgcuaccagacgaccgccgucaagagcgagcacaccgggaaggagaucguggaccucaugugccacgccaccuucacgaugcggcugcugucccccgugcgcgucccgaacuacaacaugaucaucauggacgaggcccacuucaccgaccccagcuccaucgcggcccggggcuacaucagcacccgcguggggaugggcgaggccgccgccaucuucaugaccgcgacgccgcccggguccguggaggccuucccgcagagcaacgccgucauccaggacgaggagcgggacauccccgagcgcuccuggaacagcggcuacgaguggaucaccgacuuccccggcaagaccgugugguucgugcccuccaucaagagcgggaacgacaucgccaacugccuccggaagaacggcaagcgcgucauccagcugucccggaagaccuucgacacggaguaccagaagaccaagaacaacgacugggacuacguggugaccaccgacaucagcgagaugggggcgaacuuccgcgccgaccgggucaucgacccgcgccggugccugaagcccgugauccucaaggacggccccgagcgcgugauccuggccgggcccaugccggucacgguggccuccgccgcgcagcggcgcggccggaucggccgcaaccacaacaaggagggggaccaguacaucuacaugggccagccccugaacaacgacgaggaccacgcccacuggaccgaggccaagaugcuccuggacaacaucaacacccccgaggggaucauccccgcccuguucgagccggagcgcgagaaguccgccgcggucgacggcgaguaccggcuccgcggggaggcccggaagaccuucguggagcugaugcgccggggcgaccugcccguguggcucuccuacaaggucgccagcgagggcuuccaguacagcgaccgccgguggugcuucgacggggagcgcaacaaccaggugcuggaggagaacauggacguggagaucuggacgaaggagggcgagcggaagaagcugcgcccccgguggcucgacgcccgcaccuacuccgacccccuggcccugcgggaguucaaggaguucgcggccgggcgcaagagcgucuccggcgaccucauccuggagaucggcaagcugccgcagcaccucacccagcgggcccagaacgcccuggacaaccuggugaugcuccacaacagcgagcagggcgggcgcgcguaccggcacgccauggaggagcugcccgacaccaucgagacgcugaugcuccuggcccugaucgccgugcucaccgggggcgucacccuguucuuccuguccgggcgcggccucggcaagaccagcaucgggcugcugugcgugauggccuccagcgugcuccuguggauggcguccgucgagccccacuggaucgccgccagcaucauccuggaguucuuccucauggugcugcugauccccgagccggaccggcagcgcacgccccaggacaaccagcucgccuacguggucaucggccugcuguucaugauccucacgguggccgcgaacgagauggggcugcuggagaccaccaagaaggaccucggcaucgggcacguggccgucgagaaccaccaccacgccgccaugcuggacguggaccugcaccccgccuccgcguggacccucuacgccguggccacgaccaucaucaccccgaugaugcggcacaccaucgagaacacgaccgccaacaucagccugaccgccaucgcgaaccaggccgccauccugaugggccucgacaagggcuggcccaucuccaagauggacaucggggucccccugcuggcccucggcugcuacagccaggugaacccccugacccugacggcggccgugcucaugcuggucgcccacuacgccaucaucgggccgggccugcaggccaaggcgacccgcgaggcccagaagcgcaccgccgccgggaucaugaagaaccccaccguggacggcaucguggccaucgaccucgaccccgucguguacgacgcgaaguucgagaagcagcugggccagaucaugcugcucauccugugcacgucccagauccugcucaugcggaccaccugggcccugugcgagagcaucacccuggccacggggccccucaccacccugugggagggcuccccggggaaguucuggaacaccacgaucgccgugagcauggccaacaucuuccgcggcuccuaccuggcgggcgccgggcucgccuucagccugaugaagucccugggcgggggccggcgcgggaccggcgcccagggcgagacccucggggagaaguggaagcggcagcugaaccagcuguccaagagcgaguucaacaccuacaagcgcuccggcaucauggaggucgaccggagcgaggcgaaggaggggcucaagcgcggcgagacgaccaagcacgccgugucccgggggaccgccaagcugcgcugguucguggagcggaaccuggucaagcccgagggcaaggugaucgaccugggcugcgggcgcggcggguggagcuacuacugcgccggccucaagaaggugaccgaggucaagggguacacgaagggcggccccgggcacgaggagcccaucccgauggccaccuacggcuggaaccuggugaagcugcacuccgggaaggacguguucuucaucccgcccgagaagugcgacacccuccugugcgacaucggcgagagcucccccaacccgaccaucgaggaggggcggacgcugcgcguccucaagaugguggagcccuggcugcggggcaaccaguucugcaucaagauccugaaccccuacaugcccagcguggucgagacccucgagcagaugcagcgcaagcacggcgggaugcuggugcggaacccgcugucccgcaacagcacccacgagauguacuggguguccugcggcaccgggaacaucgucagcgcggugaacaugaccucccggaugcuccugaaccgcuucacgauggcccaccgcaagcccaccuacgagcgggacguggaccugggcaccggcacccgccacgucgccguggagcccgagguggccaaccucgacaucaucgggcagcggaucgagaacaucaagcacgagcacaagagcacguggcacuacgacgaggacaaccccuacaagaccugggccuaccacggcuccuacgaggucaagccgagcggguccgcgagcagcauggugaacggcgucgugaagcugcugaccaagcccugggacgugauccccauggucacccagaucgccaugacggagcuccaccuggggcagcagcgcguguucaaggagaagguggacacccggacgccccgcgccaagcggggcaccgcccagaucauggagaugacggcccgcuggcuguggggcuuccucucccggaacaagaucccgcgcaucugcacccgggaggaguucacccgcaagguccggagcaacgcggccaucggggccguguucguggacgagaaccaguggaacuccgccaaggaggcggucgaggacgagcgcuucugggaccuggugcaccgggagcgcgagcugcacaagcagggcaagugcgcgaccugcguguacaacaugauggggaagcgggagaagaagcucggcgaguucgggaaggccaagggcagccgcgccaucugguacauguggcugggcgcccgguuccuggaguucgaggcgcucggguucaugaacgaggaccacugguucucccgcgagaacagccuguccggcgucgagggggagggccugcacaagcucggguacauccugcgggacaucagcaagauccccggcggcaacauguacgccgacgacacggccgggugggacacccgcaucaccgaggacgaccugcagaacgaggccaagaucaccgacaucauggagcccgagcacgcccuccuggcgaaggccaucuucaagcugacguaccagaacaagguggugcgcguccagcggccggccaagaacggcaccgugauggacgugaucucccgccgggaccagcgcgggagcggccaggucggcaccuacgggcucaacaccuucacgaacauggaggcccagcugauccggcagauggaguccgaggagaucuucagccccuccgagcuggagacccccaaccucgccgagcgcgcgcuggacuggcuggagaaguacggcguggagcggcucaagcgcauggccaucagcggggacgacugcguggucaagcccaucgacgaccgguucgccaccgcccugaccgcccugaacgacaugggcaaggugcgcaaggacaucccgcagugggagcccuccaagggguggaacgacuggcagcagguccccuucugcagccaccacuuccaccagcucaucaugaaggacggccgggagaucgucgugcccugccgcaaccaggacgagcuggugggccgggcgcgcgucucccagggggccggcuggagccugcgggagacggccugccucggcaagagcuacgcccagauguggcagcugauguacuuccaccgccgggaccugcgccucgcggccaacgccaucugcuccgccgugccgguggacuggguccccaccagccggaccaccugguccauccacgcccaccaccaguggaugacgaccgaggacaugcugagcguguggaaccgcguguggaucgaggagaaccccuggauggaggacaagacccacaucuccagcugggaggacguccccuaccugggcaagcgcgaggaccaguggugcgggucccucaucggccugaccgcgcgggccacgugggccaccaacauccagguggccaucaaccaggugcgccggcugaucggcaacgagaacuaccucgacuacaugaccagcaugaagcgcuucaagaacgaguccgacccggagggggcccugugguga

SEQ ID NO: 8485 - RNA, 9879 nt, Artificial Sequence
  derived and/or modified CDS sequence (opt1) from DENV-1__KF921935__SS-prME
agcgugaccaugcugcugaugcugaugcccaccgcccuggccuuccaccucaccacccggggcggggagccccacaugaucgugagcaagcaggagcggggcaagagccugcuguucaagaccuccgccggggugaacaugugcacccucaucgccauggaccugggcgagcugugcgaggacaccaugaccuacaagugcccccggaucaccgagaccgagcccgacgacguggacugcuggugcaacgccacggacaccugggugaccuacgggaccugcagccagacgggcgagcaccggcgggacaagcgguccguggcccucgcgccccacgugggccuggggcuggagacccgcaccgagaccuggaugagcuccgagggcgcguggaagcagauccagcgggucgagacgugggcccuccggcaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagguggccgagacccagcacggcaccgugcugguccagaucaaguacgagggcaccgacgcgcccugcaagauccccuuccugacgcaggacgagaagggggugacccagaacggccggcugaucaccgccaacccgaucgugaccgacaaggagaagcccgucaacaucgaggccgagccgcccuucggggagagcuacaucaucaucggcgccggcgagaaggcgcucaagcuguccugguucaagaaggggagcuccaucggcaagauguucgaggccacggcccgcggggcccggcgcauggccauccugggcgacaccgcgugggacuucgggagcaucggcggcguguucaccuccguggggaagcucguccaccagaucuucggcaccgccuacggggugcuguucagcggcguguccuggacgaugaagaucgggaucggcguccugcucaccuggcugggccugaacagccgcuccaccagccucuccaugaccugcaucgccguggggcuggugacgcuguaccucggcgucauggugcaggccgacagcgggugcgugaucaacuggaagggccgggagcugaagugcggguccggcaucuucgucaccaacgaggugcacaccuggaccgagcaguacaaguuccaggccgacagcccgaagcgccugagcgcggccaucggcaaggccugggaggagggggugugcggcauccgguccgccacccgccucgagaacaucauguggaagcagaucagcaacgagcugaaccacauccugcucgagaacgacaugaaguucacggucguggugggggacgucgccggcauccuggcgcaggggaaggagaugauccggccccagcccauggaguacaaguacuccuggaaguccuggggcaaggccaagaucaucggcgccgacgugcagaacaccaccuucaucaucgacgggcccaacaccccggagugccccgacgaccagcgcgccuggaacaucugggagguggaggacuacggcuucgggaucuucacgaccaacaucuggcugaagcuccgggacucccacacccaggucugcgaccaccgccugaugagcgcggccaucaaggacuccaaggccgugcacgccgacaugggcuacuggaucgagagcgagaagaacgagaccuggaagcuggcccgggcguccuucaucgaggugaagacgugcaucuggcccaagagccacacccucugguccaacggcguccuggagagcgagaugaucauccccaagaucuacgggggcccgaucucccagcacaacuaccgccccggguacuucacccagaccgccggccccuggcaccuggggaagcucgagcuggacuucgaccugugcgagggcacgaccgugguggucgacgagcacugcggcaaccgggggccgagccuccgcaccaccacggugaccggcaagaucauccacgaguggugcugccgguccugcacccugccgccccugcgcuuccgcggggaggacggcugcugguacgggauggagauccgccccgugaaggagaaggaggagaaccucgucaagagcaugguguccgccggcagcggcgagguggacagcuucucccuggggcugcucugcaucagcaucaugaucgaggaggucaugcggucccgcuggagccggaagaugcugaugaccggcacgcuggccguguucuuccuccugaucauggggcagcugaccuggaacgaccucauccgccugugcaucauggugggcgccaacgcguccgaccgcauggggaugggcaccaccuaccuggcccucauggccacguucaagaugcggccgauguucgccgucggccugcuguuccgccggcucaccagccgcgaggugcugcugcucaccaucgggcugucccugguggccagcgucgagcuccccaacucccuggaggagcugggcgacgggcucgcgaugggcaucaugauccugaagcugcucaccgacuuccagagccaccagcugugggccacgcugcucucccugaccuucaucaagaccaccuucagccugcacuacgccuggaagacgauggccauggugcucuccaucgucagccuguucccccugugccucuccaccaccagccagaagaccacguggcugcccgugcugcucggcucccuggggugcaagccgcugaccauguuccucaucgcggagaacaagaucuggggccggcgcagcuggccccugaacgaggggaucauggccgugggcaucgucuccauccugcucagcagccugcugaagaacgacgugccccucgccgggccccugaucgccggcggcaugcugaucgccugcuacgugaucuccgggagcuccgcggaccucagccuggagaaggccgccgaggucuccugggaggaggaggccgagcacagcggcgccucccacaacauccugguggaggugcaggacgacgggaccaugaagaucaaggacgaggagcgggacgacacccucaccauccugcugaaggcgacgcuccuggccgucagcggcguguacccgcuguccauccccgccacccucuucgugugguacuucuggcagaagaagaagcagcgcagcgggguccugugggacacccccagcccgcccgagguggagcgggccgugcuggacgacggcaucuaccgcaucaugcagcggggccugcucgggcgcagccaggucggcguggggguguuccaggagaacgucuuccacaccauguggcacgugacgcggggcgccgugcugauguaccaggggaagcgccuggagcccuccugggcgagcgucaagaaggaccucaucuccuacggcggcggguggcggcugcagggcagcuggaacaccggggaggagguccaggugaucgccgucgagcccggcaagaaccccaagaacgugcagaccgcccccgggaccuucaagacgcccgagggcgaggugggcgccaucgcccuggacuucaagcccgggaccuccggcagccccaucgucaaccgcgaggggaagaucgugggccucuacggcaacgggguggucaccaccuccggcacguacgugagcgcgaucgcccaggccaaggccagccaggaggggccgcugcccgagaucgaggacgagguguuccggaagcgcaaccugaccaucauggaccuccaccccggcuccgggaagacccggcgcuaccugccggcgaucguccgggaggccaucaagcgcaagcugcgcacccucauccuggcccccacgcgggugguggccagcgagauggccgaggcgcugaagggcaugcccauccgcuaccagaccaccgccgucaaguccgagcacaccggcaaggagaucguggaccucaugugccacgccacguucaccaugcggcugcugagccccgugcgcgucccgaacuacaacaugaucaucauggacgaggcccacuucaccgaccccuccagcaucgccgcgcggggguacaucuccacccgcgugggcaugggggaggccgccgccaucuucaugacggccacgccgcccggcagcguggaggcguucccgcaguccaacgccgucauccaggacgaggagcgggacauccccgagcgcagcuggaacuccggguacgaguggaucaccgacuuccccggcaagaccgugugguucgugcccagcaucaaguccggcaacgacaucgccaacugccuccggaagaacgggaagcgcgucauccagcugagccggaagacguucgacaccgaguaccagaagaccaagaacaacgacugggacuacguggugaccacggacaucuccgagaugggcgccaacuuccgcgcggaccgggucaucgacccgcgccggugccugaagcccgugauccucaaggacgggcccgagcgcgugauccuggccggccccaugccggucaccguggccagcgccgcccagcggcgcgggcggaucggccgcaaccacaacaaggagggcgaccaguacaucuacauggggcagccccugaacaacgacgaggaccacgcgcacuggaccgaggccaagaugcuccuggacaacaucaacacccccgagggcaucauccccgcccuguucgagccggagcgcgagaaguccgccgccaucgacggggaguaccggcuccgcggcgaggcgcggaagacguucgucgagcugaugcgccgcggggaccugcccguguggcucagcuacaagguggccuccgagggcuuccaguacagcgaccgccgguggugcuucgacggcgagcgcaacaaccagguccuggaggagaacauggacguggagaucuggaccaaggagggggagcggaagaagcugcgcccccgguggcucgacgcccgcaccuacagcgacccccuggcccugcgggaguucaaggaguucgccgcgggccgccgguccgugagcggggaccucauccuggagaucggcaagcugccgcagcaccucacccagcgcgcccagaacgcccuggacaaccuggucaugcuccacaacuccgagcagggcgggcgggccuaccgccacgcgauggaggagcugcccgacacgaucgagacccugaugcuccuggcccugaucgccgugcucaccggcggggugacccuguucuuccugagcggccgggggcucggcaagaccuccaucggccugcugugcgucauggccagcuccgugcuccuguggauggccagcguggagccccacuggaucgcggccuccaucauccuggaguucuuccucaugguccugcugauccccgagccggaccgccagcggacgccccaggacaaccagcucgccuacguggugaucgggcugcuguucaugauccucaccgucgccgccaacgagaugggccugcuggagaccaccaagaaggaccucgggaucggccacguggcgguggagaaccaccaccacgccgccaugcuggacgucgaccugcaccccgccagcgccuggacgcucuacgcgguggccaccaccaucaucaccccgaugaugcgccacacgaucgagaacaccaccgccaacaucucccugaccgccaucgccaaccaggcggccauccugauggggcucgacaagggcuggcccaucagcaagauggacaucggcgugccccugcuggcccucgggugcuacucccaggucaacccccugacgcugaccgccgcggugcucaugcugguggcccacuacgccaucaucggcccggggcugcaggccaaggccacccgcgaggcgcagaagcggaccgccgccggcaucaugaagaaccccacggucgacgggaucguggccaucgaccucgaccccguggucuacgacgccaaguucgagaagcagcugggccagaucaugcugcucauccugugcaccagccagauccugcucaugcgcaccaccugggcgcugugcgaguccaucacgcuggccaccggcccccucaccacccugugggaggggagcccgggcaaguucuggaacacgaccaucgccguguccauggccaacaucuuccgggggagcuaccuggccggcgcgggccucgccuucucccugaugaagucccucgggggcgggcgccgggggaccggggcccagggcgagacccucggcgagaaguggaagcgccagcugaaccagcugagcaaguccgaguucaacacguacaagcggagcgggaucauggagguggaccgcuccgaggccaaggagggccucaagcgcggggagaccaccaagcacgcggucagccgcggcaccgccaagcugcggugguucguggagcgcaaccuggugaagcccgaggggaaggucaucgaccugggcugcggccgcggcgggugguccuacuacugcgccgggcucaagaaggugacggaggugaagggguacaccaagggcggccccggccacgaggagcccaucccgauggccaccuacggguggaaccuggucaagcugcacagcggcaaggacguguucuucaucccgcccgagaagugcgacacccuccugugcgacaucggggaguccagccccaacccgacgaucgaggagggccgcacccugcgggugcucaagauggucgagcccuggcugcgcgggaaccaguucugcaucaagauccugaaccccuacaugcccuccgugguggagacccucgagcagaugcagcggaagcacggcggcaugcugguccgcaacccgcugagccggaacuccacccacgagauguacugggugagcugcgggaccggcaacaucguguccgccgucaacaugacgagccgcaugcuccugaaccgcuucaccauggcgcaccggaagcccaccuacgagcgcgacguggaccugggggccggcacccggcacguggccgucgagcccgagaucgccaaccucgacaucaucggccagcgcaucgagaacaucaagcacgagcacaaguccacguggcacuacgacgaggacaaccccuacaagaccugggccuaccacgggagcuacgaggugaagccguccggcagcgcguccagcauggugaacggggucgugaagcugcugaccaagcccugggacgucauccccauggugacccagaucgccaugacggacaccacccccuucggccagcagcggguguucaaggagaaggucgacacccgcacgccgaaggccaagcgggggaccgcccagaucauggaggugaccgccaaguggcucuggggcuuccugagccgcaacaagaagccccggaucugcacccgcgaggaguucacgcggaaggugcgcuccaacgcggccaucggcgccgucuucguggacgagaaccaguggaacagcgccaaggaggcgguggaggacgagcgguucugggaccugguccaccgcgagcgggagcuccacaagcaggggaagugcgcgaccugcguguacaacaugaugggcaagcgcgagaagaagcugggggaguucggcaaggccaaggggucccgggccaucugguacauguggcugggcgcccgcuuccucgaguucgaggcgcugggcuucaugaacgaggaccacugguucagccgggagaacucccugagcgggguggagggcgaggggcuccacaagcugggcuacauccugcgcgacaucuccaagauccccgggggcaacauguacgccgacgacaccgccggcugggacacccggaucacggaggacgaccuccagaacgaggcccgcaucaccgacaucauggagccggagcacgcccugcuggccaagagcaucuucaagcucaccuaccagaacaaggucgugcgcgugcagcggcccgccaagaacgggaccgucauggacgugaucucccgccgggaccagcgcggcagcggccagguggggacguacggccugaacaccuucaccaacauggaggcccagcugauccggcagauggaguccgaggggaucuucagccccuccgagcucgagacccccaaccuggccgagcgcguccuggacuggcucgagaaguacggcguggagcggcugaagcgcauggccaucagcggggacgacugcguggucaagccgaucgacgaccgguucgcgacggcccugaccgcccucaacgacaugggcaaggugcgcaaggacaucccccagugggagcccuccaagggguggaacgacuggcagcagguccccuucugcagccaccacuuccaccagcugaucaugaaggacggccgggagaucgucgugccgugccgcaaccaggacgagcuggugggccgggcccgcgucucccagggggccggcuggagccuccgggagaccgcgugccugggcaagagcuacgcccagauguggcagcugauguacuuccaccgccgggaccuccgccuggccgccaacgcgaucugcuccgccgugcccguggacuggauccccaccagccggacgaccugguccauccacgcccaccaccaguggaugaccaccgaggacaugcugagcgucuggaaccgcguguggaucgaggagaaccccuggauggaggacaagacgcacaucuccagcuggggcgacgugccguaccucgggaagcgcgaggaccaguggugcggcucccugaucggccugaccgcccgggccaccugggcgaccaacauccaggucgccaucaaccaggugcgccggcucaucgggaacgagaacuaccuggacuacaugaccagcaugaagcgcuucaagaacgagggcgaccccgagggggcccugugguga

SEQ ID NO: 8486 - RNA, 9879 nt, Artificial Sequence
  derived and/or modified CDS sequence (opt1) from DENV-1__GQ199776__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacacgaugaccuacaagugcccccgcaucaccgagaccgagcccgacgacguggacugcuggugcaacgccacggacaccugggugaccuacgggaccugcagccagacgggcgagcaccggcgcgacaagcgguccguggcccucgcgccccacgugggccuggggcuggagacccgcaccgagaccuggaugagcuccgagggcgcguggaagcagauccagcgggucgagacgugggcccuccgccaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagguggccgagacccagcacggcaccgugcugguccagaucaaguacgagggcaccgacgcgcccugcaagauccccuucagcacgcaggacgagaagggggugacccagaacggccggcugaucaccgccaacccgaucgugaccgacaaggagaagcccgucaacaucgaggccgagccgcccuucggggaguccuacaucgugaucggcgccggcgagaaggcgcugaagcucagcugguucaagaagggguccagcaucggcaagauguucgaggccacggcccgcggggcccggcgcauggccauccugggcgacaccgcgugggacuucggguccaucggcggcguguucaccagcgucgggaagcuggugcaccagaucuucggcaccgccuacggggugcuguucuccggcgucagcuggacgaugaagaucgggaucggcgugcugcugaccuggcucggccugaacucccgcagcaccucccugagcaugaccugcaucgccguggggcucgucacgcuguaccugggcgugauggugcaggccgacuccgggugcgucaucaacuggaagggccgggagcucaagugcgggagcggcaucuucgugaccaacgaggugcacaccuggaccgagcaguacaaguuccaggccgacagcccgaagcgccuguccgcggccaucggcaaggccugggaggagggggucugcggcauccggagcgccacccgccuggagaacaucauguggaagcagaucuccaacgagcucaaccacauccugcuggagaacgacaugaaguucacggugguggucggggacguggccggcauccucgcgcaggggaagaagaugauccggccccagcccauggaguacaaguacagcuggaaguccuggggcaaggccaagaucaucggcgccgacgugcagaacaccaccuucaucaucgacgggcccaacaccccggagugccccgacgaccagcgcgccuggaacaucugggaggucgaggacuacggcuucgggaucuucacgaccaacaucuggcugaagcugcgggacagcuacacccaggugugcgaccaccgccucauguccgcggccaucaaggacagcaaggccgugcacgccgacaugggcuacuggaucgaguccgagaagaacgagaccuggaagcuggcccgggcgagcuucaucgaggucaagacgugcaucuggcccaagucccacacccuguggagcaacggcgugcucgaguccgagaugaucauccccaagaucuacgggggcccgaucagccagcacaacuaccgccccggguacuucacccaggccgccggccccuggcaccuggggaagcuggagcucgacuucgaccugugcgagggcaccacgguggucguggacgagcacugcggcaaccgggggccgucccugcgcaccaccaccgugacgggcaagaucauccacgaguggugcugccggagcugcacccugccgccccuccgcuuccgcggggaggacggcugcugguacgggauggagauccgccccgucaaggagaaggaggagaaccuggugaaguccauggugagcgccggcagcggcgaggucgacuccuucagccucgggcugcugugcaucuccaucaugaucgaggaggugaugcggagccgcuggucccggcgcaugcucaugaccggcacccuggccguguucuuccugcucaucauggggcagcugacguggaacgaccugauccgccucugcaucauggucggcgcgaacgccagcgaccggauggggaugggcaccaccuaccuggcccugauggccaccuucaagaugcgcccgauguucgccgugggccuccuguuccggcgccugacgucccgggaggugcuccugcugaccaucgggcucagccuggucgcguccguggagcugcccaacagccucgaggagcugggcgacgggcuggccaugggcaucaugauccucaagcugcugaccgacuuccagucccaccagcucugggccacccugcugagccucacguucaucaagaccacccugucccugcacuacgccuggaagaccauggcgaugguccucagcaucgugucccuguucccccugugccucagcacgaccucccagaagaccaccuggcugcccgugcugcucggcagccuggggugcaagccgcugacgauguuccucaucgccgagaacaagaucuggggccgccgguccuggccccugaacgaggggaucauggccgucggcaucgugagcauccugcucagcucccugcugaagaacgacgugccccucgccgggccccugaucgccggcggcaugcugaucgcgugcuacgucaucagcggguccagcgccgaccucucccuggagaaggccgccgaggugagcugggaggaggaggccgagcacuccggcgcgagccacaacauccugguggagguccaggacgacgggaccaugaagaucaaggacgaggagcgcgacgacacccucaccauccugcugaaggccacccuccuggccguguccggcguguacccgcugagcauccccgccacccucuucgucugguacuucuggcagaagaagaagcagcgguccggggugcugugggacacccccagcccgcccgagguggagcgcgccguccuggacgacggcaucuaccggaucaugcagcgcggccugcucgggcggucccaggugggcgugggggucuuccaggagaacguguuccacaccauguggcacgugacccgcggcgcgguccugauguaccaggggaagcggcuggagcccagcugggccuccgugaagaaggaccucaucagcuacggcggcggguggcgccugcagggcuccuggaacacgggggaggaggugcaggucaucgccguggagcccggcaagaaccccaagaacgugcagaccgcccccgggaccuucaagacccccgagggcgaggucggcgccaucgcgcuggacuucaagcccgggacgagcggcucccccaucgugaaccgggaggggaagaucgugggccucuacggcaacggggucgugaccaccagcggcaccuacgugagcgccaucgcccaggccaaggcgucccaggaggggccgcugcccgagaucgaggacgaggucuuccgcaagcggaaccugacgaucauggaccuccaccccggcagcgggaagacccgccgguaccugccggccaucgugcgcgaggccaucaagcgcaagcugcggacccucauccuggcccccacccgcguggucgccuccgagauggcggaggcccugaagggcaugcccauccgguaccagacgaccgccgucaagagcgagcacaccggcaaggagaucguggaccucaugugccacgccaccuucacgaugcgccugcugucccccguccgggugccgaacuacaacaugaucaucauggacgaggcccacuucaccgaccccagcuccaucgcggcccgcggguacaucagcacccgggugggcaugggggaggccgccgccaucuucaugaccgcgacgccgcccggcuccgucgaggccuucccgcagagcaacgccgugauccaggacgaggagcgcgacauccccgagcgguccuggaacagcggguacgaguggaucaccgacuuccccggcaagaccgugugguucguccccuccaucaagagcggcaacgacaucgccaacugccuccgcaagaacgggaagcgggugauccagcugucccgcaagaccuucgacacggaguaccagaagaccaagaacaacgacugggacuacguggucaccaccgacaucagcgagaugggcgcgaacuuccgggccgaccgcgugaucgacccgcggcgcugccugaagcccgugauccucaaggacgggcccgagcgggucauccuggccggccccaugccggugacggucgccuccgccgcgcagcgccgggggcgcaucggccgcaaccacaacaaggagggcgaccaguacaucuacauggggcagccccugaacaacgacgaggaccacgcccacuggaccgaggccaagaugcuccuggacaacaucaacacccccgagggcaucauccccgcccuguucgagccggagcgggagaaguccgccgcgaucgacggggaguaccgccuccggggcgaggcccgcaagaccuucguggagcugaugcggcgcggggaccugcccguguggcucuccuacaaggucgccagcgagggcuuccaguacagcgaccggcgcuggugcuucgacggcgagcggaacaaccaggugcuggaggagaacauggacguggagaucuggacgaaggagggggagcgcaagaagcugcggccccgcuggcucgacgcccggaccuacuccgacccccuggcccugcgcgaguucaaggaguucgcggccggccggcgcagcgucuccggggaccucauccuggagaucggcaagcugccgcagcaccucacccagcgggcccagaacgcccuggacaaccuggugaugcuccacaacagcgagcagggcgggcgcgcguaccggcacgccauggaggagcugcccgacaccaucgagacgcugaugcuccuggcccugaucgccgugcucaccggcggggucacccuguucuuccuguccggccgcgggcucggcaagaccagcaucggccugcugugcgugauggccuccagcgugcuccuguggauggcguccgucgagccccacuggaucgccgccagcaucauccuggaguucuuccucauggugcugcugauccccgagccggaccggcagcgcacgccccaggacaaccagcucgccuacguggucaucgggcugcuguucaugauccucacgguggccgcgaacgagaugggccugcuggagaccaccaagaaggaccucgggaucggccacguggccgucgagaaccaccaccacgccgccaugcuggacguggaccugcaccccgccuccgcguggacccucuacgccguggccacgaccaucaucaccccgaugaugcgccacaccaucgagaacacgaccgccaacaucagccugaccgccaucgcgaaccaggccgccauccugauggggcucgacaagggcuggcccaucuccaagauggacaucggcgucccccugcuggcccucgggugcuacagccaggugaacccccugacccugacggcggccgugcucaugcuggucgcccacuacgccaucaucggcccggggcugcaggccaaggcgacccgggaggcccagaagcgcaccgccgccggcaucaugaagaaccccaccguggacgggaucguggccaucgaccucgaccccgucguguacgacgcgaaguucgagaagcagcugggccagaucaugcugcucauccugugcacgucccagauccugcucaugcggaccaccugggcccugugcgagagcaucacccuggccacgggcccccucaccacccugugggagggguccccgggcaaguucuggaacaccacgaucgccgugagcauggccaacaucuuccgcggguccuaccuggcgggcgccggccucgccuucagccugaugaagucccucgggggcgggcggcgcgggaccggggcccagggcgagacccucggcgagaaguggaagcggcagcugaaccagcuguccaagagcgaguucaacaccuacaagcgcuccgggaucauggaggucgaccggagcgaggcgaaggagggccucaagcgcggggagacgaccaagcacgccgugucccggggcaccgccaagcugcgcugguucguggagcggaaccuggucaagcccgaggggaaggugaucgaccugggcugcggccgcgggggcuggagcuacuacugcgccgggcucaagaaggugaccgaggucaagggcuacacgaagggcggccccggccacgaggagcccaucccgauggccaccuacggguggaaccuggugaagcugcacuccggcaaggacguguucuucaucccgcccgagaagugcgacacccuccugugcgacaucggggagagcucccccaacccgaccaucgaggagggccggacgcugcgcguccucaagaugguggagcccuggcugcgggggaaccaguucugcaucaagauccugaaccccuacaugcccagcguggucgagacccucgagcagaugcagcgcaagcacggcggcaugcuggugcggaacccgcugucccgcaacagcacccacgagauguacuggguguccugcgggaccggcaacaucgucagcgcggugaacaugaccucccgcaugcuccugaaccgguucacgauggcccaccgcaagcccaccuacgagcgggacguggaccugggggccggcacccgccacgucgugguggagcccgaggucgccaaccucgacaucaucggccagcggaucgagaacaucaagcacgagcacaagagcaccuggcacuacgacgaggacaaccccuacaagacgugggccuaccacggguccuacgaggugaagccgagcggcuccgcgagcagcauggucaacgggguggugaagcugcugaccaagcccugggacgucauccccauggugacccagaucgccaugaccgacacgacccccuucggccagcagcgcguguucaaggagaaggucgacacccggaccccgaaggccaagcgcgggacggcccagaucauggaggugaccgccaaguggcucuggggcuuccugucccggaacaagaagccccgcaucugcacccgggaggaguucacccgcaaggugcggagcaacgcggccaucggcgccgucuucguggacgagaaccaguggaacuccgccaaggaggcgguggaggacgagcgcuucugggaccugguccaccgggagcgcgagcuccacaagcaggggaagugcgccacgugcguguacaacaugaugggcaagcgggagaagaagcugggggaguucggcaaggccaaggggagccgcgccaucugguacauguggcugggcgcccgguuccucgaguucgaggcgcugggcuucaugaacgaggaccacugguucucccgcgagaacagccuguccgggguggagggcgaggggcuccacaagcugggcuacauccugcgggacaucagcaagauccccgggggcaacauguacgccgacgacaccgccggcugggacacccgcaucaccgaggacgaccuccagaacgaggcccgcaucacggacaucauggagccggagcacgcccugcuggcgaaguccaucuucaagcucaccuaccagaacaaggucgugcgggugcagcgccccgccaagaacgggaccgucauggacgugaucagccggcgcgaccagcggggcuccggccagguggggaccuacggccugaacacguucaccaacauggaggcccagcugauccgccagauggagagcgaggggaucuucucccccagcgagcucgagacccccaaccuggccgagcggguccuggacuggcucgagaaguacggcguggagcgccugaagcggauggccaucuccggggacgacugcguggucaagccgaucgacgaccgcuucgcgaccgcccugacggcccucaacgacaugggcaaggugcggaaggacaucccccagugggagcccagcaagggguggaacgacuggcagcagguccccuucugcucccaccacuuccaccagcugaucaugaaggacggccgcgagaucgucgugccgugccggaaccaggacgagcuggugggccgcgcccgggucagccagggggccggcuggagccuccgcgagaccgcgugccuggggaaguccuacgcccagauguggcagcugauguacuuccaccggcgcgaccuccggcuggccgccaacgcgaucugcagcgccgugcccguggacuggauccccaccucccgcaccacguggagcauccacgcccaccaccaguggaugaccaccgaggacaugcuguccgucuggaaccgcguguggaucgaggagaaccccuggauggaggacaagacccacaucagcuccuggggcgacgugccguaccucgggaagcgggaggaccaguggugcggcagccugaucggccugacggcccgcgccaccugggcgaccaacauccaggucgccaucaaccaggugcggcgccucaucgggaacgagaacuaccuggacuacaugaccuccaugaagcgguucaagaacgagagcgaccccgagggcgcccugugguga

SEQ ID NO: 8487 - RNA, 9879 nt, Artificial Sequence
  derived and/or modified CDS sequence (opt1) from DENV-1__GQ199777__SS-prME
agcgugaccaugcugcucaugcugaugcccaccgcccuggccuuccaccucaccacccggggcggggagccccacaugaucgugagcaagcaggagcggggcaagagccugcuguucaagaccuccgcgggggugaacaugugcacccucaucgccauggaccugggcgagcugugcgaggacacgaugaccuacaagugcccccgcaucaccgagaccgagcccgacgacguggacugcuggugcaacgccacggacaccugggugaccuacgggaccugcagccagacgggcgagcaccggcgcgacaagcgguccguggcccucgcgccccacgugggccuggggcuggagacccgcaccgagaccuggaugagcuccgagggcgcguggaagcagauccagcgggucgagacgugggcccuccgccaccccggguucaccgugaucgcccuguuccuggcccacgugaucggcaccagcaucacccagaaggggaucaucuucauccuccugaugcuggucacgcccuccauggcgaugcggugcgugggcaucggcagccgcgacuucguggaggggcucuccggcgccaccugggucgacguggugcuggagcacgggagcugcgucaccaccauggccaaggacaagcccacgcuggacaucgagcuccugaagaccgaggugaccaaccccgccgugcugcggaagcucugcaucgaggccaagaucuccaacaccacgaccgacagccgcugcccgacccagggcgaggcgacccuggucgaggagcaggacgccaacuucgugugccggcgcacguucguggaccggggcugggggaacggcugcgggcuguucggcaaggggucccucaucacgugcgccaaguucaagugcgucaccaagcuggagggcaagaucgugcaguacgagaaccugaaguacagcgugaucgucaccgugcacacgggcgaccagcaccaggucgggaacgaguccaccgagcacggcaccaccgccaccaucacgccccaggcccccaccaccgagauccagcucaccgacuacggggcgcugacgcuggacugcagcccccgcaccggccucgacuucaacgagauggugcugcugaccaugaaggagaaguccuggcucgugcacaagcagugguuccuggaccugccccuccccuggaccagcggggccagcacgucccaggagaccuggaaccggcaggaccugcuggucaccuucaagaccgcccacgccaagaagcaggagguggugguccucggcagccaggagggcgccaugcacacggcgcugaccggggccaccgagauccagaccuccggcacgaccaccaucuucgccgggcaccugaagugccgccucaagauggacaagcugacccugaagggcaugagcuacgugaugugcacggggcuguucaagcuggagaaggagguggccgagacccagcacggcaccguccuggugcagaucaaguacgagggcaccgacgcccccugcaagauccccuucuccacgcaggacgagaagggggugacccagaacggccggcugaucaccgcgaacccgaucgucaccgacaaggagaagcccgugaacaucgaggccgagccgcccuucggggagagcuacaucaucaucggcgccggcgagaaggcccucaagcuguccugguucaagaaggggagcuccaucggcaagauguucgaggcgacggcccgcggggcccggcgcauggccauccugggcgacaccgccugggacuucgggagcaucggcggcguguucaccuccgucgggaagcucgugcaccagaucuucggcaccgcguacggggugcuguucagcggcgucuccuggacgaugaagaucgggaucggcgugcugcucaccuggcugggccugaacagccgcuccaccagccucuccaugaccugcaucgccguggggcuggucacgcuguaccucggcgugauggugcaggccgacagcgggugcgucaucaacuggaagggccgggagcugaagugcggguccggcaucuucgugaccaacgaggugcacaccuggaccgagcaguacaaguuccaggccgacagcccgaagcgccugagcgccgcgaucggcaaggccugggaggagggggucugcggcauccgguccgccacccgccucgagaacaucauguggaagcagaucagcaacgagcugaaccacauccugcucgagaacgacaugaaguucacggugguggucggggacguggccggcauccuggcccaggggaagaagaugauccggccccagcccauggaguacaaguacuccuggaaguccuggggcaaggcgaagaucaucggcgccgacgugcagaacaccaccuucaucaucgacgggcccaacaccccggagugccccgacgaccagcgcgccuggaacaucugggaggucgaggacuacggcuucgggaucuucacgaccaacaucuggcugaagcuccgggacuccuacacccaggugugcgaccaccgccugaugagcgccgcgaucaaggacuccaaggccgugcacgccgacaugggcuacuggaucgagagcgagaagaacgagaccuggaagcuggcccgggccuccuucaucgaggucaagacgugcaucuggcccaagagccacacccucugguccaacggcgugcuggagagcgagaugaucauccccaagaucuacgggggcccgaucucccagcacaacuaccgccccggguacuucacccagaccgcgggccccuggcaccuggggaagcucgagcuggacuucgaccugugcgagggcacgaccguggucguggacgagcacugcggcaaccgggggccgagccuccgcaccaccacggugaccggcaagaucauccacgaguggugcugccgguccugcacccugccgccccugcgcuuccgcggggaggacggcugcugguacgggauggagauccgccccgucaaggagaaggaggagaaccucgucaagagcaugguguccgccggcagcggcgaggucgacagcuucucccuggggcugcucugcaucagcaucaugaucgaggaggugaugcggucccgcuggagccggaagaugcugaugaccggcacgcuggccguguucuuccuccugaucauggggcagcugaccuggaacgaccucauccgccugugcaucauggucggcgccaacgccuccgaccgcauggggaugggcaccaccuaccuggcgcucauggccacguucaagaugcggccgauguucgccgugggccugcuguuccgccggcucaccagccgcgaggugcugcugcucaccaucgggcugucccuggucgccagcguggagcuccccaacucccuggaggagcugggcgacgggcucgccaugggcaucaugauccugaagcugcucgcggacuuccagagccaccagcugugggccacccugcucucccugacguucaucaagaccaccuucagccugcacuacgccuggaagaccauggccaugguccucuccaucgugagccuguucccccugugccucuccacgaccagccagaagaccaccuggcugcccgugcugcucggcucccuggggugcaagccgcugacgauguuccucaucgcggagaacaagaucuggggccggcgcagcuggccccugaacgaggggaucauggccgucggcaucguguccauccugcucagcagccugcugaagaacgacgugccccucgccgggccccugaucgccggcggcaugcugaucgccugcuacgucaucuccgggagcuccgcggaccucagccuggagaaggccgccgagguguccugggaggaggaggccgagcacagcggcgccucccacaacauccugguggagguccaggacgacgggaccaugaagaucaaggacgaggagcgggacgacacccucaccauccugcugaaggcgacccuccuggccgugagcggcguguacccgcuguccauccccgccacccucuucgucugguacuucuggcagaagaagaagcagcgcagcggggugcugugggacacccccagcccgcccgagguggagcgggccguccuggacgacggcaucuaccgcaucaugcagcggggccugcucgggcgcagccaggugggcgugggggucuuccaggagaacguguuccacaccauguggcacgugacccggggcgccguccugauguaccaggggaagcgccuggagcccuccugggcgagcgugaagaaggaccucaucuccuacggcggcggguggcggcugcagggcagcuggaacacgggggaggaggugcaggucaucgccguggagcccggcaagaaccccaagaacgugcagaccgcccccgggaccuucaagacccccgagggcgaggucggcgccaucgcccuggacuucaagcccgggacguccggcagccccaucgugaaccgcgaggggaagaucgugggccucuacggcaacggggucgugaccaccuccggcaccuacgugagcgcgaucgcccaggccaaggccagccaggaggggccgcugcccgagaucgaggacgaggucuuccggaagcgcaaccugacgaucauggaccuccaccccggcuccgggaagacccggcgcuaccugccggcgaucgugcgggaggccaucaagcgccgccugcggacccucauccuggcccccacccgcguggucgccagcgagauggccgaggcgcugaagggcaugcccauccgguaccagacgaccgccgugaaguccgagcacaccggcaaggagaucguggaccucaugugccacgccaccuucacgaugcgccugcugagccccguccgggugccgaacuacaacaugaucaucauggacgaggcccacuucaccgaccccuccagcaucgccgcgcgcggguacaucuccacccgggugggcaugggggaggccgccgccaucuucaugaccgccacgccgcccggcagcgucgaggcguucccgcaguccaacgccgugauccaggacgaggagcgcgacauccccgagcggagcuggaacuccggguacgaguggaucaccgacuuccccggcaagaccgugugguucguccccagcaucaaguccggcaacgacaucgccaacugccuccgcaagaacgggaagcgggugauccagcugagccgcaagaccuucgacacggaguaccagaagaccaagaacaacgacugggacuacguggucaccaccgacaucuccgagaugggcgccaacuuccgggcggaccgcgugaucgacccgcggcgcugccugaagcccgugauccucaaggacgggcccgagcgggucauccuggccggccccaugccggugacggucgccagcgccgcccagcgccgggggcgcaucggccgcaaccacaacaaggagggcgaccaguacaucuacauggggcagccccugaacaacgacgaggaccacgcgcacuggaccgaggccaagaugcuccuggacaacaucaacacccccgagggcaucauccccgcccuguucgagccggagcgggagaaguccgccgccaucgacggggaguaccgccuccggggcgaggcgcgcaagaccuucguggagcugaugcggcgcggggaccugcccguguggcucagcuacaaggucgccuccgagggcuuccaguacagcgaccggcgcuggugcuucgacggcgagcggaacaaccaggugcuggaggagaacauggacguggagaucuggacgaaggagggggagcgcaagaagcugcggccccgcuggcucgacgcccggaccuacagcgacccccuggcccugcgcgaguucaaggaguucgccgcgggccggcgcuccgucagcggggaccucauccuggagaucggcaagcugccgcagcaccucacccagcgggcccagaacgcccuggacaaccuggugaugcuccacaacuccgagcagggcgggcgcgccuaccggcacgcgauggaggagcugcccgacaccaucgagacgcugaugcuccuggcccugaucgccgugcucaccggcggggucacccuguucuuccugagcggccgcgggcucggcaagaccuccaucggccugcugugcgugauggccagcuccgugcuccuguggauggccagcgucgagccccacuggaucgcggccuccaucauccuggaguucuuccucauggugcugcugauccccgagccggaccggcagcgcacgccccaggacaaccagcucgccuacguggucaucgggcugcuguucaugauccucacgguggccgccaacgagaugggccugcuggagaccaccaagaaggaccucgggaucggccacguggcggucgagaaccaccaccacgccgccaugcuggacguggaccugcaccccgccagcgccuggacccucuacgcgguggccacgaccaucaucaccccgaugaugcgccacaccaucgagaacacgaccgccaacaucucccugaccgccaucgccaaccaggcggccauccugauggggcucgacaagggcuggcccaucagcaagauggacaucggcgucccccugcuggcccucgggugcuacucccaggugaacccccugacccugacggccgcggugcucaugcuggucgcccacuacgccaucaucggcccggggcugcaggccaaggccacccgggaggcgcagaagcgcaccgccgccggcaucaugaagaaccccaccguggacgggaucguggccaucgaccucgaccccgucguguacgacgccaaguucgagaagcagcugggccagaucaugcugcucauccugugcacgagccagauccugcucaugcggaccaccugggcgcugugcgaguccaucacccuggccacgggcccccucaccacccugugggaggggagcccgggcaaguucuggaacaccacgaucgccguguccauggccaacaucuuccgcgggagcuaccuggccggcgcgggccucgccuucucccugaugaagucccucgggggcgggcggcgcgggaccggggcccagggcgagacccucggcgagaaguggaagcggcagcugaaccagcugagcaaguccgaguucaacaccuacaagcgcagcgggaucauggaggucgaccgguccgaggccaaggagggccucaagcgcggggagacgaccaagcacgcggugagccggggcaccgccaagcugcgcugguucguggagcggaaccuggucaagcccgaggggaaggugaucgaccugggcugcggccgcgggggcugguccuacuacugcgccgggcucaagaaggugaccgaggucaagggcuacacgaagggcgggcccggccacgaggagcccaucccgauggccaccuacggguggaaccuggugaagcugcacagcggcaaggacguguucuucaucccgcccgagaagugcgacacccuccugugcgacaucggggaguccagccccaacccgaccaucgaggagggccggacgcugcgcguccucaagaugguggagcccuggcugcgggggaaccaguucugcaucaagauccugaaccccuacaugcccuccguggucgagacccucgagcagaugcagcgcaagcacggcggcaugcuggugcggaacccgcugagccgcaacuccacccacgagauguacugggugagcugcgggaccggcaacaucgucuccgccgugaacaugaccagccgcaugcuccugaaccgguucacgauggcgcaccgcaagcccaccuacgagcgggacguggaccugggggccggcacccgccacgucgccguggagcccgagguggccaaccucgacaucaucggccagcggaucgagaacaucaagcacgagcacaaguccaccuggcacuacgacgaggacaaccccuacaagacgugggccuaccacgggagcuacgaggucaagccguccggcagcgcguccagcauggugaacggggucgugaagcugcugaccaagcccugggacgugauccccauggucacccagaucgccaugaccgacacgacccccuucggccagcagcgcguguucaaggagaagguggacacccggaccccgaaggccaagcgcgggacggcccagaucauggaggucaccgccaaguggcucuggggcuuccugagccggaacaagaagccccgcaucugcacccgggaggaguucacccgcaaggugcgguccaacgcggccaucggcgccguguucgucgacgagaaccaguggaacagcgccaaggaggcgguggaggacgagcgcuucugggaccuggugcaccgggagcgcgagcuccacaagcaggggaagugcgccacgugcgucuacaacaugaugggcaagcgggagaagaagcugggggaguucggcaaggccaaggggucccgcgccaucugguacauguggcugggcgcccgguuccucgaguucgaggcgcugggcuucaugaacgaggaccacugguucagccgcgagaacucccugagcgggguggagggcgaggggcuccacaagcugggcuacauccugcgggacaucuccaagauccccgggggcaacauguacgccgacgacaccgccggcugggacacccgcaucaccgaggacgaccuccagaacgaggcccgcaucacggacaucauggagccggagcacgcccugcuggccaagagcaucuucaagcucaccuaccagaacaaggugguccgggugcagcgccccgccaagaacgggaccgugauggacgucaucucccggcgcgaccagcggggcagcggccagguggggaccuacggccugaacacguucaccaacauggaggcccagcugauccgccagauggaguccgaggggaucuucagccccuccgagcucgagacccccaaccuggccgagcgggugcuggacuggcucgagaaguacggcgucgagcgccugaagcggauggccaucagcggggacgacugcguggugaagccgaucgacgaccgcuucgcgaccgcccugacggcccucaacgacaugggcaagguccggaaggacaucccccagugggagcccuccaagggguggaacgacuggcagcagguccccuucugcagccaccacuuccaccagcugaucaugaaggacggccgcgagaucguggucccgugccggaaccaggacgagcuggugggccgcgcccgggugucccagggggccggcuggagccuccgcgagaccgcgugccugggcaagagcuacgcccagauguggcagcugauguacuuccaccggcgcgaccuccggcuggccgccaacgcgaucugcuccgccguccccguggacuggauccccaccagccgcaccacgugguccauccacgcccaccaccaguggaugaccaccgaggacaugcugagcguguggaaccgcgucuggaucgaggagaaccccuggauggaggacaagacccacaucuccagcuggggcgacgugccguaccucgggaagcgggaggaccaguggugcggcucccugaucggccugacggcccgcgccaccugggcgaccaacauccagguggccaucaaccagguccggcgccucaucgggaacgagaacuaccuggacuacaugaccagcaugaagcgguucaagaacgaguccgaccccgagggcgcccugugguga

SEQ ID NO: 8488 - RNA, 9879 nt, Artificial Sequence
  derived and/or modified CDS sequence (opt1) from DENV-1__GQ199778__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccgcaucaccgagaccgagcccgacgacguggacugcuggugcaacgccaccgacaccugggucaccuacgggaccugcagccagacgggcgagcaccggcgcgacaagcgguccguggcccucgcgccccacgugggccuggggcuggagacccgcaccgagaccuggaugagcuccgagggcgccuggaagcagauccagcgggucgagacgugggcccuccgccaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggaggccuggaaccggcaggaccugcuggugaccuucaagaccgcccacgcgaagaagcaggaggucguggugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgucaugugcaccggguccuucaagcucgagaaggagguggcggagacgcagcacggcaccgugcugguccagaucaaguacgagggcaccgacgcccccugcaagauccccuucagcacccaggacgagaagggggugacgcagaacggccggcugaucaccgccaacccgaucgugaccgacaaggagaagcccgucaacaucgaggccgagccgcccuucggggaguccuacaucgugaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcgucgggaagcuggugcaccagaucuucggcaccgccuacggggugcuguucuccggcgucagcuggaccaugaagaucgggaucggcgugcugcugacguggcucggccugaacucccgcagcaccucccugagcaugaccugcaucgccguggggcucgucacccuguaccugggcgugauggugcaggccgacuccgggugcgucaucaacuggaagggccgggagcucaagugcgggagcggcaucuucgugacgaacgaggugcacaccuggaccgagcaguacaaguuccaggcggacagcccgaagcgccuguccgccgccaucggcaaggccugggaggagggggucugcggcauccggagcgccacccgccuggagaacaucauguggaagcagaucuccaacgagcucaaccacauccugcuggagaacgacaugaaguucaccgugguggucggggacguggcgggcauccucgcccaggggaagaagaugauccggccccagcccauggaguacaaguacagcuggaaguccuggggcaaggccaagaucaucggcgccgacgugcagaacacgaccuucaucaucgacgggcccaacaccccggagugccccgacgaccagcgcgcguggaacaucugggaggucgaggacuacggcuucgggaucuucaccacgaacaucuggcugaagcugcgggacagcuacacccaggugugcgaccaccgccucauguccgccgccaucaaggacagcaaggccgugcacgccgacaugggcuacuggaucgaguccgagaagaacgagaccuggaagcuggcgcgggccagcuucaucgaggucaagaccugcaucuggcccaagucccacacgcuguggagcaacggcgugcucgaguccgagaugaucauccccaagaucuacgggggcccgaucagccagcacaacuaccgccccggguacuucacccaggccgccggccccuggcaccuggggaagcuggagcucgacuucgaccugugcgagggcaccaccguggucguggacgagcacugcggcaaccgggggccgucccugcgcacgaccaccgugaccggcaagaucauccacgaguggugcugccggagcugcacgcugccgccccuccgcuuccgcggggaggacggcugcugguacgggauggagauccgccccaucaaggagaaggaggagaaccuggucaaguccauggugagcgccggcagcggcgagguggacuccuucagccucgggcugcugugcaucuccaucaugaucgaggaggucaugcggagccgcuggucccggcgcaugcucaugaccggcacccuggcgguguucuuccugcucaucauggggcagcugaccuggaacgaccugauccgccucugcaucauggugggcgccaacgccagcgaccggauggggaugggcacgaccuaccuggcccugauggccaccuucaagaugcgcccgauguucgcggucggccuccuguuccggcgccugaccucccgggaggugcuccugcugacgaucgggcucagccugguggccuccgucgagcugcccaacagccucgaggagcugggcgacgggcuggccaugggcaucaugauccucaagcugcugaccgacuuccagucccaccagcucugggccacccugcugagccucaccuucaucaagacgaccuucucccugcacuacgcguggaagaccauggccauggugcugagcaucgucucccucuucccccugugccugagcaccacgucccagaagaccaccuggcuccccgugcugcugggcagccucgggugcaagccgcugaccauguuccugaucgccgagaacaagaucuggggccgccgguccuggccccucaacgaggggaucauggccgugggcaucgucagcauccugcugagcucccuccugaagaacgacgugccccuggccgggccccucaucgcgggcggcaugcugaucgccugcuacgugaucagcggguccagcgccgaccugucccucgagaaggccgccgaggucagcugggaggaggaggcggagcacuccggcgccagccacaacauccugguggaggugcaggacgacgggacgaugaagaucaaggacgaggagcgcgacgacacccugaccauccuccugaaggccacccugcucgccgucuccggcguguacccgcugagcauccccgccacccuguucgugugguacuucuggcagaagaagaagcagcgguccgggguccucugggacacgcccagcccgcccgagguggagcgcgcggugcuggacgacggcaucuaccggaucaugcagcgcggccugcuggggcggucccaggucggcguggggguguuccaggagaacgucuuccacaccauguggcacgugacccgcggcgccgugcucauguaccaggggaagcggcuggagcccagcugggccuccgucaagaaggaccugaucagcuacggcggcggguggcgccuccagggcuccuggaacaccggggaggagguccaggugaucgccgucgagcccggcaagaaccccaagaacgugcagacggcccccgggaccuucaagacccccgagggcgaggugggcgcgaucgcccuggacuucaagcccgggaccagcggcucccccaucgucaaccgggaggggaagaucgugggccuguacggcaacgggguggucacgaccagcggcaccuacgugagcgccaucgcccaggcgaaggccucccaggaggggccgcuccccgagaucgaggacgagguguuccgcaagcggaaccugaccaucauggaccugcaccccggcagcgggaagacgcgccgguaccucccggccaucguccgcgaggccaucaagcgcaagcugcggacccugauccucgcccccacccgcgugguggcguccgagauggccgaggcccugaagggcaugcccauccgguaccagaccacggccgucaagagcgagcacaccggcaaggagaucguggaccugaugugccacgccaccuucaccaugcgccuccugucccccgugcgggucccgaacuacaacaugaucaucauggacgaggcgcacuucacggaccccagcuccaucgccgcccgcggguacaucagcacccgggugggcaugggggaggccgccgcgaucuucaugaccgccacgccgcccggcuccguggaggccuucccgcagagcaacgccgucauccaggacgaggagcgcgacauccccgagcgguccuggaacagcggguacgaguggaucacggacuuccccggcaagaccgugugguucgugcccuccaucaagagcggcaacgacaucgcgaacugccugcgcaagaacgggaagcgggucauccagcucucccgcaagaccuucgacaccgaguaccagaagacgaagaacaacgacugggacuacguggugaccaccgacaucagcgagaugggcgccaacuuccgggccgaccgcgucaucgacccgcggcgcugccugaagcccgugauccugaaggacgggcccgagcgggugauccucgccggccccaugccggucaccguggccuccgcggcccagcgccgggggcgcaucggccgcaaccacaacaaggagggcgaccaguacaucuacauggggcagccccugaacaacgacgaggaccacgcccacuggacggaggccaagaugcugcucgacaacaucaacacccccgagggcaucauccccgcccuguucgagccggagcgggagaaguccgcggccaucgacggggaguaccgccugcggggcgaggcccgcaagaccuucgucgagcucaugcggcgcggggaccugcccguguggcuguccuacaagguggccagcgagggcuuccaguacagcgaccggcgcuggugcuucgacggcgagcggaacaaccagguccucgaggagaacauggacguggagaucuggaccaaggagggggagcgcaagaagcugcggccccgcuggcuggacgcccggacguacuccgacccccucgcgcugcgcgaguucaaggaguucgccgccggccggcgcagcguguccggggaccugauccucgagaucggcaagcugccgcagcaccugacccagcgggcccagaacgcgcucgacaaccuggucaugcugcacaacagcgagcagggcgggcgcgccuaccggcacgccauggaggagcuccccgacaccaucgagacccugaugcugcucgcccugaucgccgugcugacgggcggggugacccucuucuuccuguccggccgcgggcugggcaagaccagcaucggccuccugugcgucauggcguccagcgugcugcucuggauggccuccguggagccccacuggaucgccgccagcaucauccuggaguucuuccugaugguccuccugauccccgagccggaccggcagcgcacgccccaggacaaccagcuggccuacguggugaucgggcuccuguucaugauccugaccgucgcggccaacgagaugggccuccuggagacgaccaagaaggaccuggggaucggccacguggccguggagaaccaccaccacgccgccaugcucgacgucgaccugcaccccgcguccgccuggacccuguacgccguggccaccacgaucaucaccccgaugaugcgccacaccaucgagaacaccacggccaacaucagccucaccgcgaucgccaaccaggccgccauccugauggggcuggacaagggcuggcccaucuccaagauggacaucggcgugccccuccuggcgcuggggugcuacagccaggucaacccccucacccugaccgccgccgugcugaugcucguggcccacuacgccaucaucggcccggggcugcaggcgaaggccacgcgggaggcccagaagcgcaccgccgccggcaucaugaagaaccccaccgucgacgggaucguggcgaucgaccuggaccccguggucuacgacgccaaguucgagaagcagcucggccagaucaugcugcugauccucugcaccucccagauccugcugaugcggacgaccugggcccucugcgagagcaucacccuggccaccggcccccugacgacccucugggagggguccccgggcaaguucuggaacaccaccaucgccgugagcauggcgaacaucuuccgcggguccuaccuggccggcgccggccuggccuucagccucaugaagucccucgggggcgggcggcgcgggacgggggcgcagggcgagacccugggcgagaaguggaagcggcagcucaaccagcuguccaagagcgaguucaacaccuacaagcgcuccgggaucauggagguggaccggagcgaggccaaggagggccugaagcgcggggagaccacgaagcacgccgucucccggggcaccgccaagcuccgcugguucguggagcggaaccuggugaagcccgaggggaaggucaucgaccugggcugcggccgcgggggcuggagcuacuacugcgccgggcugaagaaggugaccgaggugaagggcuacaccaagggcggccccggccacgaggagcccaucccgauggcgacguacggguggaaccucgucaagcugcacuccggcaaggacguguucuucaucccgcccgagaagugcgacacccugcucugcgacaucggggagagcucccccaacccgaccaucgaggagggccggacccugcgcgugcugaagauggucgagcccuggcuccgggggaaccaguucugcaucaagauccugaaccccuacaugcccagcgugguggagacgcuggagcagaugcagcgcaagcacggcggcaugcucguccggaacccgcugucccgcaacagcacccacgagauguacuggguguccugcgggaccggcaacaucgugagcgccgucaacaugaccucccgcaugcugcucaaccgguucaccauggcccaccgcaagcccacguacgagcgggacguggaccugggggccggcacccgccacguggccgucgagcccgagguggcgaaccuggacaucaucggccagcggaucgagaacaucaagcacgagcacaagagcaccuggcacuacgacgaggacaaccccuacaagaccugggccuaccacggguccuacgaggugaagccgagcggcuccgccagcagcauggucaacgggguggucaagcuccugacgaagcccugggacgugauccccauggugacccagaucgccaugaccgacaccacgcccuucggccagcagcgcgucuucaaggagaagguggacacccggaccccgaaggccaagcgcgggaccgcgcagaucauggaggugacggccaaguggcuguggggcuuccucucccggaacaagaagccccgcaucugcacccgggaggaguucacccgcaagguccggagcaacgccgccaucggcgcgguguucguggacgagaaccaguggaacuccgccaaggaggccgucgaggacgagcgcuucugggaccuggugcaccgggagcgcgagcugcacaagcaggggaagugcgcgaccugcguguacaacaugaugggcaagcgggagaagaagcucggggaguucggcaaggccaaggggagccgcgcgaucugguacauguggcugggcgcccgguuccuggaguucgaggcccucggcuucaugaacgaggaccacugguucucccgcgagaacagccuguccggggucgagggcgaggggcugcacaagcucggcuacauccugcgggacaucagcaagauccccgggggcaacauguacgccgacgacacggccggcugggacacccgcaucaccgaggacgaccugcagaacgaggcgcgcaucaccgacaucauggagccggagcacgcccuccuggccaaguccaucuucaagcugacguaccagaacaagguggugcggguccagcgccccgccaagaacgggaccgugauggacgugaucagccggcgcgaccagcggggcuccgggcaggucggcaccuacggccucaacaccuucacgaacauggaggcccagcugauccgccagauggagagcgaggggaucuucucccccagcgagcuggagacccccaaccucgcggagcgggugcuggacuggcuggagaaguacggcguggagcgccucaagcggauggccaucuccggggacgacugcgucgugaagccgaucgacgaccgcuucgccaccgcccugaccgcccugaacgacaugggcaaggugcggaaggacaucccccagugggagcccagcaagggguggaacgacuggcagcagguccccuucugcucccaccacuuccaccagcucaucaugaaggacggccgcgagaucguggugccgugccggaaccaggacgagcuggucggccgcgcgcgggugagccagggggccggcuggagccugcgcgagacggccugccucgggaaguccuacgcccagauguggcagcugauguacuuccaccggcgcgaccugcggcucgcggccaacgccaucugcagcgccgugcccgucgacuggauccccaccucccgcaccaccuggagcauccacgcccaccaccaguggaugacgaccgaggacaugcuguccguguggaaccgcguguggaucgaggagaaccccuggauggaggacaagacccacaucagcuccuggggcgacgucccguaccuggggaagcgggaggaccaguggugcggcagccucaucggccugaccgcgcgcgccacgugggccaccaacauccagguggccaucaaccaggugcggcgccugaucgggaacgagaacuaccucgacuacaugaccuccaugaagcgguucaagaacgagagcgaccccgagggcgcccugugguga

SEQ ID NO: 8489 - RNA, 9879 nt, Artificial Sequence
  derived and/or modified CDS sequence (opt1) from DENV-1__GQ199780__SS-prME
agcgugaccaugcugcucaugcugaugcccaccgcccuggccuuccaccucacgacccggggcggggagccccacaugaucgugagcaagcaggagcggggcaagagccugcuguucaagaccuccgccggggugaacaugugcacccucaucgccauggaccugggcgaguucugcgaggacaccaugaccuacaagugcccccgcaucaccgaggccgagcccgacgacguggacugcuggugcaacgccaccgacacgugggugaccuacgggaccugcagccagaccggcgagcaccggcgggacaagcgguccguggcccuggcgccccacgugggccucgggcuggagacgcgcaccgagaccuggaugagcuccgagggcgccuggaagcagauccagcgggucgagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugcccgacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaagaucguccaguacgagaaccugaaguacagcgugaucgugaccguccacaccggcgaccagcaccagguggggaacgaguccacggagcacggcaccaccgcgaccaucacgccccaggcccccagcacggagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccagcggggccuccaccagccaggagaccuggaaccggaaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcauguccuacgucaugugcaccgggagcuucaagcuggagaaggagguggcggagacccagcacggcacggugcucguccagaucaaguacgagggcaccgacgcccccugcaagauccccuucuccacccaggacgagaagggggugacccagaacggccggcugaucacggccaacccgaucgugaccgacaaggagaagcccgucaacaucgaggccgagccgcccuucggggagagcuacaucgugaucggcgcgggcgagaaggcccugaagcuguccugguucaagaaggggagcuccaucggcaagauguucgaggccaccgcccgcggggcccggcgcauggcgauccucggcgacaccgccugggacuucgggagcaucggcggcguguucacguccgucgggaagcuggugcaccagaucuucggcaccgccuacggggugcuguucagcggcgucuccuggaccaugaagaucgggaucggcgugcuccugaccuggcugggccucaacagccgcuccacgagccuguccaugaccugcaucgccguggggcuggucacccucuaccugggcgugauggugcaggccgacagcgggugcgucaucaacuggaagggccgggagcugaagugcgggagcggcaucuucgugaccaacgaggugcacacguggaccgagcaguacaaguuccaggcggacuccccgaagcgccucagcgccgccaucggcaaggccugggaggagggggucugcggcauccgguccgccacccgccuggagaacaucauguggaagcagaucagcaacgagcugaaccacauccuccuggagaacgacaugaaguucaccgugguggucggggacguggcgggcauccuggcccaggggaagaagaugauccggccccagcccauggaguacaaguacuccuggaaguccuggggcaaggccaagaucaucggcgccgacgugcagaacaccacguucaucaucgacgggcccaacaccccggagugccccgacgaccagcgcgcguggaacaucugggaggucgaggacuacggcuucgggaucuucaccaccaacaucuggcucaagcugcgggacuccuacacccaggugugcgaccaccgccugaugagcgccgccaucaaggacuccaaggccgugcacgccgacaugggcuacuggaucgagagcgagaagaacgagaccuggaagcucgcgcgggccuccuucaucgaggucaagaccugcaucuggcccaagagccacacccugugguccaacggcgugcuggagagcgagaugaucauccccaagaucuacgggggcccgaucucccagcacaacuaccgccccggguacuucacgcagaccgccggccccuggcaccucgggaagcuggagcuggacuucgaccucugcgagggcaccaccguggucguggacgagcacugcggcaaccgggggccgagccugcgcacgaccaccgugaccggcaagaucauccacgaguggugcugccgguccugcacgcugccgccccugcgcuucaagggggaggacggcugcugguacgggauggagauccggcccgucaaggagaaggaggagaaccuggucaagagcauggugagcgccggcuccggcgaggucgacagcuucucccuggggcuccugugcaucagcaucaugaucgaggaggugaugcgcucccgguggagccgcaagaugcugaugaccggcacccucgccguguucuuccugcugaucauggggcagcucaccuggaacgaccugauccggcugugcaucauggucggcgcgaacgccuccgaccgcauggggaugggcacgaccuaccucgcccugauggccaccuucaagaugcgcccgauguucgccguggggcuccuguuccggcgccugaccagccgggaggugcugcuccugacgaucgggcugucccucgucgcgagcguggagcugcccaacucccuggaggagcucggcgacgggcuggccaugggcaucaugauccugaagcuccugaccgacuuccagagccaccagcugugggccacccuccugucccugaccuucaucaagacgaccuucagccuccacuacgccuggaagaccauggcgaugguccuguccaucgugagccuguucccccucugccuguccaccacgagccagaagaccaccuggcugcccgugcuccugggcucccuggggugcaagccgcucaccauguuccugaucgccgagaacaagaucuggggccgcaagagcuggccccugaacgaggggaucauggccgucggcaucgugagcauccuccuguccgcccugcucaagaacgacgugccccuggccgggccccugaucgcgggcggcaugcucaucgccugcuacgucaucagcggguccagcgccgaccugucccuggagaaggccgccgaggugagcugggaggaggaggcggagcacuccggcgccagccacaacauccucguggagguccaggacgacgggacgaugaagaucaaggacgaggagcgggacgacacccugaccauccugcucaaggccacccugcuggccguguccggcguguacccgcucagcauccccgccacccuguucgucugguacuucuggcagaagaagaagcagcgcuccggggugcugugggacacgcccagcccgcccgagguggagcgggcgguccucgacgacggcaucuaccgcaucaugcagcggggccugcuggggcgcucccaggugggcgugggggucuuccaggagaacguguuccacaccauguggcacgugacccggggcgccguccugauguaccaggggaagcgccucgagcccagcugggccuccgugaagaaggaccugaucagcuacggcggcggguggcggcugcagggcuccuggaacaccggggaggaggugcaggucaucgccguggagcccggcaagaaccccaagaacgugcagacggcccccgggaccuucaagaccagcgagggcgaggucggcgcgaucgcccucgacuucaagcccgggaccuccggcagccccaucgugaaccgcgaggggaagaucgugggccuguacggcaacggggucgugacgaccagcggcaccuacguguccgccaucgcccaggcgaaggccagccaggaggggccccugccggagaucgaggacgaggucuuccggaagcgcaaccucaccaucauggaccugcaccccggcuccgggaagacgcggcgcuaccugcccgccaucgugcgggaggccaucaagcgcaagcuccggacccugauccuggccccgacccgcguggucgcgagcgagauggccgaggcccucaagggcaugcccauccgcuaccagaccacggccgugaaguccgagcacaccggcaaggagaucguggaccugaugugccacgccaccuucaccaugcggcugcucagccccguccgcgugcccaacuacaacaugaucaucauggacgaggcgcacuucacggacccguccagcaucgccgcccggggguacaucuccacccgcgugggcaugggggaggccgccgcgaucuucaugaccgccacgccgcccggcagcgucgaggccuucccccaguccaacgccgugauccaggacgaggagcgggacaucccggagcgcagcuggaacuccggguacgaguggaucacggacuuccccggcaagaccgugugguucguccccagcaucaaguccggcaacgacaucgcgaacugccugcggaagaacgggaagcgcgugauccagcugagccggaagaccuucgacaccgaguaccagaagacgaagaacaacgacugggacuacguggucaccaccgacaucuccgagaugggcgccaacuuccgcgccgaccgggugaucgacccccgccggugccucaagccggugauccugaaggacgggcccgagcgcgucauccuggccggccccaugcccgugaccgucgccagcgcggcccagcggcgcgggcggaucggccgcaaccacaacaaggagggcgaccaguacaucuacauggggcagccgcucaacaacgacgaggaccacgcccacuggacggaggccaagaugcugcuggacaacaucaacacccccgagggcaucauccccgcccucuucgagcccgagcgggagaaguccgcggccaucgacggggaguaccgccugcgcggcgaggcccggaagaccuucguggagcugaugcgccgcggggaccucccgguguggcugagcuacaaggucgccagcgagggcuuccaguacuccgaccgccgguggugcuucgacggcgagcgcaacaaccaggugcuggaggagaacauggacguggagaucuggaccaaggagggggagcggaagaagcuccgcccccgguggcuggacgcccgcacguacagcgacccccuggcgcuccgggaguucaaggaguucgccgccggccgccgguccgucagcggggaccugauccuggagaucggcaagcucccccagcaccugacccagcgcgcccagaacgcgcuggacaaccucgugaugcugcacaacuccgagcagggcgggcgggccuaccgccacgccauggaggagcugccggacaccaucgagacccucaugcugcuggcccucaucgccgugcugacgggcggggucacccuguucuuccucagcggccgggggcugggcaagaccuccaucggccugcucugcgugauggcgagcuccgugcugcuguggauggccagcgucgagccccacuggaucgccgccuccaucauccucgaguucuuccugauggugcugcucauccccgagcccgaccgccagcggaccccgcaggacaaccagcuggccuacguggucaucgggcuccucuucaugauccugaccguggcggccaacgagaugggccugcucgagacgaccaagaaggaccuggggaucggccacguggccgucgagaaccaccaccacgccgccaugcuggacguggaccuccaccccgcgagcgccuggacccuguacgccguggccaccacgaucaucacccccaugaugcgccacaccaucgagaacaccacggccaacaucucccugaccgcgaucgccaaccaggccgccauccucauggggcuggacaagggcuggccgaucagcaagauggacaucggcgucccccugcucgcgcuggggugcuacucccaggugaacccccugacccucaccgccgccgugcugaugcuggucgcccacuacgccaucaucggccccgggcuccaggcgaaggccacgcgggaggcccagaagcgcaccgccgccggcaucaugaagaacccgaccguggacgggaucguggcgaucgaccuggaccccgucguguacgacgccaaguucgagaagcagcugggccagaucaugcuccugauccugugcaccagccagauccuccugaugcgcacgaccugggcccugugcgaguccaucacccucgccaccggcccccugacgacccugugggaggggagccccggcaaguucuggaacaccaccaucgccguguccauggcgaacaucuuccgggggagcuaccucgccggcgccggccuggccuucagccugaugaagucccucgggggcgggcgccggggcacgggggcgcagggcgagacccugggcgagaaguggaagcgccagcugaaccagcucagcaaguccgaguucaacaccuacaagcggagcgggaucauggaggucgaccgcuccgaggccaaggagggccugaagcgcggggagaccacgaagcacgccgugagccgcggcaccgccaagcugcggugguucguggagcgcaaccucgucaagccggaggggaaggugaucgaccugggcugcggccgcggcgggugguccuacuacugcgccgggcugaagaaggugaccgaggucaagggguacaccaagggcgggcccggccacgaggagcccauccccauggcgacguacggguggaaccuggugaagcuccacagcggcaaggacguguucuucaucccgcccgagaagugcgacacccugcugugcgacaucggggaguccagccccaaccccaccaucgaggagggccgcacccuccggguccugaagaugguggagccguggcugcgcgggaaccaguucugcaucaagauccucaaccccuacaugcccuccguggucgagacgcuggagcagaugcagcggaagcacggcggcaugcuggugcgcaacccccucagccggaacuccacccacgagauguacugggugagcugcgggaccggcaacaucgucuccgccgugaacaugaccagccgcaugcugcugaaccgguucaccauggcccaccgcaagccgacguacgagcgcgacguggaccucggggccggcacccggcacgucgccguggagcccgagguggcgaaccuggacaucaucggccagcgcaucgagaacaucaagcacgagcacaaguccaccuggcacuacgacgaggacaaccccuacaagaccugggccuaccacgggagcuacgaggucaagcccuccggcagcgccagcuccauggugaacggggucgugaagcugcucacgaagccgugggacgugauccccauggucacccagaucgccaugaccgacaccacgcccuucggccagcagcggguguucaaggagaagguggacacccgcacccccaaggccaagcgggggaccgcgcagaucauggaggucacggccaaguggcuguggggcuuccugagccgcaacaagaagccgcggaucugcacccgcgaggaguucacccggaaggugcgcuccaacgccgccaucggcgcgguguucgucgacgagaaccaguggaacagcgccaaggaggccguggaggacgagcgguucugggaccucgugcaccgcgagcgggagcugcacaagcaggggaagugcgcgaccugcgucuacaacaugaugggcaagcgcgagaagaagcugggggaguucggcaaggccaaggggucccgggcgaucugguacauguggcucggcgcccgcuuccuggaguucgaggcccugggcuucaugaacgaggaccacugguucagccgggagaacucccucagcgggguggagggcgaggggcugcacaagcugggcuacauccuccgcgacaucuccaagauccccgggggcaacauguacgccgacgacacggccggcugggacacccggaucaccgaggacgaccugcagaacgaggcgaagaucaccgacaucauggagcccgagcacgcccugcucgccaagagcaucuucaagcugacguaccagaacaaggugguccgcgugcagcggccggccaagaacgggaccgugauggacgucaucucccgccgcgaccagcggggcagcggccaggugggcaccuacggccugaacaccuucacgaacauggaggcccagcucauccgccagauggaguccgaggggaucuucagccccuccgagcuggagacccccaaccuggcgggccgggugcucgacuggcuggagaagcacggggucgagcgccugaagcggauggccaucagcggcgacgacugcguggugaagcccaucgacgaccgcuucgccaccgcccucaccgcccugaacgacauggggaagguccggaaggacgugccgcagugggagcccuccaagggcuggaacgacuggcagcagguccccuucugcagccaccacuuccaccagcugaucaugaaggacggccgcgagaucgucgugcccugccggaaccaggacgagcucguggggcgcgcgcgggucagccagggcgccggguggucccugcgcgagacggccugccugggcaagagcuacgcccagauguggcagcucauguacuuccaccggcgcgaccugcggcuggcggccaacgccaucugcuccgccgugccgguggacuggguccccaccagccgcaccaccugguccauccacgcccaccaccaguggaugacgaccgaggacaugcucagcguguggaaccggguguggaucgaggagaaccccuggauggaggacaagacccacaucuccagcuggggcgacguccccuaccugggcaagcgcgaggaccaguggugcggcucccugaucgggcucaccgcgcgggccacgugggccaccaacauccagguggccaucaaccaggugcgccgccugaucggcaacgagaacuaccuggacuacaugaccagcaugaagcgguucaagaacgaguccgacccggagggggcccucugguga

SEQ ID NO: 8490 - RNA, 9879 nt, Artificial Sequence
  derived and/or modified CDS sequence (opt1) from DENV-1__GQ199781__SS-prME
agcgugaccaugcugcucaugcugaugcccaccgcccuggccuuccaccucaccacccggggcggggagccccacaugaucgugaccaagcaggagcggggcaagagccugcuguucaagaccagcgcgggggugaacaugugcacccucaucgccauggaccugggggagcugugcgaggacaccaugaccuacaagugcccccggaucaccgaggccgagcccgacgacguggacugcuggugcaacgccacggacaccugggugaccuacgggaccugcagccagacgggggagcaccggcgcgacaagcggagcguggcccucgcgccccacgugggccuggggcuggagacccgcaccgagaccuggauguccagcgagggcgccuggaagcagauccagcggguggagacgugggcccuccgccaccccggguucaccgugaucgcccuguuccuggcccacgccaucggcaccuccaucacccagaaggggaucaucuucauccuccugaugcuggugacgcccagcauggccaugcggugcgucggcaucggcucccgcgacuucguggaggggcucagcggcgccaccuggguggacgucgugcuggagcacggguccugcgugaccaccauggccaaggacaagcccacgcuggacaucgagcuccugaagaccgaggucaccaaccccgcggugcugcggaagcucugcaucgaggccaagaucagcaacaccacgaccgacucccgcugccccacccagggcgaggccacccugauggaggagcaggacgccaacuucgugugccggcgcacguucgucgaccggggcugggggaacggcugcgggcuguucggcaaggggagccucaucacgugcgccaaguucaagugcgugaccaagcuggagggcaagaucgugcaguacgagaaccugaaguacuccgucaucgugaccgugcacacgggcgaccagcaccaggucgggaacgagagcaccgagcacggcaccaccgcgaccaucacgccccaggcccccaccuccgagauccagcucaccgacuacggggcccugacccuggacugcagcccccgcacgggccucgacuucaacgagauggugcugcugaccaugaaggagaaguccuggcucguccacaagcagugguuccuggaccugccgcuccccuggaccagcggggccagcaccucccaggagacguggaaccggcaggaccugcuggugaccuucaagaccgcccacgcgaagaagcaggagguggucgugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgugaugugcaccggguccuucaagcucgagaaggaggucgcggagacgcagcacggcaccgugcuggugcagaucaaguacgagggcaccgacgcccccugcaagauccccuucagcacccaggacgagaagggggucauccagaacggccggcugaucacggccaacccgaucgugaccgacaaggagaagcccgugaacaucgaggccgagccgcccuucggggaguccuacaucgucaucggcgugggcgagaaggcgcugaagcucagcugguucaagaagggguccagcaucggcaagauguucgaggccaccgcccgcggggcccggcgcauggccauccugggcgacaccgcgugggacuucggguccaucggcggcguguucacgagcgucgggaagcuggugcaccagaucuucggcaccgccuacgggguccuguucuccggcgucagcuggaccaugaagaucgggaucggcgugcugcugaccuggcucggccugaacucccgcagcacgucccugagcaugaccugcaucgccguggggcucgucacccuguaccugggcgugauggugcaggccgacuccgggugcgucaucaacuggaagggccgggagcucaagugcgggagcggcaucuucgugaccaacgaggugcacacguggaccgagcaguacaaguuccaggccgacagcccgaagcgccuguccgcggccaucggcaaggccugggaggagggggucugcggcauccggagcgccacccgccuggagaacaucauguggaagcagaucuccaacgagcucaaccacauccugcuggagaacgacaugaaguucaccgugguggucggggacguggugggcauccucgcccaggggaagaagaugauccggccccagcccauggagcacaaguacagcuggaaguccuggggcaaggcgaagaucaucggcgccgacgcccagaacaccacguucaucaucgacgggcccaacaccccggagugccccgacgaccagcgcgccuggaacaucugggaggucgaggacuacggcuucgggaucuucaccaccaacaucuggcugaagcugcgggacagcuacacgcaggcgugcgaccaccgccucauguccgccgccaucaaggacagcaaggccgugcacgccgacaugggcuacuggaucgaguccgagaagaacgagaccuggaagcuggcgcgggccagcuucaucgaggugaagaccugcaucuggcccaagucccacacccuguggagcaacggcguccucgaguccgagauggugauccccaagaucuacgggggcccgaucagccagcacaacuaccgccccggguacuucacgcagaccgccggccccuggcaccuggggaagcuggagcucgacuucgaccugugcgagggcaccaccguggucguggacgagcacugcggcaaccgggggccgucccugcgcacgaccaccgugaccggcaagaucauccacgaguggugcugccggagcugcacgcugccgccccuccgcuucaagggggaggacggcugcugguacgggauggagauccggcccgucaaggagaaggaggagaaccuggugaaguccauggugagcgccggcagcggcgaggucgacuccuucagccucgggcugcugugcaucuccaucaugaucgaggaggugaugcgcagccgguggucccgcaagaugcucaugaccggcacccuggccguguuccugcuccugaucauggggcagcugaccuggaacgaccucauccggcugugcaucauggucggcgcgaacgccagcgaccgcauggggaugggcacgaccuaccuggcccucauggccaccuucaagaugcgcccgauguucgccgugggccugcuguuccggcgccucaccucccgggaggugcugcugcucacgaucgggcugagccuggucgcguccguggagcuccccaacagccuggaggagcugggcgacgggcucgccaugggcaucaugauccugaagcugcucaccgacuuccagucccaccagcugugggccacccugcucagccugaccuucaucaagacgacccugucccuccacuacgccuggaagaccauggcgaugguccugagcaucgugucccuguucccccucugccugagcaccacgucccagaagaccaccuggcugcccgugcuccugggcagccuggggugcaagccgcucaccauguuccugaucgccgagaacaagaucuggggccgcaaguccuggccccugaacgaggggaucauggccgucggcguggugagcauccuccugagcucccugcucaagaacgacgucccccuggccgggccccugaucgccggcggcaugcucaucgcgugcuacgugaucagcggguccagcgccgaccugucccuggagaaggccgccgaggugagcugggaggaggaggccgagcacuccggcgcgagccacaacauccucgucgaggugcaggacgacgggacgaugaagaucaaggacgaggagcgggacgacacccugaccauccugcucaaggccacccugcuggccguguccggcgucuacccgcucagcauccccgccacccuguucgugugguacuucuggcagaagaagaagcagcgcuccggggugcugugggacacgcccagcccgcccgaggucgagcgggccgugcuggacgacggcaucuaccgcaucaugcagcggggccuccuggggcgcucccaggugggcgucgggguguuccaggagaacguguuccacaccauguggcacgucacccggggcgcggugcugauguaccaggggaagcgccucgagcccagcugggccuccgugaagaaggaccugaucagcuacggcggcggguggcggcugcagggcuccuggaacaccggggaggagguccaggugaucgccguggagcccggcaagaaccccaagaacguccagacggcccccgggaccuucaagacccccgagggcgaggugggcgccaucgcgcucgacuucaagcccgggaccagcggcucccccaucgugaaccgcgaggggaagaucgucggccuguacggcaacgggguggugacgaccagcggcaccuacgucagcgccaucgcccagaccaaggccucccaggaggggccgcugcccgagaucgaggacgagguguuccggaagcgcaaccucacgaucauggaccugcaccccggcagcgggaagacccggcgcuaccugccggcgaucauccgggaggccaucaagcgcaagcuccggacccugauccuggcccccacccgcguggucgccuccgagauggccgaggcgcucaagggcaugcccauccgcuaccagacgaccgccgucaagagcgagcacaccggcaaggagaucguggaccugaugugccacgccaccuucacgaugcggcugcucucccccguccgcgugccgaacuacaacaugaucaucauggacgaggcccacuucaccgaccccagcuccaucgccgcgcggggguacaucagcacccgcgugggcaugggggaggccgccgccaucuucaugaccgccacgccgcccggcuccgucgaggcguucccgcagagcaacgccgugauccaggacgaggagcgggacauccccgagcgcuccuggaacagcggguacgaguggaucaccgacuuccccggcaagaccgugugguucguccccuccaucaagagcggcaacgacaucgccaacugccugcggaagaacgggaagcgcgugauccagcugucccggaagaccuucgacacggaguaccagaagaccaagaacaacgacugggacuacguggucaccaccgacaucagcgagaugggcgccaacuuccgcgcggaccgggugaucgacccgcgccggugccucaagcccgugauccugaaggacgggcccgagcgcgucauccuggccggccccaugccggugacggucgccuccgccgcccagcggcgcgggcggaucggccgcaaccacaacaaggagggcgaccaguacaucuacauggggcagccccucaacaacgacgaggaccacgcgcacuggaccgaggccaagaugcugcuggacaacaucaacacccccgagggcaucauccccgcccucuucgagccggagcgggagaaguccgccgccaucgacggggaguaccgccugcgcggcgaggcgcggaagaccuucguggagcugaugcgccgcggggaccuccccguguggcuguccuacaaggucgccagcgagggcuuccaguacagcgaccgccgguggugcuucgacggcgagcgcaacaaccaggugcuggaggagaacauggacguggagaucuggacgaaggagggggagcggaagaagcuccgcccccgguggcuggacgcccgcaccuacuccgacccccuggcccuccgggaguucaaggaguucgccgcgggccgccggagcgucuccggggaccugauccuggagaucggcaagcucccgcagcaccugacccagcgcgcccagaacgcccuggacaaccucgugaugcugcacaacagcgagcagggcgggcgggccuaccgccacgcgauggaggagcugcccgacaccaucgagacgcucaugcugcuggcccucaucgccgugcugaccggcggggucacccuguucuuccucuccggccgggggcugggcaagaccagcaucggccugcucugcgugauggccuccagcgugcugcuguggauggccuccgucgagccccacuggaucgcggccagcaucauccucgaguucuuccugauggugcugcucauccccgagccggaccgccagcggacgccccaggacaaccagcuggccuacguggucaucgggcuccucuucaugauccugacgguggccgccaacgagaugggccugcucgagaccaccaagaaggaccuggggaucggccacguggcggucgagaaccaccaccacgccaccaugcuggacguggaccuccaccccgccuccgccuggacgcuguacgccguggcgaccaccaucaucaccccgaugaugcgccacacgaucgagaacaccaccgccaacaucagccugaccgccaucgccaaccaggccgcgauccucauggggcuggacaagggcuggcccaucuccaagauggacaucggcgucccccugcucgcccuggggugcuacagccaggugaacccccugacgcucaccgccgccgugcugaugcuggucgcgcacuacgccaucaucggcccggggcuccaggccaaggccacccgggaggcccagaagcgcaccgcggccggcaucaugaagaaccccacgguggacgggaucguggccaucgaccuggaccccgucguguacgacgccaaguucgagaagcagcugggccagaucaugcuccugauccugugcaccucccagauccuccugaugcgcaccaccugggcccugugcgagagcaucacgcucgcgaccggcccccugaccacccugugggagggguccccgggcaaguucuggaacacgaccaucgccgugagcauggccaacaucuuccggggguccuaccucgccggcgccggccuggcguucagccugaugaagucccucgggggcgggcgccggggcaccggggcccagggcgagacccugggcgagaaguggaagcgccagcugaaccagcucuccaagagcgaguucaacaucuacaagcgguccgggaucauggaggucgaccgcagcgaggccaaggagggccugaagcgcggggagacgacccgccacgccgugucccggggcaccgcgaagcugcgcugguucguggagcggaaccuggucaagcccgaggggaaggugaucgaccucggcugcggccgcgggggcuggagcuacuacugcgccgggcugaagaaggugaccgaggucaagggcuacacgaagggcgggcccggccacgaggagcccaucccgauggccaccuacggguggaaccuggugaagcuccacuccggcaaggacguguucuucgcgccgcccgagaagugcgacacccugcugugcgacaucggggagagcucccccaacccgaccaucgaggagggccggacgcuccgcguccugaagaugguggagcccuggcugcgggggaaccaguucugcaucaagauccucaaccccuacaugcccagcguggucgagacccuggagcagaugcagcgcaagcacggcggcaugcuggugcggaacccgcucucccgcaacagcacccacgagauguacuggguguccugcgggaccggcaacaucgucagcgccgugaacaugaccucccggaugcugcugaaccgcuucacgauggcgcaccgcaagcccaccuacgagcgggacguggaccucggggccggcacccgccacgucgccguggagcccgagguggccaaccuggacaucaucggccagcggaucgagaacaucaagcacgagcacaagagcaccuggcacuacgacgaggacaaccccuacaagacgugggccuaccacggguccuacgaggucaagccgagcggcuccgcgagcagcauggugaacggggucgugaagcugcucaccaagcccugggacgugauccccauggucacccagaucgccaugaccgacacgacccccuucggccagcagcgcguguucaaggagaagguggacacccggaccccgaaggcccgccgggggacggcccagaucauggaggucaccgcccgcuggcuguggggcuuccugucccggaacaagaagccccgcaucugcacccgggaggaguucacccgcaaggugcggagcaacgcggccaucggcgccguguucgucgacgagaaccaguggaacuccgccaaggaggcgguggaggacgagcgcuucugggaccucgugcagaaggagcgggagcugcacaagcaggggaagugcgccacgugcgucuacaacaugaugggcaagcgcgagaagaagcugggggaguucggcaaggccaaggggagccgggccaucugguacauguggcucggcgcccgcuuccuggaguucgaggcgcugggcuucaugaacgaggaccacugguucucccgggagaacagccucuccgggguggagggcgaggggcugcacaagcugggcuacauccuccgcgacaucagcaagauccccgggggcaacauguacgccgacgacaccgccggcugggacacccggaucaccgaggacgaccugcagaacgaggccaagaucacggacaucauggagccggagcacgcccugcucgcgaccuccaucuucaagcugaccuaccagaacaaggugguccgcgugcagcgccccgccaagaacgggaccgugauggacgucaucagccggcgcgaccagcggggcuccggccaggugggcacguacggccugaacaccuucaccaacauggaggcccagcucauccgccagauggagagcgaggggaucuuccugcccuccgagcuggagacccccaaccucgccgagcgggugcuggacuggcuggagaagcacggcgucgagcgccucaagcggauggccaucagcggggacgacugcguggugaagccgaucgacgaccgcuucgcgacggcccugaccgcccugaacgacaugggcaagguccggaaggacaucccccagugggagcccuccaagggguggaacgacuggcagcagguccccuucugcagccaccacuuccaccagcucaucaugaaggacggccgcgagaucguggucccgugccggaaccaggacgagcuggugggccgcgcccgggugucccagggggccggcuggagccugcgcgagaccgcgugccucggcaagagcuacgcccagauguggcagcugauguacuuccaccggcgcgaccugcggcucgccgccaacgcgaucugcuccgccguccccguggacugggugcccaccagccgcacgaccugguccauccacgcccaccaccaguggaugaccaccgaggacaugcugagcgucuggaaccggguguggaucgaggagaaccccuggauggaggacaagacgcacguguccagcuggggcgacgucccguaccuggggaagcgcgaggaccaguggugcggcucccucaucggccugaccgcccgcgccaccugggcgagcaacauccagguggccaucaaccaggugcggcgccugaucgggaacgagaacuaccucgacuacaugaccuccaugaagcgguucaagaacgagggcgaccccgagggggcccugugguga

SEQ ID NO: 8491 - RNA, 9879 nt, Artificial Sequence
  derived and/or modified CDS sequence (opt1) from DENV-1__GQ199782__SS-prME
agcgugaccaugcugcucaugcugaugcccaccgcccuggccuuccaccucaccacccgcggcggggagccccacaugaucgugaccaagcaggagcggggcaagagccugcuguucaagaccagcgccggggugaacaugugcacccucaucgccauggaccugggcgagcugugcgaggacaccaugaccuacaagugcccccggaucaccgaggccgagcccgacgacguggacugcuggugcaacgccaccgacaccugggugaccuacgggaccugcagccagacgggcgagcaccggcgcgacaagcggagcguggcccucgcgccccacgugggccuggggcuggagacccgcaccgagaccuggauguccagcgagggcgccuggaagcagauccagcggguggagacgugggcccuccgccaccccggguucaccgugaucgcccuguuccuggcgcacgccaucggcaccuccaucacccagaaggggaucaucuucauccuccugaugcuggugacgcccagcauggccaugcggugcgucggcaucggcucccgcgacuucguggaggggcucagcggcgccaccuggguggacgucgugcuggagcacggguccugcgugaccaccauggccaaggacaagcccacgcuggacaucgagcuccugaagaccgaggucaccaaccccgcggugcugcggaagcucugcaucgaggccaagaucagcaacaccacgaccgacucccgcugccccacccagggcgaggccacccugauggaggagcaggacgccaacuucgugugccggcgcacguucgucgaccggggcugggggaacggcugcgggcuguucggcaaggggagccucaucacgugcgccaaguucaagugcgugaccaagcuggagggcaagaucgugcaguacgagaaccugaaguacuccgucaucgugaccgugcacacgggcgaccagcaccaggucgggaacgagagcaccgagcacggcaccaccgcgaccaucacgccccaggcccccaccuccgagauccagcucaccgacuacggggcccugacccuggacugcagcccccgcacgggccucgacuucaacgagauggugcugcugaccaugaaggagaaguccuggcucguccacaagcagugguuccuggaccugccgcuccccuggaccagcggggccagcaccucccaggagacguggaaccggcaggaccugcuggugaccuucaagaccgcccacgcgaagaagcaggagguggucgugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgugaugugcaccggguccuucaagcucgagaaggaggucgcggagacgcagcacggcaccgugcuggugcagaucaaguacgagggcaccgacgcccccugcaagauccccuucagcacccaggacgagaagggggucacgcagaacggccggcugaucaccgccaacccgaucgugaccgacaaggagaagcccgugaacaucgaggccgagccgcccuucggggaguccuacaucgucaucggcgcgggcgagaaggcccugaagcucagcugguucaagaagggguccagcaucggcaagauguucgaggccaccgcccgcggggcccggcgcauggcgauccugggcgacacggccugggacuucggguccgugggcggcguguucaccagcgucgggaagcuggugcaccagaucuucggcaccgccuacgggguccuguucuccggcgucagcuggaccaugaagaucgggaucggcgugcugcugacguggcucggccugaacucccgcagcaccucccugagcaugaccugcaucgccguggggcucgucacccuguaccugggcgugauggugcaggccgacuccgggugcgucaucaacuggaagggccgggagcucaagugcgggagcggcaucuucgugacgaacgaggugcacaccuggaccgagcaguacaaguuccaggcggacagcccgaagcgccuguccgccgccaucggcaaggccugggaggagggggucugcggcauccggagcgccacccgccuggagaacaucauguggaagcagaucuccaacgagcucaaccacauccugcuggagaacgacaugaaguucaccgugguggucggggacguggugggcauccucgcgcaggggaagaagaugauccggccccagcccauggagcacaaguacagcuggaaguccuggggcaaggccaagaucaucggcgccgacauccagaacacgaccuucaucaucgacgggcccaacaccccggagugccccgacgaccagcgcgccuggaacaucugggaggucgaggacuacggcuucgggaucuucaccacgaacaucuggcugcggcugcgcgacagcuacacccaggugugcgaccaccggcucauguccgcggccaucaaggacagcaaggccgugcacgccgacaugggcuacuggaucgaguccgagaagaacgagaccuggaagcuggcccgcgcgagcuucaucgaggucaagaccugcaucuggcccaagucccacacgcuguggagcaacggcgugcucgaguccgagaugaucauccccaagaucuacgggggcccgaucagccagcacaacuaccggcccggguacuucacccagaccgccggccccuggcaccuggggaagcuggagcucgacuucgaccugugcgagggcaccacgguggucguggacgagcacugcggcaaccgcgggccgucccugcggaccaccaccgugacgggcaagaucauccacgaguggugcugccgcagcugcacccugccgccccuccgguucaagggggaggacggcugcugguacgggauggagauccgccccgucaaggagaaggaggagaaccuggugaaguccauggugagcgccggcagcggcgaggucgacuccuucagccucgggcugcugugcaucuccaucaugguggaggaggugaugcggagccgcuggucccggaagaugcucaugaccggcacccuggccgucuuccugcuccugaucauggggcagcugacguggaacgaccucauccgccugugcaucauggugggcgccaacgcgagcgaccgcauggggaugggcaccaccuaccuggcccucauggccaccuucaagauccggccgauguucgccguggggcugcugguccgccggcucacgucccgcgaggugcugcugcucaccaucgggcugagccuggucgccuccguggagcuccccaacagccuggaggagcugggcgacgggcucgcgaugggcaucaugauccugaagcugcucaccgacuuccagucccaccagcugugggccacccugcucagccugacguucaucaagaccacccugucccuccacuacgccuggaagaccauggccauggugcugagcaucgucucccuguucccccucugccugagcacgaccucccagaagaccaccuggcugcccgugcuccugggcagccuggggugcaagccgcucacgauguuccugaucaccgagaacaagaucuggggccggaaguccuggccccugaacgaggggaucauggcggugggcgucgugagcauccuccugagcucccugcucaagaacgacgugccccuggccgggccccugaucgccggcggcaugcucaucgccugcuacgucaucagcggguccagcgccgaccugucccuggagaaggcggccgaggugagcugggaggaggaggccgagcacuccggcgccagccacaacauccucguggagguccaggacgacgggaccaugaagaucaaggacgaggagcgcgacgacacccugaccauccugcucaaggccacgcugcuggcgguguccggcguguacccgcucagcauccccgccacccuguucgucugguacuucuggcagaagaagaagcagcgguccggggugcugugggacacccccagcccgcccgagguggagcgcgccguccuggacgacggcaucuaccggaucaugcagcgcggccuccuggggcggucccaggugggcgugggggucuuccaggagaacguguuccacaccauguggcacgugacgcgcggcgccguccugauguaccaggggaagcggcucgagcccagcugggccuccgugaagaaggaccugaucagcuacggcggcggguggcgccugcagggcuccuggaacaccggggaggaggugcaggucaucgcgguggagcccggcaagaaccccaagaacgugcagaccgcccccgggaccuucaagacgcccgagggcgaggucggcgccaucgcccucgacuucaagcccgggaccagcggcucccccaucgugaaccgggaggggaagaucgugggccuguacggcaacggggucgugaccaccagcggcacguacgugagcgccaucgcgcaggccaaggccucccaggaggggccgcugcccgagaucgaggacgaggucuuccgcaagcggaaccucaccaucauggaccugcaccccggcagcgggaagacccgccgguaccugccggccaucgugcgcgaggcgaucaagcggaagcuccgcacccugauccuggcccccacgcgcguggucgccuccgagauggccgaggcccucaagggcaugcccauccgguaccagaccaccgcggucaagagcgagcacaccggcaaggagaucguggaccugaugugccacgccacguucaccaugcgccugcucucccccguccgggugccgaacuacaacaugaucaucauggacgaggcccacuucaccgaccccagcuccaucgccgcccgcggguacaucagcacccgggugggcaugggggaggcggccgccaucuucaugacggccacgccgcccggcuccgucgaggccuucccgcagagcaacgcggugauccaggacgaggagcgcgacauccccgagcgguccuggaacagcggguacgaguggaucaccgacuuccccggcaagaccgugugguucguccccuccaucaagagcggcaacgacaucgccaacugccugcgcaagaacgggaagcgggugauccagcugucccgcaagacguucgacaccgaguaccagaagaccaagaacaacgacugggacuacguggucaccacggacaucagcgagaugggcgccaacuuccgggccgaccgcgugaucgacccgcggcgcugccucaagcccgucauccugaaggacgggcccgagcgggugauccuggcgggccccaugccggugaccgucgccuccgccgcccagcgccgggggcgcaucggccggaaccacaacaaggagggcgaccaguacaucuacauggggcagccccucaacaacgacgaggaccacgcccacuggaccgaggcgaagaugcugcuggacaacaucaacacccccgagggcaucauccccgcccucuucgagccggagcgcgagaaguccgccgccaucgacggggaguaccgccugcggggcgaggcccgcaagacguucguggagcugaugcggcgcggggaccuccccguguggcuguccuacaaggucgcgagcgagggcuuccaguacagcgaccggcgcuggugcuucgacggcgagcggaacaaccaggugcuggaggagaacauggacguggagaucuggaccaaggagggggagcgcaagaagcuccggccccgcuggcuggacgcccggaccuacuccgacccccuggcccuccgcgaguucaaggaguucgccgccggccggcgcagcgucuccggggaccugauccuggagaucggcaagcucccgcagcaccugacccagcgggcgcagaacgcccuggacaaccucgugaugcugcacaacagcgagcagggcgggcgcgccuaccggcacgccauggaggagcugcccgacacgaucgagacccucaugcugcuggcgcucaucgccgugcugaccggcggggucacccuguucuuccucuccggccgcgggcugggcaagaccagcaucggccugcucugcgugauggccuccagcgugcugcuguggauggccuccgucgagccccacuggaucgccgcgagcaucauccucgaguucuuccugauggugcugcucauccccgagccggaccggcagcgcacgccccaggacaaccagcuggccuacguggucaucgggcuccucuucaugauccugaccguggccgccaacgagaugggccugcucgagaccaccaagaaggaccuggggaucggccacguggccgucgagaaccaccaccacgcgacgaugcuggacguggaccuccaccccgccuccgccuggacccuguacgccguggccaccaccaucaucacgccgaugaugcggcacaccaucgagaacaccaccgcgaacaucagccugacggccaucgccaaccaggccgccauccucauggggcuggacaagggcuggcccaucuccaagauggacaucggcgucccccugcucgcgcuggggugcuacagccaggugaacccccugacccucaccgccgccgugcugaugcuggucgcccacuacgcgaucaucggcccggggcuccaggccaaggccacccgcgaggcccagaagcgcacggccgcgggcaucaugaagaaccccaccguggacgggaucguggccaucgaccuggaccccgucguguacgacgccaaguucgagaagcagcugggccagaucaugcuccugauccugugcaccucccagauccuccugaugcggaccacgugggcccugugcgagagcaucacccucgccaccggcccccugaccacgcugugggagggguccccgggcaaguucuggaacaccaccaucgcggugagcauggccaacaucuuccgcggguccuaccucgccggcgccggccuggccuucagccugaugaagucccucgggggcgggcggcgcggcaccggggcgcagggcgagacgcugggcgagaaguggaagcggcagcugaaccagcucuccaagagcgaguucaacaucuacaagcgcuccgggaucauggaggucgaccggagcgaggccaaggagggccugaagcgcggggagaccacccggcacgccgugucccgcggcaccgccaagcugcggugguucguggagcgcaaccuggucaagcccgaggggaaggugaucgaccucggcugcggccgcggcggguggagcuacuacugcgcggggcugaagaaggugacggaggucaagggguacaccaagggcgggcccggccacgaggagcccaucccgauggccaccuacggguggaaccuggugaagcuccacuccggcaaggacguguucuucacgccgcccgagaagugcgacacgcugcugugcgacaucggggagagcucccccaacccgaccaucgaggagggccgcacccuccggguccugaagaugguggagcccuggcugcgcgggaaccaguucugcaucaagauccucaaccccuacaugcccagcguggucgagacccuggagcagaugcagcggaagcacggcggcaugcuggugcgcaacccgcucucccggaacagcacccacgagauguacuggguguccugcgggacgggcaacaucgucagcgccgugaacaugaccucccgcaugcugcugaaccgcuucaccauggcccaccggaagcccaccuacgagcgcgacguggaccucggggccggcacgcggcacgucgcgguggagcccgaggucgccaaccuggacaucaucggccagcgcaucgagaacaugaagcacgagcacaagagcaccuggcacuacgacgaggacaaccccuacaagaccugggccuaccacggguccuacgaggugaagccgagcggcuccgccagcagcauggugaacggggucgugaagcugcucaccaagcccugggacgugauccccauggucacgcagaucgccaugaccgacaccacccccuucggccagcagcggguguucaaggagaagguggacacgcgcaccccgaaggcgaagcgggggaccgcccagaucauggaggucaccgcccgcuggcuguggggcuuccugucccggaacaagaagccccgcaucugcacgcgggaggaguucacccgcaaggugcggagcaacgccgccaucggcgcgguguucgucgacgagaaccaguggaacuccgccaaggaggccguggaggacgagcgcuucugggaccucgugcagaaggagcgggagcugcacaagcaggggaagugcgcgaccugcgucuacaacaugaugggcaagcgcgagaagaagcugggggaguucggcaaggcgaaggggagccgggccaucugguacauguggcucggcgcccgcuuccuggaguucgaggcccugggcuucaugaacgaggaccacugguucucccgggagaacagccucuccgggguggagggcgaggggcugcacaagcugggcuacauccuccgcgacaucagcaagauccccgggggcaacauguacgccgacgacaccgcgggcugggacacgcggaucaccgaggacgaccugcagaacgaggccaagaucaccgacaucauggagccggagcacgcccugcucgccaccuccaucuucaagcugacguaccagaacaaggugguccgcgugcagcgccccgccaagaacgggaccgugauggacgucaucagccggcgcgaccagcggggcuccggccaggugggcaccuacggccugaacaccuucacgaacauggaggcgcagcucauccgccagauggagagcgaggggaucuuccugcccuccgagcuggagacccccaaccucgccgagcgggugcuggacuggcuggagaaguacggcgucgagcgccucaagcggauggccaucagcggggacgacugcguggugaagccgaucgacgaccgcuucgccaccgcccugaccgcgcugaacgacaugggcaagguccggaaggacaucccccagugggagcccuccaagggguggaacgacuggcagcagguccccuucugcagccaccacuuccaccagcucaucaugaaggacggccgcgagaucguggucccgugccggaaccaggacgagcuggugggccgcgcccgggugucccagggggccggcuggagccugcgcgagacggccugccucggcaagagcuacgcccagauguggcagcugauguacuuccaccggcgcgaccugcggcucgcggccaacgccaucugcuccgccguccccguggacugggugcccaccagccgcaccaccugguccauccacgcgcaccaccaguggaugacgaccgaggacaugcugagcgucuggaaccggguguggaucgaggagaaccccuggauggaggacaagacccacguguccagcuggggcgacgucccguaccuggggaagcgcgaggaccaguggugcggcucccucaucggccugaccgcccgcgccaccugggccagcaacauccagguggccaucaaccaggugcggcgccugaucgggaacgagaacuaccucgacuacaugacguccaugaagcgguucaagaacgagggcgaccccgagggggcgcugugguga

SEQ ID NO: 8492 - RNA, 9879 nt, Artificial Sequence
  derived and/or modified CDS sequence (opt1) from DENV-1__GQ199783__SS-prME
agcgugaccaugcugcucaugcugaugcccaccgcccuggccuuccaccucaccacccggggcggggagccccacaugaucgugaccaagcaggagcggggcaagucccugcuguucaagaccagcgcgggggugaacaugugcacccucaucgccauggaccugggcgagcugugcgaggacaccaugaccuacaagugcccccggaucaccgaggccgagcccgacgacguggacugcuggugcaacgccaccgacaccugggugaccuacgggaccugcucccagaccggcgagcaccggcgcgacaagcggagcguggcccucgcgccccacgugggccuggggcuggagacccgcaccgagaccuggauguccagcgagggcgccuggaagcagauccagcgggucgagaccugggcccuccgccaccccggguucaccgugaucgcccuguuccuggcgcacgccaucggcaccuccaucacccagaaggggaucaucuucauccuccugaugcuggugacgcccagcauggccaugcggugcgucggcaucggcucccgcgacuucguggaggggaccagcggcgccaccuggguggacgucgugcucgagcacggguccugcgugaccacgauggccaaggacaagcccacccuggacaucgagcugcucaagaccgaggucaccaaccccgcggugcugcggaagcugugcaucgaggccaagaucagcaacacgaccaccgacucccgcugccccacccagggcgaggccacgcucauggaggagcaggacgccaacuucgugugccggcgcaccuucgucgaccggggcugggggaacggcugcgggcuguucggcaaggggagccugaucacgugcgccaaguucaagugcgugaccaagcucgagggcaagaucgugcaguacgagaaccugaaguacuccgucaucgugacggugcacaccggcgaccagcaccaggucgggaacgagagcaccgagcacggcaccaccgcgacgaucacgccccaggcccccaccuccgagauccagcugaccgacuacggggcccucacgcuggacugcagcccccgcaccggccuggacuucaacgagauggugcuccugaccaugaaggagaaguccuggcugguccacaagcagugguuccucgaccugccgcugcccuggaccagcggggccagcacgucccaggagaccuggaaccggcaggaccuccuggugaccuucaagaccgcccacgcgaagaagcaggagguggucgugcugggcagccaggagggcgccaugcacacggcccucaccggggccaccgagauccagaccuccggcacgaccaccaucuucgccgggcaccugaagugccgccugaagauggacaagcucacccugaagggcaugagcuacgugaugugcacgggguccuucaagcuggagaaggaggucgcggagacccagcacggcaccgugcucgugcagaucaaguacgagggcaccgacgcccccugcaagauccccuucagcacgcaggacgagaagggggucacccagaacggccggcugaucaccgccaacccgaucgugaccgacaaggagaagcccgugaacaucgaggccgagccgcccuucggggaguccuacaucgucaucggcgcgggcgagaaggcccugaagcugagcugguucaagaagggguccagcaucggcaagauguucgaggccacggcccgcggggcccggcgcauggcgauccucggcgacaccgccugggacuucggguccgugggcggcguguucaccagcgucgggaagcuggugcaccagaucuucggcaccgccuacggggugcuguucuccggcgucagcuggacgaugaagaucgggaucggcgugcuccugaccuggcugggccucaacucccgcagcaccucccugagcaugaccugcaucgccguggggcuggucacgcucuaccugggcgugauggugcaggccgacuccgggugcgucaucaacuggaagggccgggagcugaagugcgggagcggcaucuucgugaccaacgaggugcacaccuggaccgagcaguacaaguuccaggcggacagcccgaagcgccucuccgccgccaucggcaaggccugggaggagggggucugcggcauccggagcuccacccgccuggagaacaucauguggaagcagaucagcaacgagcugaaccacauccuccuggagaacgacaugaaguucacggugguggucggggacguggugggcauccuggcccaggggaagaagaugauccggccccagcccauggagcacaaguacuccuggaaguccuggggcaaggcgaagaucaucggcgccgacguccagaacaccaccuucaucaucgacgggcccaacaccccggagugccccgacgaccagcgcgccuggaacaucugggagguggaggacuacggcuucgggaucuucacgaccaacaucuggcucaagcugcgggacuccuacacccaggugugcgaccaccgccugaugagcgccgcgaucaaggacuccaaggccguccacgccgacaugggcuacuggaucgagagcgagaagaacgagaccuggaagcucgcccgggccuccuucaucgaggugaagacgugcaucuggcccaagagccacacccugugguccaacggcgugcuggagagcgagaugaucauccccaagaucuacgggggcccgaucucccagcacaacuaccgccccggguacuucacccagaccgcgggccccuggcaccucgggaagcuggagcuggacuucgaccucugcgagggcacgaccgucgugguggacgagcacugcggcaaccgggggccgagccugcgcaccaccacggucaccggcaagaucauccacgaguggugcugccgguccugcacccugccgccccugcgcuucaagggggaggacggcugcugguacgggauggagauccggcccgugaaggagaaggaggagaaccuggucaagagcauggucagcgccggcuccggcgagguggacagcuucucccuggggcuccugugcaucagcaucaugaucgaggaggugaugcgcucccgguggagccgcaagaugcugaugaccggcacgcucgccgucuuccugcugcucaucauggggcagcugaccuggaacgaccugauccggcucugcaucauggugggcgccaacgccuccgaccgcauggggaugggcaccaccuaccuggcgcugauggccacguucaagauccgcccgauguucgccgugggccuccuguuccggcgccugaccagccgggagguccuccugcugaccaucgggcucucccugguggccagcgucgagcugcccaacucccucgaggagcugggcgacgggcuggccaugggcaucaugauccucaagcugcugaccgacuuccagagccaccagcucugggcgacgcugcugucccucaccuucaucaagaccacccugagccugcaccacgccuggaagacgauggccauggugcucuccaucgugagccuguucccccugugccucuccaccaccagccagaagaccacguggcugcccguccugcucggcucccuggggugcaagccgcugaccauguuccucaucaccgagaacaagaucuggggccgcaagagcuggccccugaacgaggggaucauggccgugggcguggucagcauccugcucuccagccugcugaagaacgacgugccccucgcggggccccugaucgccggcggcaugcugaucgccugcuacgugaucuccgggagcuccgccgaccucagccuggagaaggccgcggaggucuccugggaggaggaggccgagcacagcggcgccucccacaacauccugguggaggugcaggacgacgggaccaugaagaucaaggacgaggagcgggacgacacccucacgauccugcugaaggccacccuccuggccgucagcggcguguacccgcuguccauccccgcgacccucuucgugugguacuucuggcagaagaagaagcagcgcagcgggguccugugggacacccccagcccgcccgagguggagcgggccgugcuggacgacggcaucuaccgcaucaugcagcggggccugcucgggcgcagccaggucggcguggggguguuccaggagaacgucuuccacacgauguggcacgugacccggggcgccgugcugauguaccaggggaagcgccuggagcccuccugggccagcgucaagaaggaccucaucuccuacggcggcggguggcggcugcagggcagcuggaacaccggggaggagguccaggugaucgccgucgagcccggcaagaaccccaagaacgugcagaccgcgcccgggacguucaagacccccgagggcgaggugggcgccaucgcccuggacuucaagcccgggaccuccggcagccccaucgucaaccgcgaggggaagaucgugggccucuacggcaacgggguggucaccacgagcggcaccuacguguccgccaucgcccagaccaaggcgagccaggaggggccgcugcccgagaucgaggacgagguguuccggaagcgcaaccugaccaucauggaccuccaccccggcuccgggaagacgcggcgcuaccugccggccaucguccgggaggccaucaagcgcaagcugcggacccucauccuggcccccacccgcgugguggcgagcgagauggccgaggcccugaagggcaugcccauccgcuaccagaccacggccgucaaguccgagcacaccggcaaggagaucguggaccucaugugccacgccaccuucaccaugcggcugcugagccccgugcgcgucccgaacuacaacaugaucaucauggacgaggcgcacuucacggaccccuccagcaucgccgcccggggguacaucuccacccgcgugggcaugggggaggccgccgcgaucuucaugaccgccacgccgcccggcagcguggaggccuucccgcaguccaacgccgucauccaggacgaggagcgggacauccccgagcgcagcuggaacuccggguacgaguggaucacggacuuccccggcaagaccgugugguucgugcccagcaucaaguccggcaacgacaucgccaacugccuccggaagaacgggaagcgcgucauccagcugagccggaagaccuucgacaccgaguaccagaagacgaagaacaacgacugggacuacguggugaccaccgacaucuccgagaugggcgcgaacuuccgcgccgaccgggucaucgacccgcgccggugccugaagcccgugauccucaaggacgggcccgagcgcgucauccuggccggccccaugccggugaccguggccagcgcggcccagcggcgcgggcggaucggccgcaaccacaacaaggagggcgaccaguacaucuacauggggcagccccugaacaacgacgaggaccacgcccacuggacggaggccaagaugcuccuggacaacaucaacacccccgagggcaucauccccgcccuguucgagccggagcgggagaaguccgcggccaucgacggggaguaccgccuccgcggcgaggcccggaagaccuucgucgagcugaugcgccgcggggaccugcccguguggcucagcuacaagguggccagcgagggcuuccaguacuccgaccgccgguggugcuucgacggcgagcgcaacaaccagguccuggaggagaacauggacguggagaucuggaccaaggagggggagcggaagaagcugcgcccccgguggcucgacgcccgcacguacagcgacccccuggcgcugcgggaguucaaggaguucgccgccggccgccgguccgugagcggggaccucauccuggagaucggcaagcugccgcagcaccucacccagcgcgcccagaacgcccuggacaaccuggucaugcuccacaacuccgagcagggcgggcgggcguaccgccacgccauggaggagcugcccgacaccaucgagacccugaugcuccuggcccugaucgccgugcucaccggcggggugacgcuguucuuccugagcggccgggggcucggcaagaccuccaucggccugcugugcgucauggcgagcuccgugcuccuguggauggccagcguggagccccacuggaucgccgccuccaucauccuggaguucuuccucaugguccugcugauccccgagccggaccgccagcggacgccccaggacaaccagcucgccuacguggugaucgggcugcuguucaugauccucaccgucgcggccaacgagaugggccugcuggagacgaccaagaaggaccucgggaucggccacguggccguggagaaccaccaccacgccaccaugcuggacgucgaccugcaccccgccagcgcguggacccucuacgccguggccacgaccaucaucaccccgaugaugcgccacaccaucgagaacacgaccgccaacaucucccugaccgccaucgcgaaccaggccgccauccugauggggcucgacaagggcuggcccaucagcaagauggacaucggcgugccccugcuggcccucgggugcuacucccaggucaacccccugacccugacggccgcggugcucaugcugguggcccacuacgccaucaucggcccggggcugcaggccaaggcgacccgggaggcccagaagcgcaccgccgccggcaucaugaagaaccccaccgucgacgggaucguggccaucgaccucgaccccguggucuacgacgcgaaguucgagaagcagcugggccagaucaugcugcucauccugugcacgagccagauccugcucaugcgcaccaccugggcccugugcgaguccaucacccuggccacgggcccccucaccacccugugggaggggagcccgggcaaguucuggaacaccacgaucgccguguccauggccaacaucuuccgggggagcuaccuggcgggcgccggccucgccuucagccugaugaagucccucgggggcgggcgccgggggaccggggcccagggcgagacccucggcgagaaguggaagcgccagcugaaccagcugagcaaguccgaguucaacaucuacaagcggagcgggaucauggagguggaccgcuccgaggccaaggagggccucaagcgcggggagaccacgcgccacgcggucagccggggcaccgccaagcugcgcugguucguggagcggaaccuggugaagcccgaggggaaggucaucgaccugggcugcggccgcgggggcugguccuacuacugcgccgggcucaagaaggugaccgaggugaagggcuacaccaagggcggccccggccacgaggagcccaucccgauggccacguacggguggaaccuggucaagcugcacagcggcaaggacguguucuucacgccgcccgagaagugcgacacccuccugugcgacaucggggaguccagccccaacccgaccaucgaggagggccggacccugcgcgugcucaagauggucgagcccuggcugcgggggaaccaguucugcaucaagauccugaaccccuacaugcccuccgugguggagacgcucgagcagaugcagcgcaagcacggcggcaugcugguccggaacccgcugagccgcaacuccacccacgagauguacugggugagcugcgggaccggcaacaucguguccgcggucaacaugaccagccggaugcuccugaaccgcuucacgauggcccaccgcaagcccaccuacgagcgggacguggaccugggggccggcacccgccacguggccgucgagcccgagguggccaaccucgacaucaucggccagcggaucgagaacaucaagcacgagcacaaguccaccuggcacuacgacgaggacaaccccuacaagacgugggcguaccacgggagcuacgaggucaagccguccggcagcgccagcuccauggugaacgggguggucaagcugcugaccaagcccugggacgugauccccauggugacccagaucgccaugaccgacacgacccccuucggccagcagcgcgucuucaaggagaagguggacacccggaccccgaaggccaagcgcgggacggcccagaucauggaggugaccgcgcgguggcucuggggcuuccugagccgcaacaagaagccccggaucugcacccgcgaggaguucacccggaagguccgcuccaacgccgccaucggcgccguguucguggacgagaaccaguggaacagcgccaaggaggcggucgaggacgagcgguucugggaccuggugcagaaggagcgcgagcuccacaagcaggggaagugcgccacgugcguguacaacaugaugggcaagcgggagaagaagcugggggaguucggcaaggccaaggggucccgcgccaucugguacauguggcugggcgcgcgguuccucgaguucgaggcccugggcuucaugaacgaggaccacugguucagccgcgagaacucccugagcggggucgagggcgaggggcuccacaagcugggcuacauccugcgggacaucuccaagauccccgggggcaacauguacgccgacgacaccgccggcugggacacccgcaucaccgaggacgaccuccagaacgaggccaagaucacggacaucauggagccggagcacgcgcugcuggccaccagcaucuucaagcucaccuaccagaacaagguggugcggguccagcgccccgccaagaacgggaccgugauggacgugaucucccgccgggaccagcgcggcagcgggcaggucggcacguacggccugaacaccuucaccaacauggaggcccagcugauccggcagauggaguccgaggggaucuuccuccccagcgagcuggagacccccaaccuggccgagcgcgugcucgacuggcuggagaaguacggcguggagcggcugaagcgcauggcgaucuccggggacgacugcgucgugaagccgaucgacgaccgguucgccacggcccucaccgcccugaacgacaugggcaaggugcgcaaggacaucccccagugggagcccagcaagggguggaacgacuggcagcagguccccuucugcucccaccacuuccaccagcugaucaugaaggacggccgggagaucguggugccgugccgcaaccaggacgagcucgucggccgggcccgcgugagccagggggcgggcuggagccugcgggagaccgccugccuggggaaguccuacgcccagauguggcagcucauguacuuccaccgccgggaccugcgccuggccgccaacgcgaucugcagcgccgugcccgucgacugggugcccaccucccggacgaccuggagcauccacgcccaccaccaguggaugaccaccgaggacaugcucuccguguggaaccgcgucuggaucgaggagaaccccuggauggaggacaagacccacgugagcuccuggggcgacgugccguaccuggggaagcgggaggaccaguggugcggcagccugaucggccucacggcccgcgcgaccugggccuccaacauccaggucgccaucaaccaggugcgccggcugaucgggaacgagaacuaccuggacuacaugaccagcaugaagcgcuucaagaacgagggcgaccccgagggggcccucugguga

SEQ ID NO: 8493 - RNA, 9879 nt, Artificial Sequence
  derived and/or modified CDS sequence (opt1) from DENV-1__GQ199784__SS-prME
agcgugaccaugcugcucaugcugaugcccaccgcccuggccuuccaccucaccacccggggcggggagccccacaugaucgugaccaagcaggagcggggcaagagccugcuguucaagaccagcgcgggggugaacaugugcacccucaucgccauggaccugggcgagcugugcgaggacaccaugaccuacaagugcccccggaucaccgaggccgagcccgacgacguggacugcuggugcaacgccaccgacaccugggucaccuacgggaccugcagccagaccggcgagcaccggcgcgacaagcggagcguggcccucgcgccccacgugggccuggggcuggagacccgcaccgagaccuggauguccagcgagggcgccuggaagcagauccagcgggucgagacgugggcccuccgccaccccggguucaccgugaucgcccuguuccuggcgcacgugaucggcaccuccaucacccagaaggggaucaucuucauccuccugaugcuggucacgcccagcauggccaugcggugcgugggcaucggcucccgcgacuucguggaggggcucagcggcgccaccugggucgacguggugcuggagcacggguccugcgucaccaccauggccaaggacaagcccacgcuggacaucgagcuccugaagaccgaggugaccaaccccgccgugcugcggaagcucugcaucgaggcgaagaucagcaacaccacgaccgacucccgcugccccacccagggcgaggccacccugauggaggagcaggacgccaacuucgucugccggcgcacguucguggaccggggcugggggaacggcugcgggcuguucggcaaggggagccucaucacgugcgccaaguucaagugcgugaccaagcuggagggcaagaucguccaguacgagaaccugaaguacuccgugaucgugaccguccacacgggcgaccagcaccagguggggaacgagagcaccgagcacggcaccaccgccaccaucacgccccaggcgcccaccuccgagauccagcucaccgacuacggggcccugacccuggacugcagcccccgcacgggccucgacuucaacgagaugguccugcugaccaugaaggagaaguccuggcucgugcacaagcagugguuccuggaccugccgcuccccuggaccagcggggccagcaccucccaggagacguggaaccggcaggaccugcuggugaccuucaagaccgcccacgccaagaagcaggaggucguggugcucggcagccaggagggcgcgaugcacaccgcccugacgggggccaccgagauccagaccuccggcaccacgaccaucuucgccgggcaccugaagugccgccucaagauggacaagcugacccugaagggcaugagcuacgucaugugcaccggguccuucaagcucgagaaggagguggccgagacgcagcacggcaccgugcugguccagaucaaguacgagggcaccgacgcgcccugcaagauccccuucagcacccaggacgagaagggggugacgcagaacggccggcugaucaccgccaacccgaucgugaccgacaaggagaagcccgucaacaucgaggccgagccgcccuucggggaguccuacaucgugaucggcgccggcgagaaggcgcugaagcucagcugguucaagaagggguccagcaucggcaagauguucgaggccaccgcccgcggggcccggcgcauggccauccugggcgacacggcgugggacuucggguccaucggcggcguguucaccagcgucgggaagcuggugcaccagaucuucggcaccgccuacggggugcuguucuccggcgucagcuggaccaugaagaucgggcugggcgugcugcucacguggcugggccugaacucccgcagcaccucccucagcaugaccugcaucgccguggggcuggucacccuguaccucggcgugauggugcaggccgacuccgggugcgucaucaacuggaagggccgggagcugaagugcgggagcggcaucuucgugacgaacgaggugcacaccuggaccgagcaguacaaguuccaggccgacagcccgaagcgccuguccgcggccaucggcaaggccugggaggagggggucugcggcauccggagcgccacccgccucgagaacaucauguggaagcagaucuccaacgagcugaaccacauccugcucgagaacgacaugaaguucaccgugguggucggggacguggugggcauccuggcccaggggaagaagaugauccggccccagcccauggagcacaaguacagcuggaaguccuggggcaaggcgaagaucaucggcgccgacguccagaacacgaccuucaucaucgacgggcccaacaccccggagugccccgacgaccagcgcgccuggaacaucugggagguggaggacuacggcuucgggaucuucaccacgaacaucuggcugaagcuccgggacagccacacccaggugugcgaccaccgccugauguccgccgcgaucaaggacagcaaggccguccacgccgacaugggcuacuggaucgaguccgagaagaacgagaccuggaagcuggcccgggccagcuucaucgaggugaagaccugcaucuggcccaagucccacacgcucuggagcaacggcgugcuggaguccgagaugaucauccccaagaucuacgggggcccgaucagccagcacaacuaccgccccggguacuucacccagaccgcgggccccuggcaccuggggaagcucgagcuggacuucgaccugugcgagggcaccacggucgugguggacgagcacugcggcaaccgggggccgucccuccgcaccaccaccgucacgggcaagaucauccacgaguggugcugccggagcugcacccugccgccccugcgcuucaagggggaggacggcugcugguacgggauggagauccggcccgugaaggagaaggaggagaaccucgugaaguccauggucagcgccggcagcggcgagguggacuccuucagccuggggcugcucugcaucuccaucaugaucgaggaggugaugcgcagccgguggucccgcaagaugcugaugaccggcacccuggccgucuuccuccugcugaucauggggcagcucacguggaacgaccugauccggcugugcaucauggugggcgccaacgccagcgaccgcauggggaugggcaccaccuaccucgcgcugauggccaccuucaagaugcgcccgauguucgccgugggccuccuguuccggcgccugacgucccgggagguccugcuccugaccaucgggcugagccucguggccuccgucgagcugcccaacagccuggaggagcucggcgacgggcuggccaugggcaucaugauccugaagcuccugaccgacuuccagucccaccagcugugggcgacccuccugagccugacguucaucaagaccacccucucccugcacuacgccuggaagaccauggccauggugcugagcaucgugucccucuucccccugugccugagcacgaccucccagaagaccaccuggcuccccguccugcugggcagccucgggugcaagccgcuggccauguuccugaucgcggagaacaagaucuggggccgcaaguccuggccccucaacgaggggaucauggccgugggcguggucagcauccugcugagcucccuccugaagaacgacgugccccuggccgggccccucaucgccggcggcaugcugaucgccugcuacgugaucagcggguccagcgcggaccugucccucgagaaggccgccgaggucagcugggaggaggaggccgagcacuccggcgccagccacaacauccugguggaggugcaggacgacgggacgaugaagaucaaggacgaggagcgggacgacacccugaccauccuccugaaggcgacccugcucgccgucuccggcguguacccgcugagcauccccgccacccuguucgugugguacuucuggcagaagaagaagcagcgcuccgggguccugugggacacgcccagcccgcccgagguggagcgggccgugcucgacgacggcaucuaccgcaucaugcagcggggccugcuggggcgcucccaggucggcguggggguguuccaggagaacgucuuccacaccauguggcacgugacccggggcgccgugcucauguaccaggggaagcgccuggagcccagcugggcguccgucaagaaggaccugaucagcuacggcggcggguggcggcuccagggcuccuggaacaccggggaggagguccaggugaucgccgucgagcccggcaagaaccccaagaacgugcagacggcccccgggaccuucaagacccccgagggcgaggugggcgccaucgcccuggacuucaagcccgggaccagcggcucccccaucgucaaccgcgaggggaagaucgugggccuguacggcaacgggguggucacgaccagcggcaccuacgugagcgcgaucgcccaggccaaggccucccaggaggggccgcuccccgagaucgaggacgagguguuccggaagcgcaaccugaccaucauggaccugcaccccggcagcgggaagacgcggcgcuaccucccggcgaucguccgggaggccaucaagcgcaagcugcggacccugauccucgcccccacccgcgugguggccuccgagauggccgaggcgcugaagggcaugcccauccgcuaccagaccacggccgucaagagcgagcacaccggcaaggagaucguggaccugaugugccacgccaccuucaccaugcggcuccugucccccgugcgcgucccgaacuacaacaugaucaucauggacgaggcccacuucacggaccccagcuccaucgccgcgcggggguacaucagcacccgcgugggcaugggggaggccgccgccaucuucaugaccgccacgccgcccggcuccguggaggcguucccgcagagcaacgccgucauccaggacgaggagcgggacauccccgagcgcuccuggaacagcggguacgaguggaucacggacuuccccggcaagaccgugugguucgugcccuccaucaagagcggcaacgacaucgccaacugccugcggaagaacgggaagcgcgucauccagcucucccggaagaccuucgacaccgaguaccagaagacgaagaacaacgacugggacuacguggugaccaccgacaucagcgagaugggcgccaacuuccgcgcggaccgggucaucgacccgcgccggugccugaagcccgugauccugaaggacgggcccgagcgcgucauccucgccggccccaugccggugaccguggccuccgccgcccagcggcgcgggcggaucggccgcaaccacaacaaggagggcgaccaguacaucuacauggggcagccccugaacaacgacgaggaccacgcgcacuggacggaggccaagaugcugcucgacaacaucaacacccccgagggcaucauccccgcccuguucgagccggagcgggagaaguccgccgccaucgacggggaguaccgccugcgcggcgaggcgcggaagaccuucgucgagcucaugcgccgcggggaccugcccguguggcuguccuacaagguggccagcgagggcuuccaguacagcgaccgccgguggugcuucgacggcgagcgcaacaaccagguccucgaggagaacauggacguggagaucuggaccaaggagggggagcggaagaagcugcgcccccgguggcuggacgcccgcacguacuccgacccccucgcccugcgggaguucaaggaguucgccgcgggccgccggagcguguccggggaccugauccucgagaucggcaagcugccgcagcaccugacccagcgcgcccagaacgcccucgacaaccuggucaugcugcacaacagcgagcagggcgggcgggccuaccgccacgcgauggaggagcuccccgacaccaucgagacccugaugcugcucgcccugaucgccgugcugacgggcggggugacccucuucuuccuguccggccgggggcugggcaagaccagcaucggccuccugugcgucauggccuccagcgugcugcucuggauggccuccguggagccccacuggaucgcggccagcaucauccuggaguucuuccugaugguccuccugauccccgagccggaccgccagcggacgccccaggacaaccagcuggccuacguggugaucgggcuccuguucaugauccugaccgucgccgccaacgagaugggccuccuggagacgaccaagaaggaccuggggaucggccacguggcgguggagaaccaccaccacgccaccaugcucgacgucgaccugcaccccgccuccgccuggacccuguacgccguggcgacgaccaucaucaccccgaugaugcgccacaccaucgagaacacgaccgccaacaucagccucaccgccaucgccaaccaggccgcgauccugauggggcuggacaagggcuggcccaucuccaagauggacaucggcgugccccuccuggcccuggggugcuacagccaggucaacccccucacccugacggccgccgugcugaugcucguggcgcacuacgccaucaucggcccggggcugcaggccaaggccacccgggaggcccagaagcgcaccgcggccggcaucaugaagaaccccaccgucgacgggaucguggccaucgaccuggaccccguggucuacgacgccaaguucgagaagcagcucggccagaucaugcugcugauccucugcacgucccagauccugcugaugcgcaccaccugggcccucugcgagagcaucacccuggcgacgggcccccugaccacccucugggagggguccccgggcaaguucuggaacaccacgaucgccgugagcauggccaacaucuuccggggguccuaccuggccggcgccggccuggcguucagccucaugaagucccucgggggcgggcgccgggggaccggggcccagggcgagacccugggcgagaaguggaagcgccagcucaaccagcuguccaagagcgaguucaacaucuacaagcgguccgggaucauggagguggaccgcagcgaggccaaggagggccugaagcgcggggagaccacgcgccacgccgucucccggggcaccgcgaagcugcgcugguucguggagcggaaccucgugaagcccgaggggaaggucaucgaccugggcugcggccgcgggggcuggagcuacuacugcgccgggcugaagaaggugaccgaggugaagggcuacaccaagggcgggcccggccacgaggagcccaucccgauggccacguacggguggaaccucgucaagcugcacuccggcaaggacguguucuucacgccgcccgagaagugcgacacccugcucugcgacaucggggagagcucccccaacccgaccaucgaggagggccggacgcugcgcgugcugaagauggucgagcccuggcuccgggggaaccaguucugcaucaagauccugaaccccuacaugcccagcgugguggagacccuggagcagaugcagcgcaagcacggcggcaugcucguccggaacccgcugucccgcaacagcacccacgagauguacuggguguccugcgggaccggcaacaucgugagcgccgucaacaugaccucccggaugcugcucaaccgcuucacgauggcccaccgcaagcccaccuacgagcgggacguggaccugggggcgggcacccgccacguggccgucgagcccgagguggccaaccuggacaucaucggccagcggaucgagaacaucaagcacgagcacaagagcaccuggcacuacgacgaggacaaccccuacaagacgugggccuaccacggguccuacgaggucaagccgagcggcuccgccagcagcauggugaacgggguggucaagcuccugaccaagcccugggacgugauccccauggugacccagaucgcgaugaccgacacgacccccuucggccagcagcgcgucuucaaggagaagguggacacccggaccccgaaggccaagcgcgggacggcccagaucauggaggugaccgcccgguggcuguggggcuuccucucccgcaacaagaagccccggaucugcacccgcgaggaguucacccggaagguccgcagcaacgccgcgaucggcgccguguucguggacgagaaccaguggaacuccgccaaggaggccgucgaggacgagcgguucugggaccuggugcagaaggagcgcgagcugcacaagcaggggaagugcgcgacgugcguguacaacaugaugggcaagcgggagaagaagcucggggaguucggcaaggccaaggggagccgcgccaucugguacauguggcugggcgcccgguuccuggaguucgaggcccucggcuucaugaacgaggaccacugguucucccgcgagaacagccuguccggggucgagggcgaggggcugcacaagcucggcuacauccugcgggacaucagcaagauccccgggggcaacauguacgcggacgacaccgccggcugggacacccgcaucaccgaggacgaccugcagaacgaggcccggaucacggacaucauggagccggagcacgcccuccuggccaccuccaucuucaagcugaccuaccagaacaagguggugcgcguccagcgccccgcgaagaacgggaccgugauggacgugaucagccggcgcgaccagcggggcuccgggcaggucggcacguacggccucaacaccuucaccaacauggaggcccagcugauccgccagauggagagcgaggggaucuuccugcccuccgagcucgagacccagaaccuggccgagcgggugcuggacuggcucgagaaguacggcguggagcgccugaagcggauggccaucagcggggacgacugcgucgugaagcccaucgacgaccgcuucgccacggcgcugaccgcccucaacgacaugggcaaggugcggaaggacaucccgcagugggagcccuccaagggguggaacgacuggcagcagguccccuucugcagccaccacuuccaccagcugaucaugaaggacggccgcgagaucguggugcccugccggaaccaggacgagcuggucggccgcgcccgggugucccagggggccggcuggagccuccgcgagaccgccugccugggcaagagcuacgcgcagauguggcagcugauguacuuccaccggcgcgaccuccggcuggccgccaacgccaucugcuccgcggugccggucgacugggugcccaccagccgcacgaccugguccauccacgcccaccaccaguggaugaccaccgaggacaugcugagcguguggaaccgggucuggaucgaggagaaccccuggauggaggacaagacgcacguguccagcuggggcgacgugcccuaccucgggaagcgcgaggaccaguggugcggcucccugaucggccugaccgcccgcgccaccugggccagcaacauccaggucgcgaucaaccaggugcggcgccucaucgggaacgagaacuaccuggacuacaugaccuccaugaagcgguucaagaacgagggcgacccggagggggcccugugguga

SEQ ID NO: 8494 - RNA, 9879 nt, Artificial Sequence
  derived and/or modified CDS sequence (opt1) from DENV-1__GQ199785__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccgcaucaccgagguggagcccgacgacguggacugcuggugcaacaccaccgacaccugggugaccuacgggaccugcagccagacgggcgagcaccggcgcgacaagcggagcguggcccucgcgccccacgucggccuggggcuggagacccgcgccgagaccuggaugagcuccgagggcgcguggaagcagauccagaagguggagaccugggcccuccggcaccccggguucacggugaucgcccuguuccuggcccacgcgaucggcaccagcaucacccagaaggggaucaucuucauccuccugaugcuggucacccccuccauggccaugcgcugcgugggcaucggcagccgggacuucguggaggggcucuccggcgccacgugggucgacguggugcuggagcacgggagcugcgucaccaccauggccaaggacaagcccacccuggacaucgagcuccugaagacggaggugaccaaccccgccgugcugcgcaagcucugcaucgaggcgaagaucuccaacaccaccacggacagccggugcccgacccagggcgaggccacccuggucgaggagcaggacgccaacuucgugugccgccggaccuucguggaccgcggcugggggaacggcugcgggcuguucggcaaggggucccucaucacgugcgccaaguucaagugcgucaccaagcuggagggcaagaucgugcaguacgagaaccugaaguacagcgugaucgucaccgugcacaccggcgaccagcaccaggucgggaacgaguccacggagcacggcaccaccgccaccaucacgccccaggcgcccacgagcgagauccagcucaccgacuacggggcccugacccuggacugcagcccccggaccggccucgacuucaacgagauggugcugcugacgaugaaggagaaguccuggcucgugcacaagcagugguuccuggaccugccccuccccuggaccagcggggccuccaccagccaggagaccuggaaccgccaggaccugcuggucacguucaagaccgcccacgccaagaagcaggagguggugguccucggcucccaggagggcgcgaugcacaccgcccugaccggggccacggagauccagaccagcggcaccaccacgaucuucgccgggcaccugaagugccggcucaagauggacaagcugacccugaagggcauguccuacgugaugugcaccgggagcuucaagcucgagaaggagguggccgagacccagcacggcacgguccuggugcagaucaaguacgagggcaccgacgcgcccugcaagauccccuucuccacccaggacgagaagggggugacccagaacggccgccugaucacggccaacccgaucgucaccgacaaggagaagcccgugaacaucgaggccgagccgcccuucggggagagcuacaucgugaucggcgccggcgagaaggcgcugaagcucuccugguucaagaaggggagcuccaucggcaagauguucgaggccaccgcccgcggggcccgccggauggccauccugggcgacaccgcgugggacuucgggagcaucggcggcgucuucacguccguggggaagcuggugcaccagaucuucggcaccgccuacgggguccucuucagcggcguguccuggaccaugaagaucgggaucggcgugcugcugaccuggcucggccugaacagccgcuccacgagccuguccaugaccugcaucgccgucgggcucgugacccuguaccugggcgugaugguccaggccgacagcgggugcgugaucaacuggaagggccgcgagcucaagugcgggagcggcaucuucgugaccaacgagguccacacguggaccgagcaguacaaguuccaggccgacuccccgaagcggcugagcgcggccaucggcaaggccugggaggagggggugugcggcauccgcuccgccacccggcuggagaacaucauguggcgccagaucagcaacgagcucaaccacauccugcuggagaacgacaugaaguucaccguggucgugggggacguggucggcauccucgcccaggggaagaagaugauccggccccagcccauggagcacaaguacuccuggaaguccuggggcaaggcgaagaucaucggcgccgacgugcagaacaccacguucaucaucgacgggcccaacaccccggagugccccgacgaccagcgcgccuggaacaucugggagguggaggacuacggcuucgggaucuucaccaccaacaucuggcugaagcugcgggacuccuacacgcaggucugcgaccaccgccucaugagcgccgcgaucaaggacuccaaggccgugcacgccgacaugggcuacuggaucgagagcgagaagaacgagaccuggaagcuggcccgggccuccuucaucgaggugaagaccugcaucuggcccaagagccacacccugugguccaacggcguccucgagagcgagaugaucauccccaagaucuacgggggcccgaucucccagcacaacuaccgccccggguacuucacgcagaccgcgggccccuggcaccuggggaagcuggagcucgacuucgaccugugcgagggcaccaccgugguggucgacgagcacugcggcaaccgggggccgagccugcgcacgaccaccgugaccggcaagaucauccacgaguggugcugccgguccugcacgcugccgccccuccgcuucaagggggaggacggcugcugguacgggauggagauccggcccgugaaggagaaggaggagaaccuggucaagagcauggugagcgccggcuccggcgagguggacagcuucucccucgggcugcugugcaucagcaucaugaucgaggaggucaugcgcucccgguggagccgcaagaugcucaugaccggcacccuggccguguucuuccugcucaucauggggcagcugaccuggaacgaccugauccgguccugcaucauggugggcgccaacgccagcgaccgcauggggaugggcacgaccuaccucgcgcugauggccaccuucaagaugcgcccgauguucgccgucgggcugcuguuccggcgccugaccucccgggaggugcugcuccugacgaucgggcugagccucgucgccuccguggagcugcccaacagccuggaggagcucggcgacgggcuggccaugggcaucaugauccugaagcuccugaccgacuuccaguccuaccagcugugggcgacccuccugagccugaccuucaucaagacgaccuucucccuccacuacgccuggaagaccauggccauggugcugagcaucgucucccugcucccccugugccugagcaccacgucccagaagaccaccuggcuccccgugcugcugggcagccucgggugcaagccgcugaccauguuccugaucgccgagaacaagaucuggggccgcaagagcuggccccucaacgaggggaucauggcggugggcaucgucuccauccugcugagcucccuccugaagaacgacgugccccuggccgggccccucaucgccggcggcaugcugaucgccugcuacgugaucagcggguccagcgccgaccugucccucgagaaggcggccgaggucagcugggaggaggaggccgagcacuccggcgccagccacaacauccugguggaggugcaggacgacgggacgaugaagaucaaggacgaggagcgggacgacacccugaccauccuccugaaggccacccugcucgcggucuccggcguguacccgcugagcauccccgccacccuguucgugugguacuucuggcagaagaagaagcagcgcuccgggguccucugggacacgcccagcccgcccgagguggagcgggccgugcuggacgacggcaucuaccgcaucaugcagcggggccugcuggggcgcucccaggucggcguggggguguuccaggagaacgucuuccacaccauguggcacgugacccggggcgccgugcucauguaccaggggaagcgccuggagcccagcugggccuccgucaagaaggaccugaucagcuacggcggcggguggcggcuccagggcuccuggaacaccggggaggagguccaggugaucgcggucgagcccggcaagaaccccaagaacgugcagacggcccccgggaccuucaagacccccgagggcgaggugggcgccaucgcccuggacuucaagcccgggaccagcggcagccccaucgucaaccgcgaggggaagaucgugggccuguacggcaacgggguggucacgaccuccggcaccuacgugagcgccaucgcgcaggccaaggccucccaggaggggccgcuccccgagaucgaggacgagguguuccggaagcgcaaccugaccaucauggaccugcaccccggcagcgggaagacgcggcgcuaccucccggccaucguccgggaggcgaucaagcgcaagcugcggacccugauccucgcccccacccgcgugguggccuccgagauggccgaggcccugaagggcaugcccauccgcuaccagaccacggcggucaagagcgagcacaccggccgggagaucguggaccugaugugccacgccaccuucaccaugcgccuccugucccccgugcgggucccgaacuacaacaugaucaucauggacgaggcccacuucacggaccccagcuccaucgccgcccgcggguacaucagcacccgggugggcaugggggaggcggccgccaucuucaugaccgccacgccgcccggcuccguggaggccuucccgcagagcaacgcggucauccaggacgaggagcgcgacauccccgagcgguccuggaacagcggguacgaguggaucacggacuuccccggcaagaccgugugguucgugcccuccaucaagagcggcaacgacaucgccaacugccugcgcaagaacgggaagcgggucauccagcucucccgcaagaccuucgacaccgaguaccagaagacgaagaacaacgacugggacuacguggugaccaccgacaucagcgagaugggcgccaacuuccgggccgaccgcgucaucgacccgcggcgcugccugaagcccgugauccugaaggacgggcccgagcgggucauccucgcgggccccaugccggugaccguggccuccgccgcccagcgccgggggcgcaucggccggaaccacaacaaggagggcgaccaguacaucuacauggggcagccccugaacaacgacgaggaccacgcccacuggacggaggcgaagaugcugcucgacaacaucaacacccccgagggcaucauccccgcccuguucgagccggagcgcgagaaguccgccgccaucgacggggaguaccgccugcggggcgaggcccgcaagaccuucgucgagcucaugcggcgcggggaccugcccguguggcugagcuacaagguggcguccgagggcuuccaguacagcgaccggcgcuggugcuucgacggcgagcggaacaaccagguccucgaggagaacauggacguggagaucuggaccaaggagggggagcgcaagaagcugcggccccgcuggcuggacgcccggacguacuccgacccccucgcccugcgcgaguucaaggaguucgccgccggccggcgcagcguguccggggaccugauccucgagaucggcaagcugccgcagcaccugacccagcgggcgcagaacgcccucgacaaccuggucaugcugcacaacagcgagcagggcgggcgcgccuaccggcacgccauggaggagcuccccgacaccaucgagacccugaugcugcucgcgcugaucgccgugcugacgggcggggugacccucuucuuccuguccggcaaggggcugggcaagaccagcaucggccuccugugcgucauggccuccagcgcccugcucuggauggccuccguggagccccacuggaucgcggccagcaucauccuggaguucuuccugauggugcuccugauccccgagccggaccgccagcggacgccccaggacaaccagcuggccuacgucgugaucgggcuccuguucaugauccugaccguggccgccaacgagaugggccuccuggagacgaccaagaaggaccuggggaucggccacgucgcgguggagaaccaccaccacgccaccaugcucgacguggaccugcaccccgccuccgccuggacccuguacgccgucgcgacgaccaucaucaccccgaugaugcgccacaccaucgagaacacgaccgccaacaucagccucaccgccaucgccaaccaggccgcgauccugauggggcuggacaagggcuggcccaucuccaagauggacaucggcgugccccuccuggcccuggggugcuacagccaggugaacccccucacccugacggccgccguccugaugcucguggcgcacuacgccaucaucggcccggggcugcaggccaaggccacccgggaggcccagaagcgcaccgcggccggcaucaugaagaaccccaccguggacgggaucgucgccaucgaccuggaccccgugguguacgacgccaaguucgagaagcagcucggccagaucaugcugcugauccucugcacgucccagauccugcugaugcgcaccaccugggcccucugcgagagcaucacccuggcgacgggcccccugaccacccucugggagggguccccgggcaaguucuggaacaccacgaucgccgucagcauggccaacaucuuccgggggagcuaccuggccggcgccggccuggcguucucccucaugaagucccucgggggcgggcgccgggggaccggggcccagggcgagacccugggcgagaaguggaagcgccagcucaaccagcuguccaagagcgaguucaacaccuacaagcgguccgggaucauggagguggaccgcagcgaggccaaggagggccugcggcgcggggagacgaccaagcacgccgugucccggggcaccgcgaagcuccgcugguucgucgagcggaaccuggugaagcccgaggggaaggugaucgaccugggcugcggccgcgggggcuggagcuacuacugcgccgggcugaagaaggucaccgaggugaagggcuacacgaagggcgggcccggccacgaggagcccaucccgauggccaccuacggguggaaccucgugaagcugcacuccggcaaggacgucuucuucaucccgcccgagaagugcgacacccugcucugcgacaucggggagagcucccccaacccgaccaucgaggagggccggacgcugcgcgugcugaagaugguggagcccuggcuccgggggaaccaguucugcaucaagauccugaaccccuacaugcccagcgucguggagacccuggagcagaugcagcgcaagcacggcggcaugcucgugcggaacccgcugucccgcaacagcacccacgagauguacugggucuccugcgggaccggcaacaucgugagcgccgugaacaugaccucccggaugcugcucaaccgcuucacgauggcccaccgcaagcccaccuacgagcgggacgucgaccugggggcgggcacccgccacguggccguggagcccgaggucgccaaccuggacaucaucggccagcggaucgagaacaucaagcacgagcacaagagcaccuggcacuacgacgaggacaaccccuacaagacgugggccuaccacggguccuacgaggugaagccgagcggcagcgccuccagcauggucaacgggguggugaagcuccugaccaagcccugggacgucauccccauggugacccagaucgcgaugaccgacacgacccccuucggccagcagcgcguguucaaggagaaggucgacacccggaccccgaaggccaagcgcgggacggcccagaucauggaggugaccgccaaguggcuguggggcuuccucucccggaacaagaagccccgcaucugcacccgggaggaguucacccgcaaggugcggagcaacgccgcgaucggcgccgucuucguggacgagaaccaguggaacuccgccaaggaggccguggaggacgagcgcuucugggaccugguccaccgggagcgcgagcugcacaagcaggggaagugcgcgacgugcguguacaacaugaugggcaagcgggagaagaagcucggggaguucggcaaggccaaggggagccgcgccaucugguacauguggcugggcgcccgguuccuggaguucgaggcccucggcuucaugaacgaggaccacugguucucccgcgagaacagccuguccgggguggagggcgaggggcugcacaagcucggcuacauccugcgggacaucagcaagauccccgggggcaacauguacgcggacgacaccgccggcugggacacccgcaucaccgaggacgaccugcagaacgaggccaagaucacggacaucaugaagccggagcacgcccuccuggccaccuccaucuucaagcugaccuaccagaacaaggucgugcgggugcagcgccccgcgcgcaacgggaccgucauggacgugaucagccggcgcgaccagcggggcuccggccaggugggcacguacggccucaacaccuucaccaacauggaggcccagcugauccgccagauggagagcgaggggaucuucucccccagcgagcuggagacccccaaccucgccgagcggguccuggacuggcuggagaagcacggcguggagcgccucaagcggauggccaucuccggggacgacugcguggucaagccgaucgacgaccgcuucgccacggcgcugagcgcccugaacgacaugggcaaggugcggaaggacaucccccagugggagcccagcaagggguggaacgacuggcagcagguccccuucugcucccaccacuuccaccagcucaucaugaaggacggccgcgagaucgucgugccgugccggaaccaggacgagcuggugggccgcgcccgggucagccagggggccggcuggucccugcgcgagaccgccugccucggcaagagcuacgcgcagauguggcagcugauguacuuccaccggcgcgaccugcggcucgccgccaacgccaucugcuccgcggugcccguggacuggguccccaccagccgcaccacgugguccauccacgcccaccaccaguggaugaccaccgaggacaugcugagcguguggaaccggguguggaucgaggagaaccccuggauggaggacaagacccacaucuccagcuggggcgacgucccguaccuggggaagcgcgaggaccaguggugcggcucccucaucggccugacggcccgcgccaccugggccaccaacauccagguggcgaucaaccaggugcggcgccugaucgggaacgagaacuaccucgacuacaugaccagcaugaagcgguucaagaacgaguccgaccccgagggcgcccugugguga

SEQ ID NO: 8495 - RNA, 9879 nt, Artificial Sequence
  derived and/or modified CDS sequence (opt1) from DENV-1__GQ199786__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgagaccgagcccgacgacguggacugcuggugcaacgccaccgacaccugggugaccuacgggaccugcagccagacgggcgagcaccggcgggacaagcgguccguggcccucgcgccccacgugggccuggggcuggagacccgcaccgagaccuggaugagcuccgagggcgcguggaagcagauccagcgggucgagacgugggcccuccggcaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagguggccgagacccagcacggcaccgugcugguccagaucaaguacgagggcaccgacgcgcccugcaagauccccuucagcacgcaggacgagaagggggugacccagaacggccggcugaucaccgccaacccgaucgugaccgacaaggagaagcccgucaacaucgaggccgagccgcccuucggggaguccuacaucgugaucggcgccggcgagaaggcgcugaagcucagcugguucaagaagggguccagcaucggcaagauguucgaggccacggcccgcggggcccggcgcauggccauccugggcgacaccgcgugggacuucggguccaucggcggcguguucaccagcgucgggaagcuggugcaccagaucuucggcaccgccuacggggugcuguucuccggcgucagcuggacgaugaagaucgggaucggcgugcugcugaccuggcucggccugaacucccgcagcaccucccugagcaugaccugcaucgccguggggcucgucacgcuguaccugggcgugauggugcaggccgacuccgggugcgucaucaacuggaagggccgggagcucaagugcgggagcggcaucuucgugaccaacgaggugcacaccuggaccgagcaguacaaguuccaggccgacagcccgaagcgccuguccgcggccaucggcaaggccugggaggagggggucugcggcauccggagcgccacccgccuggagaacaucauguggaagcagaucuccaacgagcucaaccacauccugcuggagaacgacaugaaguucacggugguggucggggacguggccggcauccucgcgcaggggaagaagaugauccggccccagcccauggaguacaaguacagcuggaaguccuggggcaaggccaagaucaucggcgccgacgugcagaacaccaccuucaucaucgacgggcccaacaccccggagugccccgacgaccagcgcgccuggaacaucugggaggucgaggacuacggcuucgggaucuucacgaccaacaucuggcugaagcugcgggacagcuacacccaggugugcgaccaccgccucauguccgcggccaucaaggacagcaaggccgugcacgccgacaugggcuacuggaucgaguccgagaagaacgagaccuggaagcuggcccgggcgagcuucaucgaggucaagacgugcaucuggcccaagucccacacccuguggagcaacggcgugcucgaguccgagaugaucauccccaagaucuacgggggcccgaucagccagcacaacuaccgccccggguacuucacccagaccgccggccccuggcaccuggggaagcuggagcucgacuucgaccugugcgagggcacgaccguggucguggacgagcacugcggcaaccgggggccgucccugcgcaccaccacggugaccggcaagaucauccacgaguggugcugccggagcugcacccugccgccccuccgcuuccgcggggaggacggcugcugguacgggauggagauccgccccgucaaggagaaggaggagaaccuggugaaguccauggugagcgccggcagcggcgaggucgacuccuucagccucgggcugcugugcaucuccaucaugaucgaggaggugaugcggagccgcuggucccggaagaugcucaugaccggcacgcuggccguguucuuccugcucaucauggggcagcugaccuggaacgaccugauccgccucugcaucauggucggcgccaacgcgagcgaccgcauggggaugggcaccaccuaccuggcccugauggccacguucaagaugcggccgauguucgccgugggccuccuguuccgccggcugaccucccgcgaggugcuccugcugaccaucgggcucagccuggucgccuccguggagcugcccaacagccucgaggagcugggcgacgggcuggcgaugggcaucaugauccucaagcugcugaccgacuuccagucccaccagcucugggccacgcugcugagccucaccuucaucaagaccaccuucucccugcacuacgccuggaagacgauggccaugguccugagcaucgugucccucuucccccugugccugagcaccaccucccagaagaccacguggcuccccgugcugcugggcagccucgggugcaagccgcugaccauguuccugaucgcggagaacaagaucuggggccggcgcuccuggccccucaacgaggggaucauggccgucggcaucgugagcauccugcugagcucccuccugaagaacgacgugccccuggccgggccccucaucgccggcggcaugcugaucgccugcuacgucaucagcggguccagcgcggaccugucccucgagaaggccgccgaggugagcugggaggaggaggccgagcacuccggcgccagccacaacauccugguggagguccaggacgacgggaccaugaagaucaaggacgaggagcgggacgacacccugaccauccuccugaaggcgacgcugcucgccguguccggcguguacccgcugagcauccccgccacccuguucgucugguacuucuggcagaagaagaagcagcgcuccggggugcucugggacacccccagcccgcccgagguggagcgggccguccuggacgacggcaucuaccgcaucaugcagcggggccugcuggggcgcucccaggugggcgugggggucuuccaggagaacguguuccacaccauguggcacgugacgcggggcgccguccucauguaccaggggaagcgccuggagcccagcugggcguccgugaagaaggaccugaucagcuacggcggcggguggcggcuccagggcuccuggaacaccggggaggaggugcaggucaucgccguggagcccggcaagaaccccaagaacgugcagaccgcccccgggaccuucaagacgcccgagggcgaggucggcgccaucgcccuggacuucaagcccgggaccagcggcucccccaucgugaaccgcgaggggaagaucgugggccuguacggcaacggggucgugaccaccagcggcacguacgugagcgcgaucgcccaggccaaggccucccaggaggggccgcuccccgagaucgaggacgaggucuuccggaagcgcaaccugaccaucauggaccugcaccccggcagcgggaagacccggcgcuaccucccggcgaucgugcgggaggccaucaagcgcaagcugcgcacccugauccucgcccccacgcggguggucgccuccgagauggccgaggcgcugaagggcaugcccauccgcuaccagaccaccgccgucaagagcgagcacaccggcaaggagaucguggaccugaugugccacgccacguucaccaugcggcuccugucccccguccgcgugccgaacuacaacaugaucaucauggacgaggcccacuucaccgaccccagcuccaucgccgcgcggggguacaucagcacccgcgugggcaugggggaggccgccgccaucuucaugacggccacgccgcccggcuccgucgaggcguucccgcagagcaacgccgugauccaggacgaggagcgggacauccccgagcgcuccuggaacagcggguacgaguggaucaccgacuuccccggcaagaccgugugguucguccccuccaucaagagcggcaacgacaucgccaacugccugcggaagaacgggaagcgcgugauccagcucucccggaagacguucgacaccgaguaccagaagaccaagaacaacgacugggacuacguggucaccacggacaucagcgagaugggcgccaacuuccgcgcggaccgggugaucgacccgcgccggugccugaagcccgugauccugaaggacgggcccgagcgcgucauccucgccggccccaugccggugaccgucgccuccgccgcccagcggcgcgggcggaucggccgcaaccacaacaaggagggcgaccaguacaucuacauggggcagccccugaacaacgacgaggaccacgcgcacuggaccgaggccaagaugcugcucgacaacaucaacacccccgagggcaucauccccgcccuguucgagccggagcgcgagaaguccgccgccaucgacggggaguaccggcugcgcggcgaggcgcggaagacguucguggagcucaugcgccgcggggaccugcccguguggcuguccuacaaggucgccagcgagggcuuccaguacagcgaccgccgguggugcuucgacggcgagcgcaacaaccaggugcucgaggagaacauggacguggagaucuggaccaaggagggggagcggaagaagcugcgcccccgguggcuggacgcccgcaccuacuccgacccccucgcccugcgggaguucaaggaguucgccgcgggccgccggagcgucuccggggaccugauccucgagaucggcaagcugccgcagcaccugacccagcgcgcccagaacgcccucgacaaccuggugaugcugcacaacagcgagcagggcgggcgggccuaccgccacgcgauggaggagcuccccgacacgaucgagacccugaugcugcucgcccugaucgccgugcugaccggcggggucauccucuucuuccuguccggccgggggcugggcaagaccagcaucggccuccugugcgugauggccuccagcgugcugcucuggauggccuccgucgagccccacuggaucgcggccagcaucauccuggaguucuuccugauggugcuccugauccccgagccggaccgccagcggacgccccaggacaaccagcuggccuacguggucaucgggcuccuguucaugauccugacgguggccgccaacgagaugggccuccuggagaccaccaagaaggaccuggggaucggccacguggcggucgagaaccaccaccacgccgccaugcucgacguggaccugcaccccgccuccgccuggacccuguacgcgguggccacgaccaucaucaccccgaugaugcgccacaccaucgagaacacgaccgccaacaucagccucaccgccaucgccaaccaggcggccauccugauggggcuggacaagggcuggcccaucuccaagauggacaucggcgucccccuccuggcccuggggugcuacagccaggugaacccccucacccugacggccgcggugcugaugcucgucgcccacuacgccaucaucggcccggggcugcaggccaaggccacccgcgaggcgcagaagcggaccgccgccggcaucaugaagaaccccaccguggacgggaucguggccaucgaccuggaccccgucguguacgacgccaaguucgagaagcagcucggccagaucaugcugcugauccucugcacgucccagauccugcugaugcgcaccaccugggcgcucugcgagagcaucacccuggccacgggcccccugaccacccucugggagggguccccgggcaaguucuggaacaccacgaucgccgugagcauggccaacaucuuccggggguccuaccuggccggcgcgggccuggccuucagccucaugaagucccucgggggcgggcgccgggggaccggggcccagggcgagacccugggcgagaaguggaagcgccagcucaaccagcuguccaagagcgaguucaacaccuacaagcgguccgggaucauggaggucgaccgcagcgaggccaaggagggccugaagcgcggggagacgaccaagcacgcggugucccgcggcaccgccaagcuccggugguucguggagcgcaaccuggucaagcccgaggggaaggugaucgaccugggcugcggccgcgggggcuggagcuacuacugcgccgggcugaagaaggugaccgaggucaagggcuacacgaagggcggccccggccacgaggagcccaucccgauggccaccuacggguggaaccucgugaagcugcacuccggcaaggacguguucuucaucccgcccgagaagugcgacacccugcucugcgacaucggggagagcucccccaacccgaccaucgaggagggccgcacgcugcggguccugaagaugguggagcccuggcuccgcgggaaccaguucugcaucaagauccugaaccccuacaugcccagcguggucgagacccuggagcagaugcagcggaagcacggcggcaugcucgugcgcaacccgcugucccggaacagcacccacgagauguacuggguguccugcgggaccggcaacaucgucagcgccgugaacaugaccucccgcaugcugcucaaccgcuucacgauggcgcaccggaagcccaccuacgagcgcgacguggaccugggggccggcacccggcacgucgccguggagcccgagguggccaaccuggacaucaucggccagcgcaucgagaacaucaagcacgagcacaagagcaccuggcacuacgacgaggacaaccccuacaagacgugggccuaccacggguccuacgaggucaagccgagcggcuccgcgagcagcauggugaacggggucgugaagcuccugaccaagcccugggacgugauccccauggucacccagaucgccaugaccgacacgacccccuucggccagcagcggguguucaaggagaagguggacacccgcaccccgaaggccaagcgggggacggcccagaucauggaggucaccgccaaguggcuguggggcuuccucucccgcaacaagaagccccggaucugcacccgcgaggaguucacccggaaggugcgcagcaacgcggccaucggcgccguguucgucgacgagaaccaguggaacuccgccaaggaggcgguggaggacgagcgguucugggaccuggugcaccgcgagcgggagcugcacaagcaggggaagugcgccacgugcgucuacaacaugaugggcaagcgcgagaagaagcucggggaguucggcaaggccaaggggagccgggccaucugguacauguggcugggcgcccgcuuccuggaguucgaggcgcucggcuucaugaacgaggaccacugguucucccgggagaacagccuguccgggguggagggcgaggggcugcacaagcucggcuacauccugcgcgacaucagcaagauccccgggggcaacauguacgccgacgacaccgccggcugggacacccggaucaccgaggacgaccugcagaacgaggcccgcaucacggacaucauggagccggagcacgcccuccuggcgcgcuccaucuucaagcugaccuaccagaacaaggugguccgggugcagcgccccgccaagaacgggaccgugauggacgucaucagccggcgcgaccagcggggcuccggccagguggggaccuacggccucaacacguucaccaacauggaggcccagcugauccgccagauggagagcgaggggaucuucucccccagcgagcuggagacccccaaccucgccgagcgggugcuggacuggcuggagaaguacggcgucgagcgccucaagcggauggccaucuccggggacgacugcguggugaagccgaucgacgaccgcuucgcgaccgcccugacggcccugaacgacaugggcaagguccggaaggacaucccccagugggagcccagcaagggguggaacgacuggcagcagguccccuucugcucccaccacuuccaccagcucaucaugaaggacggccgcgagaucguggucccgugccggaaccaggacgagcuggugggccgcgcccgggugagccagggggccggcuggagccugcgcgagaccgcgugccucgggaaguccuacgcccagauguggcagcugauguacuuccaccggcgcgaccugcggcucgccgccaacgcgaucugcagcgccguccccguggacuggauccccaccucccgcaccacguggagcauccacgcccaccaccaguggaugaccaccgaggacaugcuguccguguggaaccgcgucuggaucgaggagaaccccuggauggaggacaagacccacaucagcuccuggggcgacgugccguaccuggggaagcgggaggaccaguggugcggcagccucaucggccugacggcccgcgccaccugggcgaccaacauccagguggccaucaaccagguccggcgccugaucgggaacgagaacuaccucgacuacaugaccuccaugaagcgguucaagaacgagagcgaccccgagggcgcccugugguga

SEQ ID NO: 8496 - RNA, 9879 nt, Artificial Sequence
  derived and/or modified CDS sequence (opt1) from DENV-1__GQ199787__SS-prME
agcgugaccaugcugcugaugcuggugcccaccgcccuggccuuccaccucaccacccggggcggggagccccacaugaucgugaccaagcaggagcggggcaagagccugcuguucaagaccagcgcgggggugaacaugugcacccucaucgccauggaccugggcgagcugugcgaggacaccaugaccuacaagugcccccggaucaccgaggccgagcccgacgacgucgacugcuggugcaacgccaccgacaccugggugaccuacgggaccugcagccagaccggcgagcaccggcgcgacaagcggagcguggcccucgcgccccacgucggccuggggcuggagacccgcaccgagaccuggauguccagcgagggcgccuggaagcagauccagcggguggagacgugggcccuccgccaccccggguucaccgugaucgcccuguuccuggcgcacgccaucggcaccuccaucacccagaaggggaucaucuucauccuccugaugcuggucacgcccagcauggccaugcggugcgugggcaucggcucccgcgacuucguggaggggcucagcggcgccaccugggucgacguggugcuggagcacggguccugcgucaccaccauggccaaggacaagcccacgcuggacaucgagcuccugaagaccgaggugaccaaccccgcggugcugcggaagcucugcaucgaggccaagaucagcaacaccacgaccgacucccgcugccccacccagggcgaggccacccugauggaggagcaggacgccaacuucgucugccggcgcacguucguggaccggggcugggggaacggcugcgggcuguucggcaaggggagccucaucacgugcgccaaguucaagugcgugaccaagcuggagggcaagaucguccaguacgagaaccugaaguacuccgugaucgugaccguccacacgggcgaccagcaccagguggggaacgagagcaccgagcacggcaccaccgcgaccaucacgccccaggcccccaccuccgagauccagcucaccgacuacggggcccugacccuggacugcagcccccgcacgggccucgacuucaacgagaugguccugcugaccaugaaggagaaguccuggcucgugcacaagcagugguuccuggaccugccgcuccccuggaccagcggggccagcaccucccaggagacguggaaccggcaggaccugcuggugaccuucaagaccgcccacgcgaagaagcaggaggucguggugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgucaugugcaccggguccuucaagcucgagaaggagguggcggagacgcagcacggcaccgugcugguccagaucaaguacgagggcaccgacgcccccugcaagauccccuucagcacccaggacgagaagggggugauccagaacggccggcugaucacggccaacccgaucgugaccgacaaggagaagcccgucaacaucgaggccgagccgcccuucggggaguccuacaucgugaucggcgugggcgagaaggcgcugaagcucagcugguucaagaagggguccagcaucggcaagauguucgaggccaccgcccgcggggcccggcgcauggccauccugggcgacaccgcgugggacuucggguccaucggcggcgucuucacgagcguggggaagcuggugcaccagaucuucggcaccgccuacgggguccucuucuccggcgugagcuggaccaugaagaucgggaucggcgugcugcugaccuggcucggccugaacucccgcagcacgucccugagcaugaccugcaucgccgucgggcucgugacccuguaccugggcgugaugguccaggccgacuccgggugcgugaucaacuggaagggccgggagcucaagugcgggagcggcaucuucgugaccaacgagguccacacguggaccgagcaguacaaguuccaggccgacagcccgaagcgccuguccgcggccaucggcaaggccugggaggagggggugugcggcauccggagcgccacccgccuggagaacaucauguggaagcagaucuccaacgagcucaaccacauccugcuggagaacgacaugaaguucaccguggucgugggggacguggucggcauccucgcccaggggaagaagaugauccggccccagcccauggagcacaaguacagcuggaaguccuggggcaaggcgaagaucaucggcgccgacgugcagaacaccacguucaucaucgacgggcccaacaccccggagugccccgacgaccagcgcgccuggaacaucugggagguggaggacuacggcuucgggaucuucaccaccaacaucuggcugaagcugcgggacagcuacacgcaggccugcgaccaccgccucauguccgcggccaucaaggacagcaaggccguccacgccgacaugggcuacuggaucgaguccgagaagaacgagaccuggaagcuggcccgggcgagcuucaucgaggugaagaccugcaucuggcccaagucccacacccuguggagcaacggcgugcucgaguccgagauggucauccccaagaucuacgggggcccgaucagccagcacaacuaccgccccggguacuucacgcagaccgccggccccuggcaccuggggaagcuggagcucgacuucgaccugugcgagggcaccaccgugguggucgacgagcacugcggcaaccgggggccgucccugcgcacgaccaccgugaccggcaagaucauccacgaguggugcugccggagcugcacgcugccgccccuccgcuucaagggggaggacggcugcugguacgggauggagauccggcccgugaaggagaaggaggagaaccuggucaaguccauggugagcgccggcagcggcgagguggacuccuucagccucgggcugcugugcaucuccaucaugaucgaggaggucaugcgcagccgguggucccgcaagaugcucaugaccggcacccuggccguguuccugcuccugaucauggggcagcugaccuggaacgaccucauccggcugugcaucauggugggcgccaacgcgagcgaccgcauggggaugggcacgaccuaccuggcccucauggccaccuucaagaugcgcccgauguucgccgucggccugcuguuccggcgccucaccucccgggaggugcugcugcucacgaucgggcugagccuggucgccuccguggagcuccccaacagccuggaggagcugggcgacgggcucgcgaugggcaucaugauccugaagcugcucaccgacuuccagucccaccagcugugggccacccugcucagccugaccuucaucaagacgacccugucccuccacuacgccuggaagaccauggccauggugcugagcaucgucucccuguucccccucugccugagcaccacgucccagaagaccaccuggcugcccgugcuccugggcagccuggggugcaagccgcucaccauguuccugaucgcggagaacaagaucuggggccgcaaguccuggccccugaacgaggggaucauggccgugggcgucgugagcauccuccugagcucccugcucaagaacgacgugccccuggccgggccccugaucgccggcggcaugcucaucgccugcuacgucaucagcggguccagcgcggaccugucccuggagaaggccgccgaggugagcugggaggaggaggccgagcacuccggcgccagccacaacauccucguggagguccaggacgacgggacgaugaagaucaaggacgaggagcgggacgacacccugaccauccugcucaaggcgacccugcuggccguguccggcguguacccgcucagcauccccgccacccuguuccugugguacuucuggcagaagaagaagcagcgcuccgggguccugugggacacgcccagcccgcccgagguggagcgggccgugcucgacgacggcaucuaccgcaucaugcagcggggccugcuggggcgcucccaggucggcguggggguguuccaggagaacgucuuccacaccauguggcacgugacccggggcgccgugcucauguaccaggggaagcgccuggagcccagcugggcguccgucaagaaggaccugaucagcuacggcggcggguggcggcuccagggcuccuggaacaccggggaggagguccaggugaucgccgucgagcccggcaagaaccccaagaacgugcagacggcccccgggaccuucaagacccccgagggcgaggugggcgccaucgcccuggacuucaagcccgggaccagcggcucccccaucgucaaccgcgaggggaagaucgugggccuguacggcaacgggguggucacgaccagcggcaccuacgugagcgcgaucgcccaggccaaggccucccaggaggggccgcuccccgagaucgaggacgagguguuccggaagcgcaaccugaccaucauggaccugcaccccggcagcgggaagacgcggcgcuaccucccggcgaucguccgggaggccaucaagcgcaagcugcggacccugauccucgcccccacccgcgugguggccuccgagauggccgaggcgcugaagggcaugcccauccgcuaccagaccacggccgucaagagcgagcacaccggcaaggagaucguggaccugaugugccacgccaccuucaccaugcggcuccugucccccgugcgcgucccgaacuacaacaugaucaucauggacgaggcccacuucacggaccccagcuccaucgccgcgcggggguacaucagcacccgcgugggcaugggggaggccgccgccaucuucaugaccgccacgccgcccggcuccguggaggcguucccgcagagcaacgccgucauccaggacgaggagcgggacauccccgagcgcuccuggaacagcggguacgaguggaucacggacuuccccggcaagaccgugugguucgugcccuccaucaagagcggcaacgacaucgccaacugccugcggaagaacgggaagcgcgucauccagcucucccggaagaccuucgacaccgaguaccagaagacgaagaacaacgacugggacuacguggugaccaccgacaucagcgagaugggcgccaacuuccgcgcggaccgggucaucgacccgcgccggugccugaagcccgugauccugaaggacgggcccgagcgcgucauccucgccggccccaugccggugaccguggccuccgccgcccagcggcgcgggcggaucggccgcaaccacaacaaggagggcgaccaguacaucuacauggggcagccccugaacaacgacgaggaccacgcgcacuggacggaggccaagaugcugcucgacaacaucaacacccccgagggcaucauccccgcccuguucgagccggagcgggagaaguccgccgccaucgacggggaguaccgccugcgcggcgaggcgcggaagaccuucgucgagcucaugcgccgcggggaccugcccguguggcuguccuacaagguggccagcgagggcuuccaguacagcgaccgccgguggugcuucgacggcgagcgcaacaaccagguccucgaggagaacauggacguggagaucuggaccaaggagggggagcggaagaagcugcgcccccgguggcuggacgcccgcacguacuccgacccccucgcccugcgggaguucaaggaguucgccgcgggccgccggagcguguccggggaccugauccucgagaucggcaagcugccgcagcaccugacccagcgcgcccagaacgcccucgacaaccuggucaugcugcacaacagcgagcagggcgggcgggccuaccgccacgcgauggaggagcuccccgacaccaucgagacccugaugcugcucgcccugaucgccgugcugacgggcggggugacccucuucuuccuguccggccgggggcugggcaagaccagcaucggccuccugugcgucauggccuccagcgugcugcucuggauggccuccguggagccccacuggaucgcggccagcaucauccuggaguucuuccugaugguccuccugauccccgagccggaccgccagcggacgccccaggacaaccagcuggccuacguggugaucgggcuccuguucaugauccugaccgucgccgccaacgagaugggccuccuggagacgaccaagaaggaccuggggaucggccacguggcgguggagaaccaccaccacgccaccaugcucgacgucgaccugcaccccgccuccgccuggacccuguacgccguggcgacgaccaucaucaccccgaugaugcgccacaccaucgagaacacgaccgccaacaucagccucaccgccaucgccaaccaggccgcgauccugauggggcuggacaagggcuggcccaucuccaagauggacaucggcgugccccuccuggcccuggggugcuacagccaggucaacccccucacccugacggccgccgugcugaugcucguggcgcacuacgccaucaucggcccggggcugcaggccaaggccacccgggaggcccagaagcgcaccgcggccggcaucaugaagaaccccaccgucgacgggaucguggccaucgaccuggaccccguggucuacgacgccaaguucgagaagcagcucggccagaucaugcugcugauccucugcacgucccagauccugcugaugcgcaccaccugggcccucugcgagagcaucacccuggcgacgggcccccugaccacccucugggagggguccccgggcaaguucuggaacaccacgaucgccgugagcauggccaacaucuuccggggguccuaccuggccggcgccggccuggcguucagccucaugaagucccucgggggcgggcgccgggggaccggggcccagggcgagacccugggcgagaaguggaagcgccagcucaaccagcuguccaagagcgaguucaacaucuacaagcgguccgggaucauggagguggaccgcagcgaggccaaggagggccugaagcgcggggagaccacgcgccacgccgucucccggggcaccgcgaagcugcgcugguucguggagcggaaccucgugaagcccgaggggaaggucaucgaccugggcugcggccgcgggggcuggagcuacuacugcgccgggcugaagaaggugaccgaggugaagggcuacaccaagggcgggcccggccacgaggagcccaucccgauggccacguacggguggaaccucgucaagcugcacuccggcaaggacguguucuucacgccgcccgagaagugcgacacccugcucugcgacaucggggagagcucccccaacccgaccaucgaggagggccggacgcugcgcgugcugaagauggucgagcccuggcuccgggggaaccaguucugcaucaagauccugaaccccuacaugcccagcgugguggagacccuggagcagaugcagcgcaagcacggcggcaugcucguccggaacccgcugucccgcaacagcacccacgagauguacuggguguccugcgggaccggcaacaucgugagcgccgucaacaugaccucccggaugcugcucaaccgcuucacgauggcccaccgcaagcccaccuacgagcgggacguggaccugggggcgggcacccgccacguggccgucgagcccgagguggccaaccuggacaucaucggccagcggaucgagaacaucaagcacgagcacaagagcaccuggcacuacgacgaggacaaccccuacaagacgugggccuaccacggguccuacgaggucaagccgagcggcuccgccagcagcauggugaacgggguggucaagcuccugaccaagcccugggacgugauccccauggugacccagaucgcgaugaccgacacgacccccuucggccagcagcgcgucuucaaggagaagguggacacccggaccccgaaggccaagcgcgggacggcccagaucauggaggugaccgcccgguggcuguggggcuuccucucccgcaacaagaagccccggaucugcacccgcgaggaguucacccggaagguccgcagcaacgccgcgaucggcgccguguucguggacgagaaccaguggaacuccgccaaggaggccgucgaggacgagcgguucugggaccuggugcagaaggagcgcgagcugcacaagcaggggaagugcgcgacgugcguguacaacaugaugggcaagcgggagaagaagcucggggaguucggcaaggccaaggggagccgcgccaucugguacauguggcugggcgcccgguuccuggaguucgaggcccucggcuucaugaacgaggaccacugguucucccgcgagaacagccuguccggggucgagggcgaggggcugcacaagcucggcuacauccugcgggacaucagcaagauccccgggggcaacauguacgcggacgacaccgccggcugggacacccgcaucaccgaggacgaccugcagaacgaggccaagaucacggacaucauggagccggagcacgcccuccuggccaccuccaucuucaagcugaccuaccagaacaagguggugcggguccagcgccccgcgaagaacgggaccgugauggacgugaucagccgccgggaccagcgcggcuccgggcaggucggcacguacggccucaacaccuucaccaacauggaggcccagcugauccggcagauggagagcgaggggaucuuccugcccuccgagcucgagacccccaaccuggccgagcgcgugcuggacuggcucgagaagcacggcguggagcggcugaagcgcauggccaucagcggggacgacugcgucgugaagccgaucgacgaccgguucgccacggcgcugaccgcccucaacgacaugggcaaggugcgcaaggacaucccccagugggagcccuccaagggguggaacgacuggcagcagguccccuucugcagccaccacuuccaccagcugaucaugaaggacggccgggagaucguggugccgugccgcaacgaggacgagcuggucggccgggcccgcgugucccagggggccggcuggagccuccgggagaccgccugccugggcaagagcuacgcgcagauguggcagcugauguacuuccaccgccgggaccuccgccuggccgccaacgccaucugcuccgcggugcccgucgacugggugcccaccagccggacgaccugguccauccacgcccaccaccaguggaugaccaccgaggacaugcugagcguguggaaccgcgucuggaucgaggagaaccccuggauggaggacaagacgcacguguccagcuggggcgacgugccguaccucgggaagcgggaggaccaguggugcggcucccugaucggccugaccgcccgcgccaccugggccagcaacauccaggucgcgaucaaccaggugcgccggcucaucgggaacgagaacuaccuggacuacaugaccuccaugaagcgcuucaagaacgagggcgaccccgagggggcccugugguga

SEQ ID NO: 8497 - RNA, 9879 nt, Artificial Sequence
  derived and/or modified CDS sequence (opt1) from DENV-1__GQ199788__SS-prME
agcgugaccaugcugcucaugcugaugcccaccgcccuggccuuccaccucacgacccggggcggggagccccacaugaucgugagcaagcaggagcggggcaagagccugcuguucaagaccagcgcgggggugaacaugugcacccucaucgccauggaccugggcgaguucugcgaggacacgaugaccuacaagugcccccgcaucaccgaggccgagcccgacgacguggacugcuggugcaacgccaccgacacgugggugaccuacgggaccugcagccagaccggcgagcaccggcgggacaagcgguccguggcccuggcgccccacgugggccucgggcuggagacgcgcaccgagaccuggaugagcuccgagggcgccuggaagcagauccagcggguggagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugcccgacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaagaccguccaguacgagaaccugaaguacagcgugaucgugaccguccacacgggcgaccagcaccagguggggaacgaguccaccgagcacggcaccaccgcgaccaucacgccccaggcccccagcaccgagauccagcugaccgacuacggggcccucacccuggacugcagcccccggacgggccuggacuucaacgagaugguccuccugaccaugaaggagaaguccuggcuggugcacaagcagugguuccucgaccugccgcugcccuggaccagcggggccuccaccagccaggagacguggaaccggaaggaccuccuggugaccuucaagaccgcccacgcgaagaagcaggaggucguggugcugggcucccaggagggcgccaugcacaccgcccucacgggggccaccgagauccagaccagcggcaccacgaccaucuucgccgggcaccugaagugccgccugaagauggacaagcucacccugaagggcauguccuacgucaugugcaccgggagcuucaagcuggagaaggagguggcggagacgcagcacggcaccgugcucguccagaucaaguacgagggcaccgacgcccccugcaagauccccuucuccacccaggacgagaagggggugacgcagaacggccggcugaucaccgccaacccgaucgugaccgacaaggagaagcccgucaacaucgaggccgagccgcccuucggggagagcuacaucgugaucggcgcgggcgagaaggcccugaagcuguccugguucaagaaggggagcuccaucggcaagauguucgaggccaccgcccgcggggcccggcgcauggcgauccucggcgacacggccugggacuucgggagcaucggcggcguguucaccuccgucgggaagcuggugcaccagaucuucggcaccgccuacggggugcuguucagcggcgucuccuggaccaugaagaucgggaucggcgugcuccugacguggcugggccucaacagccgcuccaccagccuguccaugaccugcaucgccguggggcuggucacccucuaccugggcgugauggugcaggccgacagcgggugcgucaucaacuggaagggccgggagcugaagugcgggagcggcaucuucgugacgaacgaggugcacaccuggaccgagcaguacaaguuccaggcggacuccccgaagcgccucagcgccgccaucggcaaggccugggaggagggggucugcggcauccgguccgccacccgccuggagaacaucauguggaagcagaucagcaacgagcugaaccacauccuccuggagaacgacaugaaguucaccgugguggucggggacguggcgggcauccuggcccaggggaagaagaugauccggccccagcccauggaguacaaguacuccuggaaguccuggggcaaggccaagaucaucggcgccgacgugcagaacacgaccuucaucaucgacgggcccaacaccccggagugccccgacgaccagcgcgcguggaacaucugggaggucgaggacuacggcuucgggaucuucaccacgaacaucuggcucaagcugcgggacuccuacacccaggugugcgaccaccgccugaugagcgccgccaucaaggacuccaaggccgugcacgccgacaugggcuacuggaucgagagcgagaagaacgagaccuggaagcucgcgcgggccuccuucaucgaggucaagaccugcaucuggcccaagagccacacgcugugguccaacggcgugcuggagagcgagaugaucauccccaagaucuacgggggcccgaucucccagcacaacuaccgccccggguacuucacccagaccgccggccccuggcaccucgggaagcuggagcuggacuucgaccucugcgagggcaccacgguggucguggacgagcacugcggcaaccgggggccgagccugcgcaccaccaccgugacgggcaagaucauccacgaguggugcugccgguccugcacccugccgccccugcgcuucaagggggaggacggcugcugguacgggauggagauccggcccgucaaggagaaggaggagaaccuggucaagagcauggugagcgccggcuccggcgaggucgacagcuucucccuggggcuccugugcaucagcaucaugaucgaggaggugaugcgcucccgguggagccgcaagaugcugaugaccggcacccucgccguguucuuccugcugaucauggggcagcucacguggaacgaccugauccggcugugcaucauggucggcgcgaacgccuccgaccgcauggggaugggcaccaccuaccucgcccugauggccaccuucaagaugcgcccgauguucgccgugggccuccuguuccggcgccugacgagccgggaggugcugcuccugaccaucgggcugucccucgucgcgagcguggagcugcccaacucccuggaggagcucggcgacgggcuggccaugggcaucaugauccugaagcuccugaccgacuuccagagccaccagcugugggccacccuccugucccugacguucaucaagaccaccuucagccuccacuacgccuggaagaccauggcgaugguccuguccaucgugagccuguucccccucugccuguccacgaccagccagaagaccaccuggcugcccgugcuccugggcucccuggggugcaagccgcucacgauguuccugaucgccgagaacaagaucuggggccgcaagagcuggccccugaacgaggggaucauggccgucggcaucgugagcauccuccuguccagccugcucaagaacgacgugccccuggccgggccccugaucgccggcggcaugcucaucgcgugcuacgucaucuccgggagcuccgccgaccugagccuggagaaggccgccgagguguccugggaggaggaggccgagcacagcggcgcgucccacaacauccucguggagguccaggacgacgggaccaugaagaucaaggacgaggagcgggacgacacccugaccauccugcucaaggccacccugcuggccgugagcggcguguacccgcucuccauccccgccacgcuguucgucugguacuucuggcagaagaagaagcagcgcagcggggugcugugggacacccccagcccgcccgagguggagcgggccguccucgacgacggcaucuaccgcaucaugcagcggggccugcuggggcgcagccaggugggcgugggggucuuccaggagaacguguuccacaccauguggcacgugacccggggcgcgguccugauguaccaggggaagcgccucgagcccuccugggccagcgugaagaaggaccugaucuccuacggcggcggguggcggcugcagggcagcuggaacacgggggaggaggugcaggucaucgccguggagcccggcaagaaccccaagaacgugcagaccgcccccgggaccuucaagaccuccgagggcgaggucggcgccaucgcgcucgacuucaagcccgggacgagcggcagccccaucgugaaccgcgaggggaagaucgugggccuguacggcaacggggucgugaccaccuccggcaccuacgugagcgccaucgcccaggccaaggcgucccaggaggggccccugccggagaucgaggacgaggucuuccggaagcgcaaccucacgaucauggaccugcaccccggcagcgggaagacccggcgcuaccugcccgccaucgugcgggaggccaucaagcgcaagcuccggacccugauccuggccccgacccgcguggucgccuccgagauggcggaggcccucaagggcaugcccauccgcuaccagacgaccgccgucaagagcgagcacaccggcaaggagaucguggaccugaugugccacgccaccuucacgaugcggcugcucucccccguccgcgugcccaacuacaacaugaucaucauggacgaggcccacuucaccgacccgagcuccaucgcggcccggggguacaucagcacccgcgugggcaugggggaggccgccgccaucuucaugaccgcgacgccgcccggcuccgucgaggccuucccccagagcaacgccgugauccaggacgaggagcgggacaucccggagcgcuccuggaacagcggguacgaguggaucaccgacuuccccggcaagaccgugugguucguccccuccaucaagagcggcaacgacaucgccaacugccugcggaagaacgggaagcgcgugauccagcugucccggaagaccuucgacacggaguaccagaagaccaagaacaacgacugggacuacguggucaccaccgacaucagcgagaugggcgcgaacuuccgcgccgaccgggugaucgacccccgccggugccucaagccggugauccugaaggacgggcccgagcgcgucauccuggccggccccaugcccgugacggucgccuccgccgcgcagcggcgcgggcggaucggccgcaaccacaacaaggagggcgaccaguacaucuacauggggcagccgcucaacaacgacgaggaccacgcccacuggaccgaggccaagaugcugcuggacaacaucaacacccccgagggcaucauccccgcccucuucgagcccgagcgggagaaguccgccgcgaucgacggggaguaccgccugcgcggcgaggcccggaagaccuucguggagcugaugcgccgcggggaccucccgguguggcugagcuacaaggucgccuccgagggcuuccaguacagcgaccgccgguggugcuucgacggcgagcgcaacaaccaggugcuggaggagaacauggacguggagaucuggacgaaggagggggagcggaagaagcuccgcccccgguggcuggacgcccgcaccuacuccgacccccuggcccuccgggaguucaaggaguucgcggccggccgccggagcgucuccggggaccugauccuggagaucggcaagcucccccagcaccugacccagcgcgcccagaacgcccuggacaaccucgugaugcugcacaacagcgagcagggcgggcgggcguaccgccacgccauggaggagcugccggacaccaucgagacgcucaugcugcuggcccucaucgccgugcugaccggcggggucacccuguucuuccucuccggccgggggcugggcaagaccagcaucggccugcucugcgugauggccuccagcgugcugcuguggauggcguccgucgagccccacuggaucgccgccagcaucauccucgaguucuuccugauggugcugcucauccccgagcccgaccgccagcggaccccgcaggacaaccagcuggccuacguggucaucgggcuccucuucaugauccugacgguggccgcgaacgagaugggccugcucgagaccaccaagaaggaccuggggaucggccacguggccgucgagaaccaccaccacgccgccaugcuggacguggaccuccaccccgccuccgcguggacccuguacgccguggccacgaccaucaucacccccaugaugcgccacaccaucgagaacacgaccgccaacaucagccugaccgccaucgcgaaccaggccgccauccucauggggcuggacaagggcuggccgaucuccaagauggacaucggcgucccccugcucgcccuggggugcuacagccaggugaacccccugacccucacggcggccgugcugaugcuggucgcccacuacgccaucaucggccccgggcuccaggccaaggcgacccgggaggcccagaagcgcaccgccgccggcaucaugaagaacccgaccguggacgggaucguggccaucgaccuggaccccgucguguacgacgcgaaguucgagaagcagcugggccagaucaugcuccugauccugugcacgucccagauccuccugaugcgcaccaccugggcccugugcgagagcaucacccucgccacgggcccccugaccacccugugggaggggucccccggcaaguucuggaacaccacgaucgccgugagcauggccaacaucuuccgggggagcuaccucgcgggcgccggccuggccuucucccugaugaagucccucgggggcgggcgccggggcaccggggcccagggcgagacccugggcgagaaguggaagcgccagcugaaccagcucuccaagagcgaguucaacaccuacaagcgguccgggaucauggaggucgaccgcagcgaggcgaaggagggccugaagcgcggggagacgaccaagcacgccgugucccgcggcaccgccaagcugcggugguucguggagcgcaaccucgucaagccggaggggaaggugaucgaccugggcugcggccgcggcggguggagcuacuacugcgccgggcugaagaaggugaccgaggucaagggguacacgaagggcgggcccggccacgaggagcccauccccauggccaccuacggguggaaccuggugaagcuccacuccggcaaggacguguucuucaucccgcccgagaagugcgacacccugcugugcgacaucggggagagcucccccaaccccaccaucgaggagggccgcacgcuccggguccugaagaugguggagccguggcugcgcgggaaccaguucugcaucaagauccucaaccccuacaugcccagcguggucgagacccuggagcagaugcagcggaagcacggcggcaugcuggugcgcaacccccucucccggaacagcacccacgagauguacuggguguccugcgggaccggcaacaucgucagcgcggugaacaugaccucccgcaugcugcugaaccgguucacgauggcccaccgcaagccgaccuacgagcgcgacguggaccucggggccggcacccggcacgucgccguggagcccgagguggccaaccuggacaucaucggccagcgcaucgagaacaucaagcacgagcacaagagcaccuggcacuacgacgaggacaaccccuacaagacgugggcguaccacggguccuacgaggucaagcccagcggcagcgccuccagcauggugaacggggucgugaagcugcucaccaagccgugggacgugauccccauggucacccagaucgccaugaccgacacgacccccuucggccagcagcggguguucaaggagaagguggacacccgcacccccaaggccaagcgggggacggcccagaucauggaggucaccgcgaaguggcuguggggcuuccugucccgcaacaagaagccgcggaucugcacccgcgaggaguucacccggaaggugcgcagcaacgccgccaucggcgccguguucgucgacgagaaccaguggaacuccgcgaaggaggccguggaggacgagcgguucugggaccucgugcaccgcgagcgggagcugcacaagcaggggaagugcgccacgugcgucuacaacaugaugggcaagcgcgagaagaagcugggggaguucggcaaggccaaggggagccgggccaucugguacauguggcucggcgcgcgcuuccuggaguucgaggcccugggcuucaugaacgaggaccacugguucucccgggagaacagccucuccgggguggagggcgaggggcugcacaagcugggcuacauccuccgcgacaucagcaagauccccgggggcaacauguacgccgacgacaccgccggcugggacacccggaucaccgaggacgaccugcagaacgaggccaagaucacggacaucauggagcccgagcacgcgcugcucgccaaguccaucuucaagcugaccuaccagaacaaggugguccgcgugcagcggccggccaagaacgggaccgugauggacgucaucagccgccgcgaccagcggggcuccggccaggugggcaccuacggccugaacacguucaccaacauggaggcccagcucauccgccagauggagagcgaggggaucuucucccccagcgagcuggagacccccaaccuggcccggcgcgugcucgacuggcuggagaagcacggcgucgagcggcugaagcgcauggcgaucuccggggacgacugcguggugaagcccaucgacgaccgguucgccaccgcccucacggcccugaacgacaugggcaagguccgcaaggacaucccgcagugggagcccagcaagggguggaacgacuggcagcagguccccuucugcagccaccacuuccaccagcugaucaugaaggacggccgggagaucgugguccccugccgcaaccaggacgagcucgugggccgggcccgcgugucccagggggcgggcuggagccugcgggagaccgccugccuggggaaguccuacgcccagauguggcagcucauguacuuccaccgccgggaccugcgccuggccgcgaacgccaucugcagcgccgucccgguggacugggugcccaccucccggaccacguggagcauccacgcccaccaccaguggaugaccaccgaggacaugcucuccgucuggaaccgcguguggaucgaggagaaccccuggauggaggacaagacccacaucagcuccuggggcgacgugcccuaccuggggaagcgggaggaccaguggugcggcagccugaucggccucacggcccgcgcgaccugggccaccaacauccaggucgccaucaaccaggugcgccggcugaucgggaacgagaacuaccuggacuacaugaccuccaugaagcgcuucaagaacgagagcgacccggagggcgcccucugguga

SEQ ID NO: 8498 - RNA, 9879 nt, Artificial Sequence
  derived and/or modified CDS sequence (opt1) from DENV-1__GQ199789__SS-prME
agcgugaccaugcugcucaugcugaugcccaccgcccuggccuuccaccucacgacccggggcggggagccccacaugaucguguccaagcaggagcggggcaagagccugcuguucaagaccuccgccggggugaacaugugcacccucaucgccauggaccugggcgaguucugcgaggacaccaugaccuacaagugcccccggaucaccgaggccgagcccgacgacguggacugcuggugcaacgccaccgacacgugggugaccuacgggaccugcagccagaccggcgagcaccggcgcgacaagcgguccguggcccuggcgccccacgugggccucgggcuggagacgcgcaccgagaccuggaugagcuccgagggcgccuggaagcagauccagaaggucgagaccugggcccugcggcaccccggguucacggugaucgcccucuuccuggcgcacgccaucggcaccagcaucacccagaaggggaucaucuucauccugcucaugcuggugacccccuccauggccaugcgcugcgucggcaucggcagccgggacuucguggaggggcuguccggcgccacguggguggacgucgugcucgagcacgggagcugcgugaccaccauggccaaggacaagcccacccuggacaucgagcugcucaagacggaggucaccaaccccgcggugcugcgcaagcugugcaucgaggccaagaucuccaacaccaccacggacagccggugcccgacccagggcgaggccacccucguggaggagcaggacgccaacuucgucugccgccggaccuucguggaccgcggcugggggaacggcugcgggcuguucggcaaggggucccugaucacgugcgccaaguucaagugcgugaccaagcucgagggcaagaccguccagcacgagaaccugaaguacagcgugaucgugaccguccacacgggcgaccagcaccagguggggaacgaguccaccgagcacggcaccaccgcgaccaucacgccccaggcccccagcaccgagauccagcugaccgacuacggggcccucacccuggacugcagcccccggacgggccuggacuucaacgagaugguccuccugaccaugaaggagaaguccuggcuggugcacaagcagugguuccucgaccugccgcugcccuggaccagcggggccuccaccagccaggagacguggaaccgcaaggaccuccuggugaccuucaagaccgcccacgcgaagaagcaggaggucguggugcugggcucccaggagggcgccaugcacaccgcccucacgggggccaccgagauccagaccagcggcaccacgaccaucuucgccgggcaccugaagugccggcugaagauggacaagcucacccugaagggcaccuccuacgucaugugcacggggagcuucaagcuggagaaggagguggcggagacccagcacggcaccgugcucguccagaucaaguacgagggcaccgacgcccccugcaagauccccuucuccacgcaggacgagaagggggugacccagaacggccgccugaucaccgccaacccgaucgugaccgacaaggagaagcccgucaacaucgaggccgagccgcccuucggggagagcuacaucgugaucggcgcgggcgagaaggcccugaagcuguccugguucaagaaggggagcuccaucggcaagauguucgaggccacggcccgcggggcccgccggauggcgauccucggcgacaccgccugggacuucgggagcaucggcggcguguucaccuccgucgggaagcuggugcaccagaucuucggcaccgccuacggggugcuguucagcggcgucuccuggacgaugaagaucgggaucggcgugcuccugaccuggcugggccucaacagccgcuccaccagccuguccaugaccugcaucgccguggggcuggucacgcucuaccugggcgugauggugcaggccgacagcgggugcgucaucaacuggaagggccgcgagcugaagugcgggagcggcaucuucgugaccaacgaggugcacaccuggaccgagcaguacaaguuccaggcggacuccccgaagcggcucagcgccgccaucggcaaggccugggaggagggggucugcggcauccgcuccgccacccggcuggagaacaucauguggaagcagaucagcaacgagcugaaccacauccuccuggagaacgacaugaaguucacggugguggucggggacguggcgggcauccuggcccaggggaagaagaugauccgcccccagcccauggaguacaaguacuccuggaaguccuggggcaaggccaagaucaucggcgccgacgugcagaacaccaccuucaucaucgacgggcccaacaccccggagugccccgacgaccagcgggcguggaacaucugggaggucgaggacuacggcuucgggaucuucacgaccaacaucuggcucaagcugcgcgacuccuacacccaggugugcgaccaccggcugaugagcgccgccaucaaggacuccaaggccgugcacgccgacaugggcuacuggaucgagagcgagaagaacgagaccuggaagcucgcgcgcgccuccuucaucgaggucaagacgugcaucuggcccaagagccacacccugugguccaacggcgugcuggagagcgagaugaucauccccaagaucuacgggggcccgaccucccagcacaacuaccggcccggguacuucacccagacggccggccccuggcaccucgggaagcuggagcuggacuucgaccucugcgagggcaccaccguggucguggacgagcacugcggcaaccgcgggccgagccugcggaccacgaccgugaccggcaagaucauccacgaguggugcugccgcuccugcacccugccgccccugcgguucaagggggaggacggcugcugguacgggauggagauccgccccgucaaggagaaggaggagaaccuggucaagagcauggugagcgccggcuccggcgaggucgacagcuucucccuggggcuccugugcaucagcaucaugaucgaggaggugaugcggucccgcuggagccggaagaugcugaugacgggcacccucgccguguucuuccugcugaucauggggcagcucaccuggaacgaccugauccgccugugcaucauggucggcgcgaacgccuccgaccggauggggaugggcaccacguaccucgcccugauggccaccuucaagaugcgcccgauguucgccguggggcuccuguuccgccggcugaccagccgcgaggugcugcuccugaccaucgggcugucccucgucgcgagcguggagcugcccaacucccuggaggagcucggcgacgggcuggccaugggcaucaugauccugaagcuccugacggacuuccagagccaccagcugugggccacccuccugucccugaccuucaucaagaccacguucagccuccacuacgccuggaagaccauggcgaugguccuguccaucgugagccuguucccccucugccuguccaccaccagccagaagacgaccuggcugcccgugcuccugggcucccuggggugcaagccgcucaccauguuccugaucgccgagaacaagaucuggggccgcaagagcuggccccugaacgaggggaucauggccgucggcaucgugagcauccuccuguccagccugcucaagaacgacgugccccuggccgggccccugaucgccggcggcaugcucaucgcgugcuacgucaucuccgggagcuccgccgaccugagccuggagaaggccgccgagguguccugggaggaggaggccgagcacagcggcgcgucccacaacauccucguggagguccaggacgacgggaccaugaagaucaaggacgaggagcgcgacgacacccugacgauccugcucaaggccacccugcuggccgugagcggcguguacccgcucuccauccccgccacccuguucgucugguacuucuggcagaagaagaagcagcggagcggggugcugugggacacccccagcccgcccgagguggagcgcgccguccucgacgacggcaucuaccggaucaugcagcgcggccugcuggggcggagccaggugggcgugggggucuuccaggagaacguguuccacacgauguggcacgugacccgcggcgcgguccugauguaccaggggaagcggcucgagcccuccugggccagcgugaagaaggaccugaucuccuacggcggcggguggcgccugcagggcagcuggaacaccggggaggaggugcaggucaucgccguggagcccggcaagaaccccaagaacgugcagaccgcccccgggacguucaagaccuccgagggcgaggucggcgccaucgcgcucgacuucaagcccgggaccagcggcagccccaucgugaaccgggaggggaagaucgugggccuguacggcaacggggucgugaccacguccggcaccuacgugagcgccaucgcccaggccaaggcgucccaggaggggccccugccggagaucgaggacgaggucuuccgcaagcggaaccucaccaucauggaccugcaccccggcagcgggaagacccgccgguaccugcccgccaucgugcgcgaggccaucaagcggaagcuccgcacgcugauccuggccccgacccggguggucgccuccgagauggcggaggcccucaagggcaugcccauccgcuaccagaccaccgccgugaagggcgagcacacggggaaggagaucguggaccugaugugccacgccaccuucaccaugcgccugcucagccccguccgggugcccaacuacaacaugaucaucauggacgaggcccacuucaccgacccguccagcaucgcggcccgcggcuacaucuccacgcggguggggaugggcgaggccgccgccaucuucaugaccgcgacgccgcccgggagcgucgaggccuucccccaguccaacgccgugauccaggacgaggagcgcgacaucccggagcggagcuggaacuccggcuacgaguggaucaccgacuuccccggcaagacggugugguucguccccagcaucaaguccgggaacgacaucgccaacugccugcgcaagaacggcaagcgggugauccagcugagccgcaagaccuucgacaccgaguaccagaagaccaagaacaacgacugggacuacguggucacgaccgacaucuccgagaugggggcgaacuuccgggccgaccgcgugaucgacccccggcgcugccucaagccggugauccugaaggacggccccgagcgggucauccuggccgggcccaugcccgugaccgucgccagcgccgcgcagcgccggggccgcaucggccggaaccacaacaaggagggggaccaguacaucuacaugggccagccgcucaacaacgacgaggaccacgcccacuggaccgaggccaagaugcugcuggacaacaucaacacgcccgaggggaucauccccgcccucuucgagcccgagcgcgagaaguccgccgcgaucgacggcgaguaccggcugcgcggggaggcccgcaagaccuucguggagcugaugcggcgcggcgaccucccgguguggcugagcuacaaggucgccagcgagggcuuccaguacuccgaccggcgcuggugcuucgacggggagcggaacaaccaggugcuggaggagaacauggacguggagaucuggaccaaggagggcgagcgcaagaagcuccggccccgcuggcuggacgcccggaccuacagcgacccccuggcccuccgcgaguucaaggaguucgcggccgggcggcgcuccgucagcggcgaccugauccuggagaucggcaagcucccccagcaccugacgcagcgggcccagaacgcccuggacaaccucgugaugcugcacaacuccgagcagggcgggcgcgcguaccggcacgccauggaggagcugccggacaccaucgagacccucaugcugcuggcccucaucgccgugcugaccgggggcgucacccuguucuuccucagcgggcgcggccugggcaagacguccaucgggcugcucugcgugauggccagcuccgcgcugcuguggauggccagcguggagccccacuggaucgccgccuccaucauccucgaguucuuccugaugguccugcucauccccgagcccgaccggcagcgcaccccgcaggacaaccagcuggccuacguggugaucggccuccucuucaugauccugaccgucgcggccaacgagauggggcugcucgagaccacgaagaaggaccugggcaucgggcacguggccguggagaaccaccaccacgccgccaugcuggacgucgaccuccaccccgcgagcgccuggacccuguacgccguggccaccaccaucaucacgcccaugaugcggcacaccaucgagaacaccaccgccaacaucucccugacggcgaucgccaaccaggccgccauccucaugggccuggacaagggcuggccgaucagcaagauggacaucggggugccccugcucgcgcugggcugcuacucccaggucaacccccugacccucaccgccgccgugcugaugcugguggcccacuacgccaucaucgggcccggccuccaggcgaaggccacccgcgaggcccagaagcggacggccgccgggaucaugaagaacccgaccgucgacggcaucguggcgaucgaccuggaccccguggucuacgacgccaaguucgagaagcagcugggccagaucaugcuccuggugcugugcaccagccagauccuccugaugcgcaccacgugggcccugugcgaguccaucacccucgccaccgggccccugaccacgcugugggagggcagccccgggaaguucuggaacaccaccaucgccguguccauggcgaacaucuuccgcggcagcuaccucgccggcgccgggcuggccuucagccugaugaagucccucggcgggggccggcgcgggaccggcgcgcagggcgagacgcugggggagaaguggaagcggcagcugaaccagcucagcaaguccgaguucaacaccuacaagcgcagcggcaucauggaggucgaccgguccgaggccaaggaggggcugaagcgcggcgagaccaccaagcacgccgugagccgggggacggccaagcugcgcugguucguggagcggaaccucgucaagccggagggcaaggugaucgaccugggcugcgggcgcggcgggugguccuacuacugcgccggccugaagaaggugaccgaggucaagggguacaccaagggcggccccgggcacgaggagcccauccccauggcgaccuacggcuggaaccuggugaagcuccacagcgggaaggacguguucuucaucccgcccgagaagugcgacacgcugcugugcgacaucggcgaguccagccccaaccccaccaucgaggaggggcggacccuccgcguccugaagaugguggagccguggcugcggggcaaccaguucugcaucaagauccucaaccccuacaugcccuccguggucgagacccuggagcagaugcagcgcaagcacggcgggaugcuggugcggaacccccucagccgcaacuccacccacgagauguacugggugagcugcggcacggggaacaucgucuccgccgugaacaugaccagccggaugcugcugaaccgcuucaccauggcccaccggaagccgaccuacgagcgcgacguggaccucggcgccggcacgcgccacgucgccguggagcccgagguggcgaaccuggacaucaucgggcagcggaucgagaacaucaagcacgagcacaaguccaccuggcacuacgacgaggacaaccccuacaagaccugggccuaccacggcagcuacgaggucaagcccuccgggagcgccagcuccauggugaacggcgucgugaagcugcucaccaagccgugggacgugauccccauggucacgcagaucgccaugaccgacaccacccccuucgggcagcagcgcguguucaaggagaagguggacacgcggacccccaaggccaagcgcggcaccgcgcagaucauggaggucaccgccaaguggcuguggggcuuccugagccggaacaagaagccgcgcaucugcacgcgggaggaguucacccgcaaggugcgguccaacgccgccaucggggcgguguucgucgacgagaaccaguggaacagcgccaaggaggccguggaggacgagcgcuucugggaccucgugcaccgggagcgcgagcugcacaagcagggcaagugcgcgaccugcgucuacaacaugauggggaagcgggagaagaagcugggcgaguucgggaaggccaagggcucccgcgcgaucugguacauguggcucggcgcccgguuccuggaguucgaggcccugggguucaugaacgaggaccacugguucagccgcgagaacucccucagcggcguggagggggagggccugcacaagcugggguacauccuccgggacaucuccaagauccccggcggcaacauguacgccgacgacaccgccgggugggacacgcgcaucaccgaggacgaccugcagaacgaggcgaagaucaccgacaucauggagcccgagcacgcccugcucgccaagagcaucuucaagcugaccuaccagaacaaggugguccgggugcagcgcccggccaagaacggcacggugauggacgucaucucccggcgcgaccagcgcgggagcggccaggugggcaccuacgggcugaacaccuucaccaacaucgaggcccagcucauccggcagauggaguccgaggagaucuucagccccuccgagcuggagacgcccaaccuggcgggccgcgugcucgacuggcuggagaagcacggggucgagcggcugaagcgcauggccaucagcggcgacgacugcguggugaagcccaucgacgaccgguucgccaccgcccucaccgcccugaacgacauggggaagguccgcaaggacaucccgcagugggagcccuccaagggcuggaacgacuggcagcagguccccuucugcagccaccacuuccaccagcugaucaugaaggacggccgggagaucgugguccccugccgcaaccaggacgagcucguggggcgggcgcgcgugagccagggcgccggguggucccugcgggagaccgccugccugggcaagagcuacgcccagauguggcagcucauguacuuccaccgccgggaccugcgccuggcggccaacgccaucugcuccgccgucccgguggacugggugcccacgagccggaccaccugguccauccacgcccaccaccaguggaugaccacggaggacaugcucagcgucuggaaccgcguguggaucgaggagaaccccuggauggaggacaagacccacaucuccagcuggggcgacgugcccuaccugggcaagcgggaggaccaguggugcggcucccugaucgggcucaccgcgcgcgccaccugggccaccaacauccaggucgccaucaaccaggugcggcgccugaucggcaacgagaacuaccuggacuacaugacgagcaugaagcgcuucaagaacgaguccgacccggagggggcccucugguga

SEQ ID NO: 8499 - RNA, 9879 nt, Artificial Sequence
  derived and/or modified CDS sequence (opt1) from DENV-1__GQ199790__SS-prME
agcgugaccaugcugcucaugcugaugcccaccgcccuggccuuccaccucaccacccggggcggggagccccacaugaucgugaccaagcaggagcggggcaagagccugcuguucaagaccagcgcgggggugaacaugugcacccucaucgccauggaccugggcgagcugugcgaggacaccaugaccuacaagugcccccggaucaccgaggccgagcccgacgacguggacugcuggugcaacgccaccgacaccugggugaccuacgggaccugcagccagaccggcgagcaccggcgcgacaagcggagcguggcccucgcgccccacgugggccuggggcuggagacccgcaccgagaccuggauguccagcgagggcgccuggaagcagauccagcgggucgagacgugggcccuccgccaccccggguucaccgugaucgcccuguuccuggcgcacgugaucggcaccuccaucacccagaaggggaucaucuucauccuccugaugcuggucacgcccagcauggccaugcggugcgugggcaucggcucccgcgacuucguggaggggcucagcggcgccaccugggucgacguggugcuggagcacggguccugcgucaccaccauggccaaggacaagcccacgcuggacaucgagcuccugaagaccgaggugaccaaccccgccgugcugcggaagcucugcaucgaggcgaagaucagcaacaccacgaccgacucccgcugccccacccagggcgaggccacccugauggaggagcaggacgccaacuucgucugccggcgcacguucguggaccggggcugggggaacggcugcgggcuguucggcaaggggagccucaucacgugcgccaaguucaagugcgugaccaagcuggagggcaagaucguccaguacgagaaccugaaguacuccgugaucgugaccguccacacgggcgaccagcaccagguggggaacgagagcaccgagcacggcaccaccgccaccaucacgccccaggcgcccaccuccgagauccagcucaccgacuacggggcccugacccuggacugcagcccccgcacgggccucgacuucaacgagaugguccugcugaccaugaaggagaaguccuggcucgugcacaagcagugguuccuggaccugccgcuccccuggaccagcggggccagcaccucccaggagacguggaaccggcaggaccugcuggugaccuucaagaccgcccacgccaagaagcaggaggucguggugcucggcagccaggagggcgcgaugcacaccgcccugacgggggccaccgagauccagaccuccggcaccacgaccaucuucgccgggcaccugaagugccgccucaagauggacaagcugacccugaagggcaugagcuacgucaugugcaccggguccuucaagcucgagaaggagguggccgagacgcagcacggcaccgugcugguccagaucaaguacgagggcaccgacgcgcccugcaagauccccuucagcacccaggacgagaagggggugacgcagaacggccggcugaucaccgccaacccgaucgugaccgacaaggagaagcccgucaacaucgaggccgagccgcccuucggggaguccuacaucgugaucggcgccggcgagaaggcgcugaagcucagcugguucaagaagggguccagcaucggcaagauguucgaggccaccgcccgcggggcccggcgcauggccauccugggcgacacggcgugggacuucggguccaucggcggcguguucaccagcgucgggaagcuggugcaccagaucuucggcaccgccuacgggguccuguucuccggcgucagcuggaccaugaagaucgggaucggcgugcugcugacguggcucggccugaacucccgcagcaccucccugagcaugaccugcaucgccguggggcucgucacccuguaccugggcgugauggugcaggccgacuccgggugcgucaucaacuggaagggccgggagcucaagugcgggagcggcaucuucgugacgaacgaggugcacaccuggaccgagcaguacaaguuccaggccgacagcccgaagcgccuguccgcggccaucggcaaggccugggaggagggggucugcggcauccggagcgccacccgccuggagaacaucauguggaagcagaucuccaacgagcucaaccacauccugcuggagaacgacaugaaguucaccgugguggucggggacguggugggcauccucgcccaggggaagaagaugauccggccccagcccauggagcacaaguacagcuggaaguccuggggcaaggcgaagaucaucggcgccgacguccagaacacgaccuucaucaucgacgggcccaacaccccggagugccccgacgaccagcgcgccuggaacaucugggagguggaggacuacggcuucgggaucuucaccacgaacaucuggcugaagcugcgggacagccacacccaggugugcgaccaccgccucauguccgccgcgaucaaggacagcaaggccguccacgccgacaugggcuacuggaucgaguccgagaagaacgagaccuggaagcuggcccgggccagcuucaucgaggugaagaccugcaucuggcccaagucccacacgcuguggagcaacggcgugcucgaguccgagaugaucauccccaagaucuacgggggcccgaucagccagcacaacuaccgccccggguacuucacccagaccgcgggccccuggcaccuggggaagcuggagcucgacuucgaccugugcgagggcaccacggucgugguggacgagcacugcggcaaccgggggccgucccugcgcaccaccaccgucacgggcaagaucauccacgaguggugcugccggagcugcacccugccgccccuccgcuucaagggggaggacggcugcugguacgggauggagauccggcccgugaaggagaaggaggagaaccuggugaaguccauggucagcgccggcagcggcgagguggacuccuucagccucgggcugcugugcaucuccaucaugaucgaggaggugaugcgcagccgguggucccgcaagaugcucaugaccggcacccuggccgucuuccugcuccugaucauggggcagcugacguggaacgaccucauccggcugugcaucauggugggcgccaacgccagcgaccgcauggggaugggcaccaccuaccuggcgcucauggccaccuucaagaugcgcccgauguucgccguggggcugcuguuccggcgccucacgucccgggagguccugcugcucaccaucgggcugagccugguggccuccgucgagcuccccaacagccuggaggagcugggcgacgggcucgccaugggcaucaugauccugaagcugcucaccgacuuccagucccaccagcugugggcgacccugcucagccugacguucaucaagaccacccugucccuccacuacgccuggaagaccauggccauggugcugagcaucgugucccuguucccccucugccugagcacgaccucccagaagaccaccuggcugcccguccuccugggcagccuggggugcaagccgcucgccauguuccugaucgcggagaacaagaucuggggccgcaaguccuggccccugaacgaggggaucauggccgugggcguggucagcauccuccugagcucccugcucaagaacgacgugccccuggccgggccccugaucgccggcggcaugcucaucgccugcuacgugaucagcggguccagcgcggaccugucccuggagaaggccgccgaggucagcugggaggaggaggccgagcacuccggcgccagccacaacauccucguggaggugcaggacgacgggacgaugaagaucaaggacgaggagcgggacgacacccugaccauccugcucaaggcgacccugcuggccgucuccggcguguacccgcucagcauccccgccacccuguucgugugguacuucuggcagaagaagaagcagcgcuccgggguccugugggacacgcccagcccgcccgagguggagcgggccgugcuggacgacggcaucuaccgcaucaugcagcggggccuccuggggcgcucccaggucggcguggggguguuccaggagaacgucuuccacaccauguggcacgugacccggggcgccgugcugauguaccaggggaagcgccucgagcccagcugggcguccgucaagaaggaccugaucagcuacggcggcggguggcggcugcagggcuccuggaacaccggggaggagguccaggugaucgccgucgagcccggcaagaaccccaagaacgugcagacggcccccgggaccuucaagacccccgagggcgaggugggcgccaucgcccucgacuucaagcccgggaccagcggcucccccaucgucaaccgcgaggggaagaucgugggccuguacggcaacgggguggucacgaccagcggcaccuacgugagcgcgaucgcccaggccaaggccucccaggaggggccgcugcccgagaucgaggacgagguguuccggaagcgcaaccucaccaucauggaccugcaccccggcagcgggaagacgcggcgcuaccugccggcgaucguccgggaggccaucaagcgcaagcuccggacccugauccuggcccccacccgcgugguggccuccgagauggccgaggcgcucaagggcaugcccauccgcuaccagaccacggccgucaagagcgagcacaccggcaaggagaucguggaccugaugugccacgccaccuucaccaugcggcugcucucccccgugcgcgucccgaacuacaacaugaucaucauggacgaggcccacuucacggaccccagcuccaucgccgcgcggggguacaucagcacccgcgugggcaugggggaggccgccgccaucuucaugaccgccacgccgcccggcuccguggaggcguucccgcagagcaacgccgucauccaggacgaggagcgggacauccccgagcgcuccuggaacagcggguacgaguggaucacggacuuccccggcaagaccgugugguucgugcccuccaucaagagcggcaacgacaucgccaacugccugcggaagaacgggaagcgcgucauccagcugucccggaagaccuucgacaccgaguaccagaagacgaagaacaacgacugggacuacguggugaccaccgacaucagcgagaugggcgccaacuuccgcgcggaccgggucaucgacccgcgccggugccucaagcccgugauccugaaggacgggcccgagcgcgucauccuggccggccccaugccggugaccguggccuccgccgcccagcggcgcgggcggaucggccgcaaccacaacaaggagggcgaccaguacaucuacauggggcagccccucaacaacgacgaggaccacgcgcacuggacggaggccaagaugcugcuggacaacaucaacacccccgagggcaucauccccgcccucuucgagccggagcgggagaaguccgccgccaucgacggggaguaccgccugcgcggcgaggcgcggaagaccuucgucgagcugaugcgccgcggggaccuccccguguggcuguccuacaagguggccagcgagggcuuccaguacagcgaccgccgguggugcuucgacggcgagcgcaacaaccagguccuggaggagaacauggacguggagaucuggaccaaggagggggagcggaagaagcuccgcccccgguggcuggacgcccgcacguacuccgacccccuggcccuccgggaguucaaggaguucgccgcgggccgccggagcguguccggggaccugauccuggagaucggcaagcucccgcagcaccugacccagcgcgcccagaacgcccuggacaaccucgucaugcugcacaacagcgagcagggcgggcgggccuaccgccacgcgauggaggagcugcccgacaccaucgagacccucaugcugcuggcccucaucgccgugcugacgggcggggugacccuguucuuccucuccggccgggggcugggcaagaccagcaucggccugcucugcgucauggccuccagcgugcugcuguggauggccuccguggagccccacuggaucgcggccagcaucauccucgaguucuuccugaugguccugcucauccccgagccggaccgccagcggacgccccaggacaaccagcuggccuacguggugaucgggcuccucuucaugauccugaccgucgccgccaacgagaugggccugcucgagacgaccaagaaggaccuggggaucggccacguggcgguggagaaccaccaccacgccaccaugcuggacgucgaccuccaccccgccuccgccuggacccuguacgccguggcgacgaccaucaucaccccgaugaugcgccacaccaucgagaacacgaccgccaacaucagccugaccgccaucgccaaccaggccgcgauccucauggggcuggacaagggcuggcccaucuccaagauggacaucggcgugccccugcucgcccuggggugcuacagccaggucaacccccugacccucacggccgccgugcugaugcugguggcgcacuacgccaucaucggcccggggcuccaggccaaggccacccgggaggcccagaagcgcaccgcggccggcaucaugaagaaccccaccgucgacgggaucguggccaucgaccuggaccccguggucuacgacgccaaguucgagaagcagcugggccagaucaugcuccugauccugugcacgucccagauccuccugaugcgcaccaccugggcccugugcgagagcaucacccucgcgacgggcccccugaccacccugugggagggguccccgggcaaguucuggaacaccacgaucgccgugagcauggccaacaucuuccggggguccuaccucgccggcgccggccuggcguucagccugaugaagucccucgggggcgggcgccggggcaccggggcccagggcgagacccugggcgagaaguggaagcgccagcugaaccagcucuccaagagcgaguucaacaucuacaagcgguccgggaucauggagguggaccgcagcgaggccaaggagggccugaagcgcggggagaccacgcgccacgccgucucccggggcaccgcgaagcugcgcugguucguggagcggaaccuggugaagcccgaggggaaggucaucgaccucggcugcggccgcgggggcuggagcuacuacugcgccgggcugaagaaggugaccgaggugaagggcuacaccaagggcgggcccggccacgaggagcccaucccgauggccacguacggguggaaccuggucaagcuccacuccggcaaggacguguucuucacgccgcccgagaagugcgacacccugcugugcgacaucggggagagcucccccaacccgaccaucgaggagggccggacgcuccgcgugcugaagauggucgagcccuggcugcgggggaaccaguucugcaucaagauccucaaccccuacaugcccagcgugguggagacccuggagcagaugcagcgcaagcacggcggcaugcugguccggaacccgcucucccgcaacagcacccacgagauguacuggguguccugcgggaccggcaacaucgugagcgccgucaacaugaccucccggaugcugcugaaccgcuucacgauggcccaccgcaagcccaccuacgagcgggacguggaccucggggcgggcacccgccacguggccgucgagcccgagguggccaaccuggacaucaucggccagcggaucgagaacaucaagcacgagcacaagagcaccuggcacuacgacgaggacaaccccuacaagacgugggccuaccacggguccuacgaggucaagccgagcggcuccgccagcagcauggugaacgggguggucaagcugcucaccaagcccugggacgugauccccauggugacccagaucgcgaugaccgacacgacccccuucggccagcagcgcgucuucaaggagaagguggacacccggaccccgaaggccaagcgcgggacggcccagaucauggaggugaccgcccgguggcuguggggcuuccugucccgcaacaagaagccccggaucugcacccgcgaggaguucacccggaagguccgcagcaacgccgcgaucggcgccguguucguggacgagaaccaguggaacuccgccaaggaggccgucgaggacgagcgguucugggaccucgugcagaaggagcgcgagcugcacaagcaggggaagugcgcgacgugcguguacaacaugaugggcaagcgggagaagaagcugggggaguucggcaaggccaaggggagccgcgccaucugguacauguggcucggcgcccgguuccuggaguucgaggcccugggcuucaugaacgaggaccacugguucucccgcgagaacagccucuccggggucgagggcgaggggcugcacaagcugggcuacauccuccgggacaucagcaagauccccgggggcaacauguacgcggacgacaccgccggcugggacacccgcaucaccgaggacgaccugcagaacgaggcccggaucacggacaucauggagccggagcacgcccugcucgccaccuccaucuucaagcugaccuaccagaacaagguggugcgcguccagcgccccgcgaagaacgggaccgugauggacgugaucagccggcgcgaccagcggggcuccgggcaggucggcacguacggccugaacaccuucaccaacauggaggcccagcucauccgccagauggagagcgaggggaucuuccugcccuccgagcuggagacccagaaccucgccgagcgggugcuggacuggcuggagaaguacggcguggagcgccucaagcggauggccaucagcggggacgacugcgucgugaagcccaucgacgaccgcuucgccacggcgcugaccgcccugaacgacaugggcaaggugcggaaggacaucccgcagugggagcccuccaagggguggaacgacuggcagcagguccccuucugcagccaccacuuccaccagcucaucaugaaggacggccgcgagaucguggugcccugccggaaccaggacgagcuggucggccgcgcccgggugucccagggggccggcuggagccugcgcgagaccgccugccucggcaagagcuacgcgcagauguggcagcugauguacuuccaccggcgcgaccugcggcucgccgccaacgccaucugcuccgcggugccggucgacugggugcccaccagccgcacgaccugguccauccacgcccaccaccaguggaugaccaccgaggacaugcugagcguguggaaccgggucuggaucgaggagaaccccuggauggaggacaagacgcacguguccagcuggggcgacgugcccuaccuggggaagcgcgaggaccaguggugcggcucccucaucggccugaccgcccgcgccaccugggccagcaacauccaggucgcgaucaaccaggugcggcgccugaucgggaacgagaacuaccucgacuacaugaccuccaugaagcgguucaagaacgagggcgacccggagggggcccugugguga

SEQ ID NO: 8500 - RNA, 9879 nt, Artificial Sequence
  derived and/or modified CDS sequence (opt1) from DENV-1__GQ199791__SS-prME
agcgugaccaugcugcucaugcugaugcccaccgcccuggccuuccaccucaccacccggggcggggagccccacaugaucgugaccaagcaggagcggggcaagagccugcuguucaagaccagcgcgggggugaacaugugcacccucaucgccauggaccugggcgagcugugcgaggacaccaugaccuacaagugcccccggaucaccgaggccgagcccgacgacguggacugcuggugcaacgccaccgacaccugggucaccuacgggaccugcucccagacgggcgagcaccggcgcgacaagcggagcguggcccucgcgccccacgugggccuggggcuggagacccgcaccgagaccuggauguccagcgagggcgccuggaagcagauccagcgggucgagacgugggcccuccgccaccccggguucaccgugaucgcccuguuccuggcgcacgccaucggcaccuccaucacccagaaggggaucaucuucauccuccugaugcuggugacgcccagcauggccaugcggugcgucggcaucggcucccgcgacuucguggaggggcucagcggcgccaccuggguggacgucgugcuggagcacggguccugcgugaccaccauggccaaggacaagcccacgcuggacaucgagcuccugaagaccgaggucaccaaccccgcggugcugcggaagcucugcaucgaggccaagaucagcaacaccacgaccgacucccgcugccccacccagggcgaggccacccugauggaggagcaggacgccaacuucgugugccggcgcacguucgucgaccggggcugggggaacggcugcgggcuguucggcaaggggagccucaucacgugcgccaaguucaagugcgugaccaagcuggagggcaagaucgugcaguacgagaaccugaaguacuccgucaucgugaccgugcacacgggcgaccagcaccaggucgggaacgagagcaccgagcacggcaccaccgcgaccaucacgccccaggcccccaccuccgagauccagcucaccgacuacggggcccugacccuggacugcagcccccgcacgggccucgacuucaacgagauggugcugcugaccaugaaggagaaguccuggcucguccacaagcagugguuccuggaccugccgcuccccuggaccagcggggccagcaccucccaggagacguggaaccggcaggaccugcuggugaccuucaagaccgcccacgcgaagaagcaggagguggucgugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgugaugugcaccggguccuucaagcucgagaaggaggucgcggagacgcagcacggcaccgugcuggugcagaucaaguacgagggcaccgacgcccccugcaagauccccuuccugacccaggacgagaagggggucacgcagaacggccggcugaucaccgccaacccgaucgugaccgacaaggagaagcccgugaacaucgaggccgagccgcccuucggggagagcuacaucgucaucggcgcgggcgagaaggcccucaagcuguccugguucaagaaggggagcuccaucggcaagauguucgaggccaccgcccgcggggcccggcgcauggcgauccugggcgacacggccugggacuucgggagcaucggcggcguguucaccuccguggggaagcucguccaccagaucuucggcaccgccuacggggugcuguucagcggcguguccuggaccaugaagaucgggaucggcguccugcucacguggcugggccugaacagccgcuccaccagccucuccaugaccugcaucgccguggggcuggugacccuguaccucggcgucauggugcaggccgacagcgggugcgugaucaacuggaagggccgggagcugaagugcggguccggcaucuucgucacgaacgaggugcacaccuggaccgagcaguacaaguuccaggcggacagcccgaagcgccugagcgccgccaucggcaaggccugggaggagggggugugcggcauccgguccgccacccgccucgagaacaucauguggaagcagaucagcaacgagcugaaccacauccugcucgagaacgacaugaaguucaccgucguggugggggacgucgugggcauccuggcgcaggggaagaagaugauccggccccagcccauggagcacaaguacuccuggaaguccuggggcaaggccaagaucaucggcgccgacgugcagaacacgaccuucaucaucgacgggcccaacaccccggagugccccgacgaccagcgcgccuggaacaucugggaggucgaggacuacggcuucgggaucuucaccacgaacaucuggcugaagcuccgggacuccuacacccaggugugcgaccaccgccugaugagcgcggccaucaaggacuccaaggccgugcacgccgacaugggcuacuggaucgagagcgagaagaacgagaccuggaagcuggcccgggcguccuucaucgaggucaagaccugcaucuggcccaagagccacacgcucugguccaacggcgugcuggagagcgagaugaucauccccaagaucuacgggggcccgaucucccagcacaacuaccgccccggguacuucacccagaccgccggccccuggcaccuggggaagcucgagcuggacuucgaccugugcgagggcaccacgguggucguggacgagcacugcggcaaccgggggccgagccuccgcaccaccaccgugacgggcaagaucauccacgaguggugcugccgguccugcacccugccgccccugcgcuucaagggggaggacggcugcugguacgggauggagauccggcccgucaaggagaaggaggagaaccucgucaagagcaugguguccgccggcagcggcgaggucgacagcuucucccuggggcugcucugcaucagcaucaugaucgaggaggugaugcgcucccgguggagccgcaagaugcugaugaccggcacccuggccguguuccuccugcugaucauggggcagcucacguggaacgaccugauccggcugugcaucauggucggcgccaacgcguccgaccgcauggggaugggcaccaccuaccucgcccugauggccaccuucaagaugcgcccgauguucgccguggggcuccuguuccggcgccugacgagccgggaggugcugcuccugaccaucgggcugucccucgucgccagcguggagcugcccaacucccuggaggagcucggcgacgggcuggcgaugggcaucaugauccugaagcuccugaccgacuuccagagccaccagcugugggccacccuccugucccugacguucaucaagaccacccucagccugcacuacgccuggaagaccauggccaugguccuguccaucgugagccucuucccccugugccuguccacgaccagccagaagaccaccuggcuccccgugcugcugggcucccucgggugcaagccgcugacgauguuccugaucgcggagaacaagaucuggggccgcaagagcuggccccucaacgaggggaucauggccgucggcgugguguccauccugcugagcagccuccugaagaacgacgucccccuggccgggccccucaucgccggcggcaugcugaucgccugcuacgugaucuccgggagcuccgcggaccugagccucgagaaggccgccgagguguccugggaggaggaggccgagcacagcggcgccucccacaacauccuggucgaggugcaggacgacgggaccaugaagaucaaggacgaggagcgggacgacacccugaccauccuccugaaggcgacccugcucgccgugagcggcgucuacccgcuguccauccccgccacgcuguucgugugguacuucuggcagaagaagaagcagcgcagcggggugcugugggacacccccagcccgcccgaggucgagcgggccgugcucgacgacggcaucuaccgcaucaugcagcggggccugcuggggcgcagccaggugggcgucgggguguuccaggagaacguguuccacaccauguggcacgucacccggggcgccgugcucauguaccaggggaagcgccuggagcccuccugggcgagcgugaagaaggaccugaucuccuacggcggcggguggcggcuccagggcagcuggaacacgggggaggagguccaggugaucgccguggagcccggcaagaaccccaagaacguccagaccgcccccgggaccuucaagacccccgagggcgaggugggcgccaucgcccuggacuucaagcccgggacguccggcagccccaucgugaaccgcgaggggaagaucgucggccuguacggcaacgggguggugaccaccuccggcaccuacgucagcgcgaucgcccaggccaaggccagccaggaggggccgcuccccgagaucgaggacgagguguuccggaagcgcaaccugacgaucauggaccugcaccccggcuccgggaagacccggcgcuaccucccggcgaucgugcgggaggccaucaagcgcaagcugcggacccugauccucgcccccacccgcgucguggccagcgagauggccgaggcgcugaagggcaugcccauccgcuaccagacgaccgccgugaaguccgagcacaccggcaaggagaucgucgaccugaugugccacgccaccuucacgaugcggcuccugagccccgugcgcgugccgaacuacaacaugaucaucauggacgaggcccacuucaccgaccccuccagcaucgccgcgcggggguacaucuccacccgcgucggcaugggggaggccgccgccaucuucaugaccgccacgccgcccggcagcguggaggcguucccgcaguccaacgccgugauccaggacgaggagcgggacauccccgagcgcagcuggaacuccggguacgaguggaucaccgacuuccccggcaagaccgucugguucgugcccagcaucaaguccggcaacgacaucgccaacugccugcggaagaacgggaagcgcgugauccagcucagccggaagaccuucgacacggaguaccagaagaccaagaacaacgacugggacuacgucgugaccaccgacaucuccgagaugggcgccaacuuccgcgcggaccgggugaucgacccgcgccggugccugaagcccgucauccugaaggacgggcccgagcgcgugauccucgccggccccaugccggucacgguggccagcgccgcccagcggcgcgggcggaucggccgcaaccacaacaaggagggcgaccaguacaucuacauggggcagccccugaacaacgacgaggaccacgcgcacuggaccgaggccaagaugcugcucgacaacaucaacacccccgagggcaucauccccgcccuguucgagccggagcgggagaaguccgccgccaucgacggggaguaccgccugcgcggcgaggcgcggaagaccuucguggagcucaugcgccgcggggaccugcccgucuggcugagcuacaagguggccuccgagggcuuccaguacagcgaccgccgguggugcuucgacggcgagcgcaacaaccaggugcucgaggagaacauggacgucgagaucuggacgaaggagggggagcggaagaagcugcgcccccgguggcuggacgcccgcaccuacagcgacccccucgcccugcgggaguucaaggaguucgccgcgggccgccgguccgugagcggggaccugauccucgagaucggcaagcugccgcagcaccugacccagcgcgcccagaacgcccucgacaaccuggugaugcugcacaacuccgagcagggcgggcgggccuaccgccacgcgauggaggagcuccccgacaccaucgagacgcugaugcugcucgcccugaucgccguccugaccggcggggugacccucuucuuccugagcggccgggggcugggcaagaccuccaucggcgugcucugcgucauggccagcuccgugcugcuguggauggccagcguggagccccacuggaucgcggccuccaucauccucgaguucuuccugaugguccugcucauccccgagccggaccgccagcggacgccccaggacaaccagcuggccuacguggugaucgggcuccuguucaugauccugacggucgccgccaacgagaugggccugcucgagaccaccaagaaggaccuggggaucggccacguggcgguggagaaccaccaccacgccaccaugcuggacgucgaccuccaccccgccagcgccuggacgcuguacgccguggcgaccaccaucaucaccccgaugaugcgccacacgaucgagaacaccaccgccaacaucucccugaccgccaucgccaaccaggccgcgauccucauggggcuggacaagggcuggcccaucagcaagauggacaucggcgugccccugcucgcccuggggugcuacucccaggucaacccccugacgcucaccgccgccgugcugaugcugguggcgcacuacgccaucaucggcccggggcuccaggccaaggccacccgggaggcccagaagcgcaccgcggccggcaucaugaagaaccccacggucgacgggaucguggccaucgaccuggaccccguggucuacgacgccaaguucgagaagcagcugggccagaucaugcuccugauccugugcaccagccagauccuccugaugcgcaccaccugggcccugugcgaguccaucacgcucgcgaccggcccccugaccacccugugggaggggagcccgggcaaguucuggaacacgaccaucgccguguccauggccaacaucuuccgggggagcuaccucgccggcgccggccuggcguucucccugaugaagucccucgggggcgggcgccggggcaccggggcccagggcgagacccugggcgagaaguggaagcgccagcugaaccagcucagcaaguccgaguucaacaucuacaagcggagcgggaucauggagguggaccgcuccgaggccaaggagggccugaagcgcggggagacgacccgccacgccgucagccggggcaccgcgaagcugcgcugguucguggagcggaaccuggugaagcccgaggggaaggucaucgaccucggcugcggccgcgggggcugguccuacuacugcgccgggcugaagaaggugaccgaggugaagggcuacacgaagggcgggcccggccacgaggagcccaucccgauggccaccuacggguggaaccuggucaagcuccacagcggcaaggacguguucuucacgccgcccgagaagugcgacacccugcugugcgacaucggggaguccagccccaacccgacgaucgaggagggccggacccuccgcgugcugaagauggucgagcccuggcugcgggggaaccaguucugcaucaagauccucaaccccuacaugcccuccgugguggagacccuggagcagaugcagcgcaagcacggcggcaugcugguccggaacccgcucagccgcaacuccacccacgagauguacugggugagcugcgggaccggcaacaucguguccgccgucaacaugacgagccggaugcugcugaaccgcuucaccauggcccaccgcaagcccaccuacgagcgggacguggaccucggggcgggcacccgccacguggccgucgagcccgagguggccaaccuggacaucaucggccagcggaucgagaacaucaagcacgagcacaaguccacguggcacuacgacgaggacaaccccuacaagaccugggccuaccacgggagcuacgaggucaagccguccggcagcgccuccagcauggugaacgggguggucaagcugcucaccaagcccugggacgugauccccauggugacccagaucgcgaugacggacaccacccccuucggccagcagcgcgucuucaaggagaagguggacacccggacgccgaaggccaagcgcgggaccgcccagaucauggaggugaccgcccgguggcuguggggcuuccugagccgcaacaagaagccccggaucugcacccgcgaggaguucacgcggaagguccgcuccaacgccgcgaucggcgccguguucguggacgagaaccaguggaacagcgccaaggaggccgucgaggacgagcgguucugggaccucgugcagaaggagcgcgagcugcacaagcaggggaagugcgcgaccugcguguacaacaugaugggcaagcgggagaagaagcugggggaguucggcaaggccaaggggucccgcgccaucugguacauguggcucggcgcccgguuccuggaguucgaggcccugggcuucaugaacgaggaccacugguucagccgcgagaacucccucagcggggucgagggcgaggggcugcacaagcugggcuacauccuccgggacaucuccaagauccccgggggcaacauguacgcggacgacaccgccggcugggacacccgcaucacggaggacgaccugcagaacgaggccaagaucaccgacaucauggagccggagcacgcccugcucgccaccagcaucuucaagcugaccuaccagaacaagguggugcggguccagcgccccgcgaagaacgggacggugauggacgugaucucccgccgggaccagcgcggcagcgggcaggucggcaccuacggccugaacaccuucaccaacauggaggcccagcucauccggcagauggaguccgaggggaucuuccugcccagcgagcuggagacgcccaaccucgccgagcgcgugcuggacuggcuggagaaguacggcguggagcggcucaagcgcauggccaucuccggggacgacugcgucgugaagccgaucgacgaccgguucgccaccgcgcugaccgcccugaacgacaugggcaaggugcgcaaggacaucccccagugggagcccagcaagggguggaacgacuggcagcagguccccuucugcucccaccacuuccaccagcucaucaugaaggacggccgggagaucguggugccgugccgcaaccaggacgagcuggucggccgggcccgcgugagccagggggccggcuggucccugcgggagaccgccugccucggcaagagcuacgcgcagauguggcagcugauguacuuccaccgccgggaccugcgccucgccgccaacgccaucugcagcgcggugcccgucgacugggugcccacgucccggaccaccuggagcauccacgcccaccaccaguggaugaccacggaggacaugcuguccguguggaaccgcgucuggaucgaggagaaccccuggauggaggacaagacccacgugagcuccuggggcgacgugccguaccuggggaagcgggaggaccaguggugcggcagccucaucggccugaccgcccgcgccaccugggccuccaacauccaggucgcgaucaaccaggugcgccggcugaucgggaacgagaacuaccucgacuacaugaccagcaugaagcgcuucaagaacgagggcgaccccgagggggccuucugguga

SEQ ID NO: 8501 - RNA, 9879 nt, Artificial Sequence
  derived and/or modified CDS sequence (opt1) from DENV-1__GQ199792__SS-prME
agcgugaccaugcugcucaugcugaugcccaccgcccuggccuuccaccucaccacccgcggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccgcaucaccgaggccgagcccgacgacguggacugcuggugcaacgccaccgacgccugggugaccuacgggaccugcagccagaccggcgagcaccggcgcgacaagcgguccguggcccucgcgccccacgugggccuggggcuggagacccgcaccgagaccuggaugagcuccgagggcgccuggaagcagauccagcgggucgagaccugggcccuccgccaccccggguucaccgugaucgcgcuguuccuggcccacgccaucggcacgagcaucacccagaaggggaucaucuucauccuccugaugcuggugacccccuccauggccaugcggugcgucggcaucggcagccgcgacuucguggaggggcucuccggcgccaccuggguggacgucgugcuggagcacgggagcugcgugacgaccauggcgaaggacaagcccacccuggacaucgagcuccugaagaccgaggucacgaaccccgccgugcugcggaagcucugcaucgaggccaagaucuccaacaccaccaccgacagccgcugcccgacgcagggcgaggccacccugguggaggagcaggacgccaacuucgucugccggcgcaccuucguggaccggggcugggggaacggcugcgggcuguucggcaaggggucccucaucacgugcgcgaaguucaagugcgugacgaagcuggagggcaagaucguccaguacgagaaccugaaguacagcgugaucgugaccguccacaccggcgaccagcaccagguggggaacgaguccaccgagcacggcacgaccgccaccaucacgccccaggcccccaccacggagauccagcucaccgacuacggggcccugacccuggacugcagcccccgcaccggccucgacuucaacgagaugguccugcugacgaugaaggagaaguccuggcucgugcacaagcagugguuccuggaccugccccuccccuggaccagcggggccagcaccucccaggagaccuggaaccggcaggaccugcuggugacguucaagaccgcgcacgccaagaagcaggaggucguggugcucggcagccaggagggcgccaugcacaccgcccugaccggggccacggagauccagaccuccggcaccaccacgaucuucgcggggcaccugaagugccgccucaagauggacaagcugacccugaagggcaugagcuacgucaugugcaccggguccuucaagcucgagaaggagguggccgagacccagcacggcacggugcugguccagaucaaguacgagggcaccgacgcccccugcaagauccccuucagcacccaggacgagaagggggugacccagaacggccggcugaucacggccaacccgaucgugaccgacaaggagaagcccgucaacaucgaggcggagccgcccuucggggaguccuacaucgugaucggcgccggcgagaaggcccugaagcucagcugguucaagaagggguccagcaucggcaagauguucgaggccaccgcccgcggggcgcggcgcauggccauccugggcgacaccgccugggacuucggguccaucggcggcguguucacgagcgucgggaagcuggugcaccagaucuucggcaccgccuacgggguccucuucuccggcgucagcuggaccaugaagaucgggaucggcgugcugcugaccuggcucggccugaacucccgcagcacgucccugagcaugaccugcaucgccguggggcucgucacccuguaccugggcgugauggugcaggcggacuccgggugcgucaucaacuggaagggccgggagcucaagugcgggagcggcaucuucgugaccaacgaggugcacacguggaccgagcaguacaaguuccaggccgacagcccgaagcgccuguccgccgccaucggcaaggccugggaggagggggucugcggcauccggagcgcgacccgccuggagaacaucauguggaagcagaucuccaacgagcucaaccacauccugcuggagaacgacaugaagcucaccgugguggucggggacguggccggcauccuggggcagggcaagaagaugauccggccccagcccauggaguacaaguacagcuggaaguccuggggcaaggccaagaucaucggggccgacgcgcagaacaccacguucaucaucgacggccccaacaccccggagugccccgacgaccagcgcgccuggaacaucugggagguggaggacuacggguucggcaucuucaccaccaacaucuggcugaagcuccgggacagcuacacgcaggucugcgaccaccgccugauguccgccgccaucaaggacagcaaggccgugcacgcggacaugggcuacuggaucgaguccgagaagaacgagaccuggaagcuggcccgggccagcuucaucgaggugaagaccugcaucuggcccaagucccacacccucuggagcaacgggguccuggaguccgagaugaucauccccaagaucuacggcgggccgaucagccagcacaacuaccgccccggcuacuucacgcagaccgccgggcccuggcaccugggcaagcucgagcuggacuucgaccugugcgagggcaccaccgugguggucgacgagcacugcgggaaccggggcccgucccuccgcacgaccaccgugaccgggaagaucauccacgaguggugcugccggagcugcacgcugccgccccugcgcuuccggggcgaggacgggugcugguacggcauggagauccgccccgugaaggagaaggaggagaaccucgucaaguccauggugagcgccggcagcggggagguggacuccuucagccugggccugcucugcaucuccaucaugaucgaggaggucaugcggagccgcuggucccggaagaugcugaugaccgggacccuggcgguguucuuccuccugaucaugggccagcugaccuggaacgaccucauccgccugugcaucauggugggggccaacgccagcgaccgcaugggcaugggcacgaccuaccuggcccucauggccaccuucaagaugcggccgauguucgcggucgggcugcuguuccgccggcucaccucccgcgaggugcugcugcucacgaucggccugagccugguggccuccgucgagcuccccaacagccuggaggagcugggggacggccucgccaugggcaucaugauccugaagcugcucaccgacuuccagucccaccagcugugggccacccugcucagccugaccuucaucaagacgaccuucucccugcacuacgcguggaagaccauggccauggugcucagcaucgucucccuguucccccugugccucagcaccacgucccagaagaccaccuggcugcccgugcugcucgggagccugggcugcaagccgcugaccauguuccucaucgccgagaacaagaucugggggcggaaguccuggccccugaacgagggcaucauggccguggggaucgucagcauccugcucagcucccugcugaagaacgacgugccccucgccggcccccugaucgcgggcgggaugcugaucgccugcuacgugaucagcggcuccagcgccgaccucucccuggagaaggccgccgaggucagcugggaggaggaggcggagcacuccggggccagccacaacauccugguggaggugcaggacgacggcacgaugaagaucaaggacgaggagcgcgacgacacccucaccauccugcugaaggccacccuccuggccgucuccgggguguacccgcugagcauccccgccacccucuucgugugguacuucuggcagaagaagaagcagcgguccggcguccugugggacacgcccagcccgcccgagguggagcgcgcggugcuggacgacggcaucuaccggaucaugcagcgcgggcugcucggccggucccaggucggggugggcguguuccaggagaacgucuuccacaccauguggcacgugacccgcggggccgugcugauguaccagggcaagcggcuggagcccagcugggccuccgucaagaaggaccucaucagcuacggcgggggcuggcgccugcggggguccuggaacaugggcgaggagguccaggugaucgccgucgagcccgggaagaaccccaagaacgugcagaccgcccccggcacguucaagacccccgagggcgaggugggggcgaucgcccuggacuucaagcccggcaccagcgggucccccaucgucaaccgcgagggcaagaucgugggccucuacgggaacggcguggucaccacgagcgggaccuacgugagcgccaucgcccaggcgaaggccucccaggagggcccgcugcccgagaucgaggacgagguguuccggaagcgcaaccugaccaucauggaccuccaccccgggagcggcaagacccggcgcuaccugccggccaucguccgggaggccaucaagcgcaagcugcgcacgcucauccuggcccccacccgggugguggcguccgagauggccgaggcccugaagggcaugcccauccgcuaccagaccaccgccgucaagagcgagcacacggggaaggagaucguggaccucaugugccacgccaccuucaccaugcggcugcugucccccgugcgcgucccgaacuacaacaugaucaucauggacgaggcgcacuucaccgaccccagcuccaucgccgcccggggcuacaucagcacgcgcguggggaugggcgaggccgccgcgaucuucaugaccgccacgccgcccggguccguggaggccuucccgcagagcaacgccgucauccaggacgaggagcgggacauccccgagcgcuccuggaacagcggcuacgaguggaucaccgacuuccccggcaagacggugugguucgugcccuccaucaagagcgggaacgacaucgcgaacugccuccggaagaacggcaagcgcgucauccagcugucccggaagaccuucgacaccgaguaccagaagaccaagaacaacgacugggacuacguggugacgaccgacaucagcgagaugggggccaacuuccgcgccgaccgggucaucgacccgcgccggugccugaagcccgugauccucaaggacggccccgagcgcgugauccuggccgggcccaugccggucaccguggccuccgcggcccagcggcgcggccggaucggccgcaaccacaacaaggagggggaccaguacaucuacaugggccagccccugaacaacgacgaggaccacgcccacuggaccgaggccaagaugcuccuggacaacaucaacacgcccgaggggaucauccccgcccuguucgagccggagcgcgagaaguccgcggccgucgacggcgaguaccggcuccgcggggaggcccggaagaccuucguggagcugaugcgccggggcgaccugcccguguggcucuccuacaaggucgccagcgagggcuuccaguacagcgaccgccgguggugcuucgacggggagcgcaacaaccaggugcuggaggagaacauggacguggagaucuggaccaaggagggcgagcggaagaagcugcgcccccgguggcucgacgcccgcaccuacuccgacccccuggcgcugcgggaguucaaggaguucgccgccgggcgccggagcgucuccggcgaccucauccuggagaucggcaagcugccgcagcaccucacgcagcgcgcccagaacgcgcuggacaaccuggugaugcuccacaacagcgagcagggcgggcgggccuaccgccacgccauggaggagcugcccgacaccaucgagacccugaugcuccuggcccugaucgccgugcucaccgggggcgucacgcuguucuuccuguccgggcggggccucggcaagaccagcaucgggcugcugugcgugauggcguccagcgugcuccuguggauggccuccgucgagccccacuggaucgccgccagcaucauccuggaguucuuccucauggugcugcugauccccgagccggaccgccagcggacgccccaggacaaccagcucgccuacguggucaucggccugcuguucaugauccucaccguggcggccaacgagauggggcugcuggagaccacgaagaaggaccucggcaucgggcacguggccgucgagaaccaccaccacgccgccaugcuggacguggaccugcaccccgcguccgccuggacccucuacgccguggccaccaccaucaucacgccgaugaugcgccacaccaucgagaacaccaccgccaacaucagccugacggcgaucgccaaccaggccgccauccugaugggccucgacaagggcuggcccaucuccaagauggacaucggggucccccugcuggcgcucggcugcuacagccaggugaacccccugacccugaccgccgccgugcucaugcuggucgcccacuacgccaucaucgggccgggccugcaggcgaaggccacccgcgaggcccagaagcggacggccgccgggaucaugaagaaccccaccguggacggcaucguggcgaucgaccucgaccccgucguguacgacgccaaguucgagaagcagcugggccagaucaugcugcucauccugugcaccucccagauccugcucaugcgcaccacgugggcccugugcgagagcaucacccuggccaccgggccccucaccacgcugugggagggcuccccggggaaguucuggaacaccaccaucgccgugagcauggcgaacaucuuccggggcuccuaccuggccggcgccgggcucgccuucagccugaugaagucccugggcgggggccgccgggggaccggcgcgcagggcgagacgcucggggagaaguggaagcgccagcugaaccagcuguccaagagcgaguucaacaccuacaagcgguccggcaucauggaggucgaccgcagcgaggccaaggaggggcucaagcggggcgagaccaccaagcacgccgugucccgcgggacggccaagcugcggugguucguggagcgcaaccuggucaagcccgagggcaaggugaucgaccugggcugcgggcggggcggguggagcuacuacugcgccggccucaagaaggugaccgaggucaagggguacaccaagggcggccccgggcacgaggagcccaucccgauggcgaccuacggcuggaaccuggugaagcugcacuccgggaaggacguguucuucaucccgcccgagaagugcgacacgcuccugugcgacaucggcgagagcucccccaacccgaccaucgaggaggggcgcacccugcggguccucaagaugguggagcccuggcugcgcggcaaccaguucugcaucaagauccugaaccccuacaugcccagcguggucgagacccucgagcagaugcagcggaagcacggcgggaugcuggugcgcaacccgcugucccggaacagcacgcacgagauguacuggguguccugcggcaccgggaacaucgucagcgccgugaacaugaccucccgcaugcuccugaaccgcuucaccauggcccaccggaagcccaccuacgagcgcgacguggaccugggcacgggcacccggcacgucgccguggagcccgagguggccaaccucgacaucaucgggcagcgcaucgagaacaucaagcacgagcacaagagcaccuggcacuacgacgaggacaaccccuacaagaccugggcguaccacggcuccuacgaggucaagccgagcggguccgccagcagcauggugaacggcgucgugaagcugcugacgaagcccugggacgugauccccauggucacccagaucgccaugaccgacaccacgcccuucgggcagcagcggguguucaaggagaagguggacacccgcaccccgaaggccaagcggggcaccgcccagaucauggaggucacggcgcgcuggcucuggggcuuccugucccggaacaagaagccccgcaucugcacccgggaggaguucacccgcaaggugcggagcaacgccgccaucggggccguguucgucgacgagaaccaguggaacuccgcgaaggaggccguggaggacgagcgcuucugggaccuggugcaccgggagcgcgagcuccacaagcagggcaagugcgcgaccugcgucuacaacaugauggggaagcgggagaagaagcugggcgaguucgggaaggccaagggcagccgcgccaucugguacauguggcugggcgcgcgguuccucgaguucgaggcccugggguucaugaacgaggaccacugguucucccgcgagaacagccuguccggcguggagggggagggccuccacaagcugggguacauccugcgggacaucagcaagauccccggcggcaacauguacgccgacgacacggccgggugggacacccgcaucaccgaggacgaccuccagaacgaggccaagaucaccgacaucauggagccggagcacgcgcugcuggccaaggccaucuucaagcucacguaccagaacaaggugguccgcgugcagcggcccgccaagaacggcaccgugauggacgucaucucccgccgggaccagcgcgggagcggccaggugggcaccuacgggcugaacaccuucacgaacauggaggcccagcugauccggcagauggaguccgagggcaucuucagccccuccgagcucgagacccccaaccuggcggagcgcgcccuggacuggcucgagaaguacgggguggagcggcugaagcgcauggccaucagcggcgacgacugcgucgugaagccgaucgacgaccgguucgccaccgcccugaccgcgcucaacgacauggggaaggugcgcaaggacaucccccagugggagcccuccaagggcuggaacgacuggcagcagguccccuucugcagccaccacuuccaccagcugaucaugaaggacggccgggagaucguggugccgugccgcaaccaggacgagcuggucgggcgggcccgcgugucccagggcgccggguggagccuccgggagacggccugccugggcaagagcuacgcgcagauguggcagcugauguacuuccaccgccgggaccuccgccuggccgccaacgccaucugcuccgccgugcccggggacuggguccccaccagccggaccaccugguccauccacgcgcaccaccaguggaugacgaccgaggacaugcugagcguguggaaccgcguguggaucgaggagaaccccuggauggaggacaagacccacaucuccagcugggaggacgucccguaccucggcaagcgcgaggaccaguggugcggcucccugaucgggcugaccgcccgggccacgugggccaccaacauccagguggccaucaaccaggugcgccggcucaucggcaacgagaacuaccuggacuacaugaccagcaugaagcgcuucaagaacgaguccgaccccgagggggcgcugugguga

SEQ ID NO: 8502 - RNA, 9879 nt, Artificial Sequence
  derived and/or modified CDS sequence (opt1) from DENV-1__GQ199793__SS-prME
agcgugaccaugcugcucaugcugaugcccaccgcccuggccuuccaccucaccacccggggcggggagccccacaugaucgugaccaagcaggagcggggcaagagccugcuguucaagaccagcgcgggggugaacaugugcacccucaucgccauggaccugggggagcugugcgaggacaccaugaccuacaagugcccccggaucaccgaggccgagcccgacgacguggacugcuggugcaacgccaccgacaccugggugaccuacgggaccugcucccagacgggggagcaccggcgcgacaagcggagcguggcccucgcgccccacgugggccuggggcuggagacccgcaccgagaccuggauguccagcgagggcgccuggaagcagauccagcgggucgagacgugggcccuccgccaccccggguucaccgugaucgcccuguuccuggcgcacgccaucggcaccuccaucacccagaaggggaucaucuucauccuccugaugcuggugacgcccagcauggccaugcggugcgucggcaucggcucccgcgacuucguggaggggcucagcggcgccaccuggguggacgucgugcuggagcacggguccugcgugaccaccauggccaaggacaagcccacgcuggacaucgagcuccugaagaccgaggucaccaaccccgcggugcugcggaagcucugcaucgaggccaagaucagcaacaccacgaccgacucccgcugccccacccagggcgaggccacccugauggaggagcaggacgccaacuucgugugccggcgcacguucgucgaccggggcugggggaacggcugcgggcuguucggcaaggggagccucaucacgugcgccaaguucaagugcgugaccaagcuggagggcaagaucgugcaguacgagaaccugaaguacuccgucaucgugaccgugcacacgggcgaccagcaccaggucgggaacgagagcaccgagcacggcaccaccgcgaccaucacgccccaggcccccaccuccgagauccagcucaccgacuacggggcccugacccuggacugcagcccccgcacgggccucgacuucaacgagauggugcugcugaccaugaaggagaaguccuggcucguccacaagcagugguuccuggaccugccgcuccccuggaccagcggggccaccacgagccaggagaccuggaaccggcaggaccugcuggugaccuucaagaccgcccacgcgaagaagcaggagguggucgugcucggcucccaggagggcgccaugcacacggcccugaccggggccaccgagauccagaccagcggcacgaccaccaucuucgccgggcaccugaagugccgccucaagauggacaagcugacccugaagggcauguccuacgugaugugcacggggagcuucaagcucgagaaggaggucgcggagacccagcacggcaccgugcuggugcagaucaaguacgagggcaccgacgcccccugcaagauccccuucuccacgcaggacgagaagggggucacccagaacggccggcugaucaccgccaacccgaucgugaccgacaaggagaagcccgugaacaucgaggccgagccgcccuucggggagagcuacaucgucaucggcgcgggcgagaaggcccugaagcucuccugguucaagaaggggagcuccaucggcaagauguucgaggccacggcccgcggggcccggcgcauggcgauccugggcgacaccgccugggacuucgggagcaucggcggcguguucaccuccguggggaagcugguccaccagaucuucggcaccgccuacgggguccuguucagcggcguguccuggacgaugaagaucgggaucggcguccugcugaccuggcucggccugaacagccgcuccaccagccuguccaugaccugcaucgccguggggcucgugacgcuguaccugggcgucauggugcaggccgacagcgggugcgugaucaacuggaagggccgggagcucaagugcggguccggcaucuucgucaccaacgaggugcacaccuggaccgagcaguacaaguuccaggcggacagcccgaagcgccugagcgccgccaucggcaaggccugggaggagggggugugcggcauccgguccgccacccgccuggagaacaucauguggaagcagaucagcaacgagcucaaccacauccugcuggagaacgacaugaaguucacggucguggugggggacgucgugggcauccucgcgcaggggaagaagaugauccggccccagcccauggagcacaaguacuccuggaaguccuggggcaaggccaagaucaucggcgccgacgugcagaacaccaccuucaucaucgacgggcccaacaccccggagugccccgacgaccagcgcgccuggaacaucugggaggucgaggacuacggcuucgggaucuucacgaccaacaucuggcugaagcugcgggacuccuacacccagaugugcgaccaccgccucaugagcgcggccaucaaggacuccaaggccgugcacgccgacaugggcuacuggaucgagagcgagaagaacgagaccuggaagcuggcccgggcguccuucaucgaggugaagacgugcaucuggcccaagagccacacccugugguccaacggcguccucgagagcgagaugaucauccccaagaucuacgggggcccgaucucccagcacaacuaccgccccggguacuucacccagaccgccggccccuggcaccuggggaagcuggagcucgacuucgaccugugcgagggcacgaccgugguggucgacgagcacugcggcaaccgggggccgagccugcgcaccaccacggugaccggcaagaucauccacgaguggugcugccgguccugcacccugccgccccuccgcuucaagggggaggacggcugcugguacgggauggagauccggcccgugaaggagaaggaggagaaccuggucaagagcaugguguccgccggcagcggcgagguggacagcuucucccucgggcugcugugcaucagcaucaugaucgaggaggucaugcgcucccgguggagccgcaagaugcucaugaccggcacgcuggccguguuccugcuccugaucauggggcagcugaccuggaacgaccucauccggcugugcaucauggugggcgccaacgcguccgaccgcauggggaugggcaccaccuaccuggcccucauggccacguucaagaugcgcccgauguucgccgucggccugcuguuccggcgccucaccagccgggaggugcugcugcucaccaucgggcugucccugguggccagcgucgagcuccccaacucccuggaggagcugggcgacgggcucgcgaugggcaucaugauccugaagcugcucaccgacuuccagagccaccagcugugggccacgcugcucucccugaccuucaucaagaccacccugagccuccacuacgccuggaagacgauggccauggugcuguccaucgucagccuguucccccucugccuguccaccaccagccagaagaccacguggcugcccgugcuccugggcucccuggggugcaagccgcucaccauguuccugaucaccgagaacaagaucuggggccgcaagagcuggccccugaacgaggggaucauggcggugggcgucguguccauccuccugagcagccugcucaagaacgacgugccccuggccgggccccugaucgccggcggcaugcucaucgccugcuacgucaucuccgggagcuccgccgaccugagccuggagaaggcggccgagguguccugggaggaggaggccgagcacagcggcgccucccacaacauccucguggagguccaggacgacgggaccaugaagaucaaggacgaggagcgggacgacacccugacgauccugcucaaggccacccugcuggcggugagcggcguguacccgcucuccauccccgccacccuguucgucugguacuucuggcagaagaagaagcagcgcagcggggugcugugggacacccccagcccgcccgagguggagcgggccguccuggacgacggcaucuaccgcaucaugcagcggggccuccuggggcgcagccaggugggcgugggggucuuccaggagaacguguuccacacgauguggcacgugacccggggcgccguccugauguaccaggggaagcgccucgagcccuccugggccagcgugaagaaggaccugaucuccuacggcggcggguggcggcugcagggcagcuggaacgcgggggaggaggugcaggucaucgccguggagcccggcaagaaccccaagaacgugcagaccgcccccgggaccuucaagacgcccgagggcgaggucggcgccaucgcccucgacuucaagcccgggaccuccggcagccccaucgugaaccgcgaggggaagaucgugggccuguacggcaacggggucgugaccaccuccggcacguacgugagcgcgaucgcccaggccaaggccagccaggaggggccgcugcccgagaucgaggacgaggucuuccggaagcgcaaccucaccaucauggaccugcaccccggcuccgggaagacccggcgcuaccugccggcgaucgugcgggaggccaucaagcgcaagcuccggacccugauccuggcccccacgcgcguggucgccagcgagauggccgaggcgcucaagggcaugcccauccgcuaccagaccaccgccgugaaguccgagcacaccggcaaggagaucguggaccugaugugccacgccacguucaccaugcggcugcucagccccguccgcgugccgaacuacaacaugaucaucauggacgaggcccacuucaccgaccccuccagcaucgccgcgcggggguacaucuccacccgcgugggcaugggggaggccgccgccaucuucaugacggccacgccgcccggcagcgucgaggcguucccgcaguccaacgccgugauccaggacgaggagcgggacauccccgagcgcagcuggaacuccgggcacgaguggaucaccgacuuccccggcaagaccgugugguucguccccagcaucaaguccggcaacgacaucgccaacugccugcggaagaacgggaagcgcgugauccagcugagccggaagacguucgacaccgaguaccagaagaccaagaacaacgacugggacuacguggucaccacggacaucuccgagaugggcgccaacuuccgcgcggaccgggugaucgacccgcgccggugccucaagcccgugauccugaaggacgggcccgagcgcgucauccuggccggccccaugccggugaccgucgccagcgccgcccagcggcgcgggcggaucggccgcaaccacaacaaggagggcgaccaguacaucuacauggggcagccccucaacaacgacgaggaccacgcgcacuggaccgaggccaagaugcugcuggacaacaucaacacccccgagggcaucauccccgcccucuucgagccggagcgggagaaguccgccgccaucgacggggaguaccgccugcgcggcgaggcgcggaagacguucguggagcugaugcgccgcggggaccuccccguguggcugagcuacaaggucgccuccgagggcuuccaguacagcgaccgccgguggugcuucgacggcgagcgcaacaaccaggugcuggaggagaacauggacguggagaucuggaccaaggagggggagcggaagaagcuccgcccccgguggcuggacgcccgcaccuacagcgacccccuggcccuccgggaguucaaggaguucgccgcgggccgccgguccgucagcggggaccugauccuggagaucggcaagcucccgcagcaccugacccagcgcgcccagaacgcccuggacaaccucgugaugcugcacaacuccgagcagggcgggcgggccuaccgccacgcgauggaggagcugcccgacacgaucgagacccucaugcugcuggcccucaucgccgugcugaccggcggggucacccuguucuuccucagcggccgggggcugggcaagaccuccaucggccugcucugcgugauggccagcuccgugcugcuguggauggccagcgucgagccccacuggaucgcggccuccaucauccucgaguucuuccugauggugcugcucauccccgagccggaccgccagcggacgccccaggacaaccagcuggccuacguggucaucgggcuccucuucaugauccugaccguggccgccaacgagaugggccugcucgagaccaccaagaaggaccuggggaucggccacguggcggucgagaaccaccaccacgccacgaugcuggacguggaccuccaccccgccagcgccuggacccuguacgccguggcgaccaccaucaucacgccgaugaugcgccacaccaucgagaacaccaccgccaacaucucccugacggccaucgccaaccaggccgcgauccucauggggcuggacaagggcuggcccaucagcaagauggacaucggcgucccccugcucgcccuggggugcuacucccaggugaacccccugacccucaccgccgccgugcugaugcuggucgcgcacuacgccaucaucggcccggggcuccaggccaaggccacccgggaggcccagaagcgcacggcggccggcaucaugaagaaccccaccguggacgggaucguggccaucgaccuggaccccgucguguacgacgccaaguucgagaagcagcugggccagaucaugcuccugauccugugcaccagccagauccuccugaugcgcaccacgugggcccugugcgaguccaucacccucgcgaccggcccccugaccacgcugugggaggggagcccgggcaaguucuggaacaccaccaucgccguguccauggccaacaucuuccgggggagcuaccucgccggcgccggccuggcguucucccugaugaagucccucgggggcgggcgccggggcaccggggcccagggcgagacgcugggcgagaaguggaagcgccagcugaaccagcucagcaaguccgaguucaacaucuacaagcggagcgggaucauggaggucgaccgcuccgaggccaaggagggccugaagcgcggggagaccacccgccacgccgugagccggggcaccgcgaagcugcgcugguucguggagcggaaccuggucaagcccgaggggaaggugaucgaccucggcugcggccgcgggggcugguccuacuacugcgccgggcugaagaaggugacggaggucaagggcuacaccaagggcgggcccggccacgaggagcccaucccgauggccaccuacggguggaaccuggugaagcuccacagcggcaaggacguguucuucacgccgcccgagaagugcgacacgcugcugugcgacaucggggaguccagccccaacccgaccaucgaggagggccggacccuccgcguccugaagaugguggagcccuggcugcgggggaaccaguucugcaucaagauccucaaccccuacaugcccuccguggucgagacccuggagcagaugcagcgcaaguacggcggcaugcuggugcggaacccgcucagccgcaacuccacccacgagauguacugggugagcugcgggacgggcaacaucgucuccgccgugaacaugaccagccggaugcugcugaaccgcuucaccauggcccaccgcaagcccaccuacgagcgggacguggaccucggggcgggcacgcgccacgucgccguggagcccgagguggccaaccuggacaucaucggccagcggaucgagaacaucaagcacgagcacaaguccaccuggcacuacgacgaggacaaccccuacaagaccugggccuaccacgggagcuacgaggucaagccguccggcagcgccuccagcauggugaacggggucgugaagcugcucaccaagcccugggacgugauccccauggucacgcagaucgcgaugaccgacaccacccccuucggccagcagcgcguguucaaggagaagguggacacgcggaccccgaaggccaagcgcgggaccgcccagaucauggaggucaccgcccgguggcuguggggcuuccugagccgcaacaagaagccccggaucugcacgcgcgaggaguucacccggaaggugcgcuccaacgccgcgaucggcgccguguucgucgacgagaaccaguggaacagcgccaaggaggccguggaggacgagcgguucugggaccucgugcagaaggagcgcgagcugcacaagcaggggaagugcgcgaccugcgucuacaacaugaugggcaagcgggagaagaagcugggggaguucggcaaggccaaggggucccgcgccaucugguacauguggcucggcgcccgguuccuggaguucgaggcccugggcuucaugaacgaggaccacugguucagccgcgagaacucccucagcgggguggagggcgaggggcugcacaagcugggcuacauccuccgggacaucuccaagauccccgggggcaacauguacgcggacgacaccgccggcugggacacgcgcaucaccgaggacgaccugcagaacgaggccaagaucaccgacaucauggagccggagcacgcccugcucgccaccagcaucuucaagcugacguaccagaacaaggugguccgggugcagcgccccgcgaagaacgggaccgugauggacgucaucucccgccgggaccagcgcggcagcggccaggugggcaccuacggccugaacaccuucacgaacauggaggcccagcucauccggcagauggaguccgaggggaucuuccugcccagcgagcuggagacccccaaccucgccgagcgcgugcuggacuggcuggagaaguacggcgucgagcggcucaagcgcauggccaucuccggggacgacugcguggugaagccgaucgacgaccgguucgccaccgcgcugaccgcccugaacgacaugggcaagguccgcaaggacaucccccagugggagcccagcaagggguggaacgacuggcagcagguccccuucugcucccaccacuuccaccagcucaucaugaaggacggccgggagaucguggucccgugccgcaaccaggacgagcuggugggccgggcccgcgugagccagggggccggcuggucccugcgggagacggccugccucggcaagagcuacgcgcagauguggcagcugauguacuuccaccgccgggaccugcgccucgccgccaacgccaucugcagcgcgguccccguggacugggugcccaccucccggaccaccuggagcauccacgcccaccaccaguggaugacgaccgaggacaugcuguccgucuggaaccgcguguggaucgaggagaaccccuggauggaggacaagacccacgugagcuccuggggcgacgucccguaccuggggaagcgggaggaccaguggugcggcagccucaucggccugaccgcccgcgccaccugggccuccaacauccagguggcgaucaaccaggugcgccggcugaucgggaacgagaacuaccucgacuacaugacgagcaugaagcgcuucaagaacgagggcgaccccgagggggcccugugguga

SEQ ID NO: 8503 - RNA, 9879 nt, Artificial Sequence
  derived and/or modified CDS sequence (opt1) from DENV-1__GQ199795__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccgcaucaccgagaccgagcccgacgacguggacugcuggugcaacgccacggacaccugggugaccuacgggaccugcagccagacgggcgagcaccggcgcgacaagcgguccguggcccucgcgccccacgugggccuggggcuggagacccgcaccgagaccuggaugagcuccgagggcgcguggaagcagauccagcgggucgagacgugggcccuccgccaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagguggccgagacccagcacggcaccgugcugguccagaucaaguacgagggcaccgacgcgcccugcaagauccccuucagcacgcaggacgagaagggggugacccagaacggccggcugaucaccgccaacccgaucgugaccgacaaggagaagcccgucaacaucgaggccgagccgcccuucggggaguccuacaucgugaucggcgccggcgagaaggcgcugaagcucagcugguucaagaagggguccagcaucggcaagauguucgaggccacggcccgcggggcccggcgcauggccauccugggcgacaccgcgugggacuucggguccaucggcggcguguucaccagcgucgggaagcuggugcaccagaucuucggcaccgccuacggggugcuguucuccggcgucagcuggacgaugaagaucgggaucggcgugcugcugaccuggcucggccugaacucccgcagcaccucccugagcaugaccugcaucgccguggggcucgucacgcuguaccugggcgugauggugcaggccgacuccgggugcgucaucaacuggaagggccgggagcucaagugcgggagcggcaucuucgugaccaacgaggugcacaccuggaccgagcaguacaaguuccaggccgacagcccgaagcgccuguccgcggccaucggcaaggccugggaggagggggucugcggcauccggagcgccacccgccuggagaacaucauguggaagcagaucuccaacgagcucaaccacauccugcuggagaacgacaugaaguucacggugguggucggggacguggccggcauccucgcgcaggggaagaagaugauccggccccagcccauggaguacaaguacagcuggaaguccuggggcaaggccaagaucaucggcgccgacgugcagaacaccaccuucaucaucgacgggcccaacaccccggagugccccgacgaccagcgcgccuggaacaucugggaggucgaggacuacggcuucgggaucuucacgaccaacaucuggcugaagcugcgggacagcuacacccaggugugcgaccaccgccucauguccgcggccaucaaggacagcaaggccgugcacgccgacaugggcuacuggaucgaguccgagaagaacgagaccuggaagcuggcccgggcgagcuucaucgaggucaagacgugcaucuggcccaagucccacacccuguggagcaacggcgugcucgaguccgagaugaucauccccaagaucuacgggggcccgaucagccagcacaacuaccgccccggguacuucacccaggccgccggccccuggcaccuggggaagcuggagcucgacuucgaccugugcgagggcaccacgguggucguggacgagcacugcggcaaccgggggccgucccugcgcaccaccaccgugacgggcaagaucauccacgaguggugcugccggagcugcacccugccgccccuccgcuuccgcggggaggacggcugcugguacgggauggagauccgccccgucaaggagaaggaggagaaccuggugaaguccauggugagcgccggcagcggcgaggucgacuccuucagccucgggcugcugugcaucuccaucaugaucgaggaggugaugcggagccgcuggucccggcgcaugcucaugaccggcacccuggccguguucuuccugcucaucauggggcagcugacguggaacgaccugauccgccucugcaucauggucggcgcgaacgccagcgaccggauggggaugggcaccaccuaccuggcccugauggccaccuucaagaugcgcccgauguucgccgugggccuccuguuccggcgccugacgucccgggaggugcuccugcugaccaucgggcucagccuggucgcguccguggagcugcccaacagccucgaggagcugggcgacgggcuggccaugggcaucaugauccucaagcugcugaccgacuuccagucccaccagcucugggccacccugcugagccucacguucaucaagaccaccuucucccugcacuacgccuggaagaccauggcgaugguccugagcaucgugucccucuucccccugugccugagcacgaccucccagaagaccaccuggcuccccgugcugcugggcagccucgggugcaagccgcugacgauguuccugaucgccgagaacaagaucuggggccgccgguccuggccccucaacgaggggaucauggccgucggcaucgugagcauccugcugagcucccuccugaagaacgacgugccccuggccgggccccucaucgccggcggcaugcugaucgcgugcuacgucaucagcggguccagcgccgaccugucccucgagaaggccgccgaggugagcugggaggaggaggccgagcacuccggcgcgagccacaacauccugguggagguccaggacgacgggaccaugaagaucaaggacgaggagcgcgacgacacccugaccauccuccugaaggccacccugcucgccguguccggcguguacccgcugagcauccccgccacgcuguucgucugguacuucuggcagaagaagaagcagcgguccggggugcucugggacacccccagcccgcccgagguggagcgcgccguccuggacgacggcaucuaccggaucaugcagcgcggccugcuggggcggucccaggugggcgugggggucuuccaggagaacguguuccacaccauguggcacgugacccgcggcgcgguccucauguaccaggggaagcggcuggagcccagcugggccuccgugaagaaggaccugaucagcuacggcggcggguggcgccuccagggcuccuggaacacgggggaggaggugcaggucaucgccguggagcccggcaagaaccccaagaacgugcagaccgcccccgggaccuucaagacccccgagggcgaggucggcgccaucgcgcuggacuucaagcccgggacgagcggcucccccaucgugaaccgggaggggaagaucgugggccuguacggcaacggggucgugaccaccagcggcaccuacgugagcgccaucgcccaggccaaggcgucccaggaggggccgcuccccgagaucgaggacgaggucuuccgcaagcggaaccugacgaucauggaccugcaccccggcagcgggaagacccgccgguaccucccggccaucgugcgcgaggccaucaagcgcaagcugcggacccugauccucgcccccacccgcguggucgccuccgagauggcggaggcccugaagggcaugcccauccgguaccagacgaccgccgucaagagcgagcacaccggcaaggagaucguggaccugaugugccacgccaccuucacgaugcgccuccugucccccguccgggugccgaacuacaacaugaucaucauggacgaggcccacuucaccgaccccagcuccaucgcggcccgcggguacaucagcacccgggugggcaugggggaggccgccgccaucuucaugaccgcgacgccgcccggcuccgucgaggccuucccgcagagcaacgccgugauccaggacgaggagcgcgacauccccgagcgguccuggaacagcggguacgaguggaucaccgacuuccccggcaagaccgugugguucguccccuccaucaagagcggcaacgacaucgccaacugccugcgcaagaacgggaagcgggugauccagcucucccgcaagaccuucgacacggaguaccagaagaccaagaacaacgacugggacuacguggucaccaccgacaucagcgagaugggcgcgaacuuccgggccgaccgcgugaucgacccgcggcgcugccugaagcccgugauccugaaggacgggcccgagcgggucauccucgccggccccaugccggugacggucgccuccgccgcgcagcgccgggggcgcaucggccgcaaccacaacaaggagggcgaccaguacaucuacauggggcagccccugaacaacgacgaggaccacgcccacuggaccgaggccaagaugcugcucgacaacaucaacacccccgagggcaucauccccgcccuguucgagccggagcgggagaaguccgccgcgaucgacggggaguaccgccugcggggcgaggcccgcaagaccuucguggagcucaugcggcgcggggaccugcccguguggcuguccuacaaggucgccagcgagggcuuccaguacagcgaccggcgcuggugcuucgacggcgagcggaacaaccaggugcucgaggagaacauggacguggagaucuggacgaaggagggggagcgcaagaagcugcggccccgcuggcuggacgcccggaccuacuccgacccccucgcccugcgcgaguucaaggaguucgcggccggccggcgcagcgucuccggggaccugauccucgagaucggcaagcugccgcagcaccugacccagcgggcccagaacgcccucgacaaccuggugaugcugcacaacagcgagcagggcgggcgcgcguaccggcacgccauggaggagcuccccgacaccaucgagacgcugaugcugcucgcccugaucgccgugcugaccggcggggucacccucuucuuccuguccggccgcgggcugggcaagaccagcaucggccuccugugcgugauggccuccagcgugcugcucuggauggcguccgucgagccccacuggaucgccgccagcaucauccuggaguucuuccugauggugcuccugauccccgagccggaccggcagcgcacgccccaggacaaccagcuggccuacguggucaucgggcuccuguucaugauccugacgguggccgcgaacgagaugggccuccuggagaccaccaagaaggaccuggggaucggccacguggccgucgagaaccaccaccacgccgccaugcucgacguggaccugcaccccgccuccgcguggacccuguacgccguggccacgaccaucaucaccccgaugaugcgccacaccaucgagaacacgaccgccaacaucagccucaccgccaucgcgaaccaggccgccauccugauggggcuggacaagggcuggcccaucuccaagauggacaucggcgucccccuccuggcccuggggugcuacagccaggugaacccccucacccugacggcggccgugcugaugcucgucgcccacuacgccaucaucggcccggggcugcaggccaaggcgacccgggaggcccagaagcgcaccgccgccggcaucaugaagaaccccaccguggacgggaucguggccaucgaccuggaccccgucguguacgacgcgaaguucgagaagcagcucggccagaucaugcugcugauccucugcacgucccagauccugcugaugcggaccaccugggcccucugcgagagcaucacccuggccacgggcccccugaccacccucugggagggguccccgggcaaguucuggaacaccacgaucgccgugagcauggccaacaucuuccgcggguccuaccuggcgggcgccggccuggccuucagccucaugaagucccucgggggcgggcggcgcgggaccggggcccagggcgagacccugggcgagaaguggaagcggcagcucaaccagcuguccaagagcgaguucaacaccuacaagcgcuccgggaucauggaggucgaccggagcgaggcgaaggagggccugaagcgcggggagacgaccaagcacgccgugucccggggcaccgccaagcuccgcugguucguggagcggaaccuggucaagcccgaggggaaggugaucgaccugggcugcggccgcgggggcuggagcuacuacugcgccgggcugaagaaggugaccgaggucaagggcuacacgaagggcggccccggccacgaggaccccaucccgauggccaccuacggguggaaccucgugaagcugcacuccggcaaggacguguucuucaucccgcccgagaagugcgacacccugcucugcgacaucggggagagcucccccaacccgaccaucgaggagggccggacgcugcgcguccugaagaugguggagcccuggcuccgggggaaccaguucugcaucaagauccugaaccccuacaugcccagcguggucgagacccuggagcagaugcagcgcaagcacggcggcaugcucgugcggaacccgcugucccgcaacagcacccacgagauguacuggguguccugcgggaccggcaacaucgucagcgcggugaacaugaccucccgcaugcugcucaaccgguucacgauggcccaccgcaagcccaccuacgagcgggacguggaccugggggccggcacccgccacgucgccguggagcccgagguggccaaccuggacaucaucggccagcggaucgagaacaucaagcacgagcacaagagcaccuggcacuacgacgaggacaaccccuacaagacgugggcguaccacggguccuacgaggucaagccgagcggcuccgccagcagcauggugaacggggucgugaagcuccugaccaagcccugggacgugauccccauggucacccagaucgccaugaccgacacgacccccuucggccagcagcgcguguucaaggagaagguggacacccggaccccgaaggccaagcgcgggacggcccagaucauggaggucaccgcgaaguggcuguggggcuuccucucccggaacaagaagccccgcaucugcacccgggaggaguucacccgcaaggugcggagcaacgccgccaucggcgccguguucgucgacgagaaccaguggaacuccgcgaaggaggccguggaggacgagcgcuucugggaccuggugcaccgggagcgcgagcugcacaagcaggggaagugcgccacgugcgucuacaacaugaugggcaagcgggagaagaagcucggggaguucggcaaggccaaggggagccgcgccaucugguacauguggcugggcgcgcgguuccuggaguucgaggcccucggcuucaugaacgaggaccacugguucucccgcgagaacagccuguccgggguggagggcgaggggcugcacaagcucggcuacauccugcgggacaucagcaagauccccgggggcaacauguacgccgacgacaccgccggcugggacacccgcaucaccgaggacgaccugcagaacgaggcccgcaucacggacaucauggagccggagcacgcgcuccuggccaaguccaucuucaagcugaccuaccagaacaaggugguccgggugcagcgccccgccaagaacgggaccgugauggacgucaucagccggcgcgaccagcggggcuccggccagguggggaccuacggccucaacacguucaccaacauggaggcccagcugauccgccagauggagagcgaggggaucuucucccccagcgagcuggagacccccaaccucgccgagcgggugcuggacuggcuggagaaguacggcgucgagcgccucaagcggauggcgaucuccggggacgacugcguggugaagccgaucgacgaccgcuucgccaccgcccugacggcccugaacgacaugggcaagguccggaaggacaucccccagugggagcccagcaagggguggaacgacuggcagcagguccccuucugcucccaccacuuccaccagcucaucaugaaggacggccgcgagaucguggucccgugccggaaccaggacgagcuggugggccgcgcccgggugagccagggggcgggcuggagccugcgcgagaccgccugccucgggaaguccuacgcccagauguggcagcugauguacuuccaccggcgcgaccugcggcucgccgcgaacgccaucugcagcgccguccccguggacuggauccccaccucccgcaccacguggagcauccacgcccaccaccaguggaugaccaccgaggacaugcuguccguguggaaccgcgucuggaucgaggagaaccccuggauggaggacaagacccacaucagcuccuggggcgacgugccguaccuggggaagcgggaggaccaguggugcggcagccucaucggccugacggcccgcgcgaccugggccaccaacauccagguggccaucaaccagguccggcgccugaucgggaacgagaacuaccucgacuacaugaccuccaugaagcgguucaagaacgagagcgaccccgagggcgcccugugguga

SEQ ID NO: 8504 - RNA, 9873 nt, Artificial Sequence
  derived and/or modified CDS sequence (opt1) from DENV-1__FJ882547__SS-prME
agcgugaccaugcugcucaugcugaugcccaccgcccuggccuuccaccucaccacccgcggcggggagccccacaugaucgugagcaagcaggagcggggcaagagccugcuguucaagaccagcgcgggggugaacaugugcacccucaucgccauggaccugggcgagcugugcgaggacacgaugaccuacaagugcccccgcaucaccgaggccgagcccgacgacguggacugcuggugcaacgccaccgacacgugggugaccuacgggaccugcagccagaccggcgagcaccggcgcgacaagcgguccguggcccucgcgccccacgugggccuggggcuggagacgcgcaccgagaccuggaugagcuccgagggcgccuggaagcagauccagcgggucgagaccugggcccuccgccaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcggugcugcggaagcucugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacaccggcgaccagcaccagguggggaacgaguccacggagcacggcaccaccgcgaccaucacgccccaggcccccacgaccgagauccagcucaccgacuacggggcccugacccuggacugcagcccccgcacgggccucgacuucaacgagaugguccugcugaccaugaaggagaaguccuggcucgugcacaagcagugguuccuggaccugccccuccccuggaccagcggggccagcaccucccaggagacguggaaccggcaggaccugcuggugaccuucaagaccgcccacgcgaagaagcaggaggucguggugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgucaugugcaccggguccuucaagcucgagaaggagguggcggagacgcagcacggcaccgugcugguccagaucaaguacgagggcaccgacgcccccugcaagauccccuucagcacccaggacgagaagggggugacgcagaacggccggcugaucaccgccaacccgaucgugaccgacaaggagaagcccgucaacaucgaggccgagccgcccuucggggaguccuacaucgugaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcgucgggaagcuggugcaccagaucuucggcaccgccuacggggugcuguucuccggcgucagcuggaccaugaagaucgggaucggcgugcugcugacguggcucggccugaacucccgcagcaccucccugagcaugaccugcaucgccguggggcucgucacccuguaccugggcgugauggugcaggccgacuccgggugcgucaucaacuggaagggccgggagcucaagugcgggagcggcaucuucgugacgaacgaggugcacaccuggaccgagcaguacaaguuccaggcggacagcccgaagcgccuguccgccgccaucggcaaggccugggaggagggggucugcggcauccggagcgccacccgccuggagaacaucauguggaagcagaucuccaacgagcucaaccacauccugcuggagaacgacaugaagcucaccgugguggucggggacguggcgggcauccuggggcagggcaagaagaugauccggccccagcccauggaguacaaguacagcuggaaguccuggggcaaggccaagaucaucggggccgacgcccagaacacgaccuucaucaucgacggccccaacaccccggagugccccgacgaccagcgcgcguggaacaucugggagguggaggacuacggguucggcaucuucaccacgaacaucuggcugaagcuccgggacagcuacacccaggucugcgaccaccgccugauguccgccgccaucaaggacagcaaggccgugcacgccgacaugggcuacuggaucgaguccgagaagaacgagaccuggaagcuggcgcgggccagcuucaucgaggugaagaccugcaucuggcccaagucccacacgcucuggagcaacgggguccuggaguccgagaugaucauccccaagaucuacggcgggccgaucagccagcacaacuaccgccccggcuacuucacccagaccgccgggcccuggcaccugggcaagcucgagcuggacuucgaccugugcgagggcaccacggugguggucgacgagcacugcgggaaccggggcccgucccuccgcaccaccaccgugacggggaagaucauccacgaguggugcugccggagcugcacccugccgccccugcgcuuccggggcgaggacgggugcugguacggcauggagauccgccccgugaaggagaaggaggagaaccucgucaaguccauggugagcgccggcagcggggagguggacuccuucagccugggccugcucugcaucuccaucaugaucgaggaggucaugcggagccgcuggucccggaagaugcugaugaccgggacccuggccguguucuuccuccugaucaugggccagcugacguggaacgaccucauccgccugugcaucauggugggggcgaacgccagcgaccgcaugggcaucggcaccaccuaccuggcccucauggccaccuucaagaugcggccgauguucgccgucgggcugcuguuccgccggcucacgucccgcgaggugcugcugcucaccaucggccugagccugguggcguccgucgagcuccccaacagccuggaggagcugggggacggccucgccaugggcaucaugaugcugaagcugcucaccgacuuccagucccaccagcugugggccacccugcucagccugacguucaucaagaccaccuucucccugcacuacgccuggaagaccauggcgauggugcucagcaucgucucccuguucccccugugccucagcacgaccucccagaagaccaccuggcugcccgugcugcucgggagccugggcugcaagccgcugacgauguuccucaucgccgagaacaagaucugggggcggaaguccuggccccugaacgagggcaucauggccguggggaucgucagcauccugcucagcucccugcugaagaacgacgugccccucgccggcccccugaucgccggcgggaugcugaucgcgugcuacgugaucagcggcuccagcgccgaccucucccuggagaaggccgccgaggucagcugggaggaggaggccgagcacuccggggcgagccacaacauccugguggaggugcaggacgacggcaccaugaagaucaaggacgaggagcgcgacgacacccucaccauccugcugaaggccacccuccuggccgucuccgggguguacccgcugagcauccccgccacccucuucgugugguacuucuggcagaagaagaagcagcgguccggcguccugugggacacccccagcccgcccgagguggagcgcgccgugcuggacgacggcaucuaccggaucaugcagcgcgggcugcucggccggucccaggucggggugggcguguuccaggagaacgucuuccacaccauguggcacgugacccgcggggcggugcugauguaccagggcaagcggcuggagcccagcugggccuccgucaagaaggaccucaucagcuacggcgggggcuggcgccugcggggguccuggaacacgggcgaggagguccaggugaucgccgucgagcccgggaagaaccccaagaacgugcagaccgcccccggcaccuucaagacccccgagggcgaggugggggccaucgcgcuggacuucaagcccggcacgagcgggucccccaucgucaaccgcgagggcaagaucgugggccucuacgggaacggcguggucaccaccagcgggaccuacgugagcgccaucgcccaggccaaggcgucccaggagggcccgcugcccgagaucgaggacgagguguuccggaagcgcaaccugacgaucauggaccuccaccccgggagcggcaagacccggcgcuaccugccggccaucguccgggaggccaucaagcgcaagcugcgcacccucauccuggcccccacccgggugguggccuccgagauggcggaggcccugaagggcaugcccauccgcuaccagacgaccgccgucaagagcgagcacaccgggaaggagaucguggaccucaugugccacgccaccuucacgaugcggcugcugucccccgugcgcgucccgaacuacaacaugaucaucauggacgaggcccacuucaccgaccccagcuccaucgcggcccggggcuacaucagcacccgcguggggaugggcgaggccgccgccaucuucaugaccgcgacgccgcccggguccguggaggccuucccgcagagcaacgccgucauccaggacgaggagcgggacauccccgagcgcuccuggaacagcggcuacgaguggaucaccgacuuccccggcaagaccgugugguucgugcccuccaucaagagcgggaacgacaucgccaacugccuccggaagaacggcaagcgcgucauccagcugucccggaagaccuucgacacggaguaccagaagaccaagaacaacgacugggacuacguggugaccaccgacaucagcgagaugggggcgaacuuccgcgccgaccgggucaucgacccgcgccggugccugaagcccgugauccucaaggacggccccgagcgcgugauccuggccgggcccaugccggucacgguggccuccgccgcgcagcggcgcggccggaucggccgcaaccacaacaaggagggggaccaguacaucuacaugggccagccccugaacaacgacgaggaccacgcccacuggaccgaggccaagaugcuccuggacaacaucaacacccccgaggggaucauccccgcccuguucgagccggagcgcgagaaguccgccgcggucgacggcgaguaccggcuccgcggggaggcccggaagaccuucguggagcugaugcgccggggcgaccugcccguguggcucuccuacaaggucgccagcgagggcuuccaguacagcgaccgccgguggugcuucgacggggagcgcaacaaccaggugcuggaggagaacauggacguggagaucuggacgaaggagggcgaggggaagaagcugcggccccgcuggcucgacgcccggaccuacuccgacccccuggcccugcgcgaguucaaggaguucgcggccggccggcgcagcgucuccggcgaccucauccuggagaucgggaagcugccgcagcaccucacccagcgggcccagaacgcccuggacaaccuggugaugcuccacaacagcgagcagggcgggcgcgcguaccggcacgccauggaggagcugcccgacaccaucgagacgcugaugcuccuggcccugaucgccgugcucaccggcggggucacccuguucuuccuguccggccgcggccucgggaagaccagcaucggccugcugugcgugauggccuccagcgugcuccuguggauggcguccgucgagccccacuggaucgccgccagcaucauccuggaguucuuccucauggugcugcugauccccgagccggaccggcagcgcacgccccaggacaaccagcucgccuacguggucaucgggcugcuguucaugauccucacgguggccgcgaacgagaugggccugcuggagaccaccaagaaggaccucgggaucggccacguggccgucgagaaccaccaccacgccgccaugcuggacguggaccugcaccccgccuccgcguggacccucuacgccguggccacgaccaucaucaccccgaugaugcggcacaccaucgagaacacgaccgccaacaucagccugaccgccaucgcgaaccaggccgccauccugaugggccucgacaagggguggcccaucuccaagauggacaucggcgucccccugcuggcccucgggugcuacagccaggugaacccccugacccugacggcggccgugcucaugcuggucgcccacuacgccaucaucggcccggggcugcaggccaaggcgacccgcgaggcccagaagcgcaccgccgccggcaucaugaagaaccccaccguggacggcaucguggccaucgaccucgaccccgucguguacgacgcgaaguucgagaagcagcuggggcagaucaugcugcucauccugugcacgucccagauccugcucaugcggaccaccugggcccugugcgagagcaucacccuggccacgggcccccucaccacccugugggagggguccccgggcaaguucuggaacaccacgaucgccgugagcauggccaacaucuuccgcggcuccuaccuggcgggggccggccucgccuucagccugaugaagucccucgggggcgggcggcgcggcaccggcgcccagggggagacccucggcgagaaguggaagcggcagcugaaccagcuguccaagagcgaguucaacaccuacaagcgcuccgggaucauggaggucgaccggagcgaggcgaaggagggccucaagcgcggggagacgaccaagcacgccgugucccggggcaccgccaagcugcgcugguucguggagcggaaccuggucaagcccgagggcaaggugaucgaccuggggugcggccgcgggggcuggagcuacuacugcgccgggcucaagaaggugaccgaggucaagggcuacacgaagggcgggcccggccacgaggagcccaucccgauggccaccuacggguggaaccuggugaagcugcacuccggcaaggacguguucuucaucccgcccgagaagugcgacacccuccugugcgacaucggggagagcucccccaacccgaccaucgaggagggccggacgcugcgcguccucaagaugguggagcccuggcugcggggcaaccaguucugcaucaagauccugaaccccuacaugcccagcguggucgagacccucgagcagaugcagcgcaagcacgggggcaugcuggugcggaacccgcugucccgcaacagcacccacgagauguacuggguguccugcgggaccggcaacaucgucagcgcggugaacaugaccucccggaugcuccugaaccgcuucacgauggcccaccgcaagcccaccuacgagcgggacguggaccugggcaccgggacccgccacgucgccguggagcccgagguggccaaccucgacaucaucggccagcggaucgagaacaucaagcacgagcacaagagcacguggcacuacgacgaggacaaccccuacaagaccugggccuaccacggguccuacgaggucaagccgagcggcuccgcgagcagcauggugaacggggucgugaagcugcugaccaagcccugggacgugauccccaugucccccaucgccaugaccgacacgaccccgcucgcccagcgcgucuucaaggagaagguggacacccggacccccaaggccaagcgcggcacggcccagaucauggaggugaccgcgcgguggcuguggggcuuccugagccgcaacaagaagccccggaucugcacccgcgaggaguucacccggaagguccgcuccaacgccgccaucggggccguguucguggacgagaaccaguggaacagcgcgaaggaggccgucgaggacgagcgguucugggaccucgugcaccgcgagcgggagcugcacaagcagggcaagugcgccacgugcguguacaacaugauggggaagcgcgagaagaagcugggcgaguucgggaaggccaagggcucccgggccaucugguacauguggcucggcgcgcgcuuccuggaguucgaggcccugggguucaugaacgaggaccacugguucagccgggagaacucccucagcggcgucgagggggagggccugcacaagcugggguacauccuccgcgacaucuccaagaucccgggcggcaacauguacgccgacgacaccgccgggugggacacccggaucaccgaggacgaccugcagaacgaggccaagaucacggacaucauggagcccgagcacgcgcugcucgccaaggccaucuucaagcugaccuaccagaacaagguggugcgcguccagcgccccgccaagaacggcaccgugauggacgugaucagccggcgcgaccagcggggguccggccaggucggcaccuacgggcugaacacguucaccaacauggaggcccagcucauccgccagauggagagcgaggagaucuucucccccagcgagcuggagaccccgaaccuggcggagcgggcccucgacuggcuggagaaguacggcguggagcgccugaagcggauggccaucuccggggacgacugcguggucaagcccaucgacgaccgcuucgccaccgcccucacggcgcugaacgacaugggcaaggugcggaaggacaucccccagugggagcccagcaagggguggaacgacuggcagcaggucccguucugcucccaccacuuccaccagcugaucaugaaggacggccgcgagaucgucgugcccugccggaaccaggacgagcucgugggccgcgcccgggucagccagggggccggcuggagccugcgcgagaccgccugccuggggaaguccuacgcgcagauguggcagcucauguacuuccaccggcgcgaccugcggcuggccgccaacgccaucugcagcgccgugcccguggacuggguccccaccucccgcaccacguggagcauccacgcgcaccaccaguggaugaccaccgaggacaugcucuccguguggaaccggguguggaucgaggagaacccguggauggaggacaagacccacaucagcuccugggaggacguccccuaccugggcaagcgcgaggaccaguggugcgggagccugaucggccucacggcccgcgccaccugggccaccaacauccagguggccaucaaccaggugcggcgccugaucggcaacgagaacuaccuggacuacaugaccuccaugaagcgguucaagaacgagagcgaccccgagggggcgcucugguga

SEQ ID NO: 8505 - RNA, 9879 nt, Artificial Sequence
  derived and/or modified CDS sequence (opt1) from DENV-1__GQ199797__SS-prME
agcgugaccaugcugcucaugcugaugcccaccgcccuggccuuccaccucacgacccggggcggggagccccacaugaucgugagcaagcaggagcggggcaagagccugcuguucaagaccagcgcgggggugaacaugugcacccucaucgccauggaccugggcgaguucugcgaggacacgaugaccuacaagugcccccgcaucaccgaggccgagcccgacgacguggacugcuggugcaacgccaccgacacgugggugaccuacgggaccugcagccagaccggcgagcaccggcgggacaagcgguccguggcccuggcgccccacgugggccucgggcuggagacgcgcaccgagaccuggaugagcuccgagggcgccuggaagcagauccagcggguggagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugcccgacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaagaccguccaguacgagaaccugaaguacagcgugaucgugaccguccacacgggcgaccagcaccagguggggaacgaguccaccgagcacggcaccaccgcgaccaucacgccccaggcccccagcaccgagauccagcugaccgacuacggggcccucacccuggacugcagcccccggacgggccuggacuucaacgagaugguccuccugaccaugaaggagaaguccuggcuggugcacaagcagugguuccucgaccugccgcugcccuggaccagcggggccuccaccagccaggagacguggaaccggaaggaccuccuggugaccuucaagaccgcccacgcgaagaagcaggaggucguggugcugggcucccaggagggcgccaugcacaccgcccucacgggggccaccgagauccagaccagcggcaccacgaccaucuucgccgggcaccugaagugccgccugaagauggacaagcucacccugaagggcauguccuacgucaugugcaccgggagcuucaagcuggagaaggagguggcggagacgcagcacggcaccgugcucguccagaucaaguacgagggcaccgacgcccccugcaagauccccuucuccacccaggacgagaagggggugacgcagaacggccggcugaucaccgccaacccgaucgugaccgacaaggagaagcccgucaacaucgaggccgagccgcccuucggggagagcuacaucgugaucggcgcgggcgagaaggcccugaagcuguccugguucaagaaggggagcuccaucggcaagauguucgaggccaccgcccgcggggcccggcgcauggcgauccucggcgacacggccugggacuucgggagcaucggcggcguguucaccuccgucgggaagcuggugcaccagaucuucggcaccgccuacggggugcuguucagcggcgucuccuggaccaugaagaucgggaucggcgugcuccugacguggcugggccucaacagccgcuccaccagccuguccaugaccugcaucgccguggggcuggucacccucuaccugggcgugauggugcaggccgacagcgggugcgucaucaacuggaagggccgggagcugaagugcgggagcggcaucuucgugacgaacgaggugcacaccuggaccgagcaguacaaguuccaggcggacuccccgaagcgccucagcgccgccaucggcaaggccugggaggagggggucugcggcauccgguccgccacccgccuggagaacaucauguggaagcagaucagcaacgagcugaaccacauccuccuggagaacgacaugaaguucaccgugguggucggggacguggcgggcauccuggcccaggggaagaagaugauccggccccagcccauggaguacaaguacuccuggaaguccuggggcaaggccaagaucaucggcgccgacgugcagaacacgaccuucaucaucgacgggcccaacaccccggagugccccgacgaccagcgcgcguggaacaucugggaggucgaggacuacggcuucgggaucuucaccacgaacaucuggcucaagcugcgggacuccuacacccaggugugcgaccaccgccugaugagcgccgccaucaaggacuccaaggccgugcacgccgacaugggcuacuggaucgagagcgagaagaacgagaccuggaagcucgcgcgggccuccuucaucgaggucaagaccugcaucuggcccaagagccacacgcugugguccaacggcgugcuggagagcgagaugaucauccccaagaucuacgggggcccgaucucccagcacaacuaccgccccggguacuucacccagaccgccggccccuggcaccucgggaagcuggagcuggacuucgaccucugcgagggcaccacgguggucguggacgagcacugcggcaaccgggggccgagccugcgcaccaccaccgugacgggcaagaucauccacgaguggugcugccgguccugcacccugccgccccugcgcuucaagggggaggacggcugcugguacgggauggagauccggcccgucaaggagaaggaggagaaccuggucaagagcauggugagcgccggcuccggcgaggucgacagcuucucccuggggcuccugugcaucagcaucaugaucgaggaggugaugcgcucccgguggagccgcaagaugcugaugaccggcacccucgccguguucuuccugcugaucauggggcagcucacguggaacgaccugauccggcugugcaucauggucggcgcgaacgccuccgaccgcauggggaugggcaccaccuaccucgcccugauggccaccuucaagaugcgcccgauguucgccgugggccuccuguuccggcgccugacgagccgggaggugcugcuccugaccaucgggcugucccucgucgcgagcguggagcugcccaacucccuggaggagcucggcgacgggcuggccaugggcaucaugauccugaagcuccugaccgacuuccagagccaccagcugugggccacccuccugucccugacguucaucaagaccaccuucagccuccacuacgccuggaagaccauggcgaugguccuguccaucgugagccuguucccccucugccuguccacgaccagccagaagaccaccuggcugcccgugcuccugggcucccuggggugcaagccgcucacgauguuccugaucgccgagaacaagaucuggggccgcaagagcuggccccugaacgaggggaucauggccgucggcaucgugagcauccuccuguccagccugcucaagaacgacgugccccuggccgggccccugaucgccggcggcaugcucaucgcgugcuacgucaucuccgggagcuccgccgaccugagccuggagaaggccgccgagguguccugggaggaggaggccgagcacagcggcgcgucccacaacauccucguggagguccaggacgacgggaccaugaagaucaaggacgaggagcgggacgacacccugaccauccugcucaaggccacccugcuggccgugagcggcguguacccgcucuccauccccgccacgcuguucgucugguacuucuggcagaagaagaagcagcgcagcggggugcugugggacacccccagcccgcccgagguggagcgggccguccucgacgacggcaucuaccgcaucaugcagcggggccugcuggggcgcagccaggugggcgugggggucuuccaggagaacguguuccacaccauguggcacgugacccggggcgcgguccugauguaccaggggaagcgccucgagcccuccugggccagcgugaagaaggaccugaucuccuacggcggcggguggcggcugcagggcagcuggaacacgggggaggaggugcaggucaucgccguggagcccggcaagaaccccaagaacgugcagaccgcccccgggaccuucaagaccuccgagggcgaggucggcgccaucgcgcucgacuucaagcccgggacgagcggcagccccaucgugaaccgcgaggggaagaucgugggccuguacggcaacggggucgugaccaccuccggcaccuacgugagcgccaucgcccaggccaaggcgucccaggaggggccccugccggagaucgaggacgaggucuuccggaagcgcaaccucacgaucauggaccugcaccccggcagcgggaagacccggcgcuaccugcccgccaucgugcgggaggccaucaagcgcaagcuccggacccugauccuggccccgacccgcguggucgccuccgagauggcggaggcccucaagggcaugcccauccgcuaccagacgaccgccgucaagagcgagcacaccggcaaggagaucguggaccugaugugccacgccaccuucacgaugcggcugcucucccccguccgcgugcccaacuacaacaugaucaucauggacgaggcccacuucaccgacccgagcuccaucgcggcccggggguacaucagcacccgcgugggcaugggggaggccgccgccaucuucaugaccgcgacgccgcccggcuccgucgaggccuucccccagagcaacgccgugauccaggacgaggagcgggacaucccggagcgcuccuggaacagcggguacgaguggaucaccgacuuccccggcaagaccgugugguucguccccuccaucaagagcggcaacgacaucgccaacugccugcggaagaacgggaagcgcgugauccagcugucccggaagaccuucgacacggaguaccagaagaccaagaacaacgacugggacuacguggucaccaccgacaucagcgagaugggcgcgaacuuccgcgccgaccgggugaucgacccccgccggugccucaagccggugauccugaaggacgggcccgagcgcgucauccuggccggccccaugcccgugacggucgccuccgccgcgcagcggcgcgggcggaucggccgcaaccacaacaaggagggcgaccaguacaucuacauggggcagccgcucaacaacgacgaggaccacgcccacuggaccgaggccaagaugcugcuggacaacaucaacacccccgagggcaucauccccgcccucuucgagcccgagcgggagaaguccgccgcgaucgacggggaguaccgccugcgcggcgaggcccggaagaccuucguggagcugaugcgccgcggggaccucccgguguggcugagcuacaaggucgccuccgagggcuuccaguacagcgaccgccgguggugcuucgacggcgagcgcaacaaccaggugcuggaggagaacauggacguggagaucuggacgaaggagggggagcggaagaagcuccgcccccgguggcuggacgcccgcaccuacuccgacccccuggcccuccgggaguucaaggaguucgcggccggccgccggagcgucuccggggaccugauccuggagaucggcaagcucccccagcaccugacccagcgcgcccagaacgcccuggacaaccucgugaugcugcacaacagcgagcagggcgggcgggcguaccgccacgccauggaggagcugccggacaccaucgagacgaugaugcuccuggcccugaucgccgugcucaccggcggggucacccuguucuuccuguccggccgggggcucggcaagaccagcaucggccugcugugcgugauggccuccagcgugcuccuguggauggcguccgucgagccccacuggaucgccgccagcaucauccuggaguucuuccucauggugcugcugauccccgagcccgaccgccagcggaccccgcaggacaaccagcucgccuacguggucaucgggcugcuguucaugauccucacgguggccgcgaacgagaugggccugcuggagaccaccaagaaggaccucgggaucggccacguggccgucgagaaccaccaccacgccgccaugcuggacguggaccugcaccccgccuccgcguggacccucuacgccguggccacgaccaucaucacccccaugaugcgccacaccaucgagaacacgaccgccaacaucagccugaccgccaucgcgaaccaggccgccauccugauggggcucgacaagggcuggccgaucuccaagauggacaucggcgucccccugcuggcccucgggugcuacagccaggugaacccccugacccugacggcggccgugcucaugcuggucgcccacuacgccaucaucggccccgggcugcaggccaaggcgacccgggaggcccagaagcgcaccgccgccggcaucaugaagaacccgaccguggacgggaucguggccaucgaccucgaccccgucguguacgacgcgaaguucgagaagcagcugggccagaucaugcugcucauccugugcacgucccagauccugcucaugcgcaccaccugggcccugugcgagagcaucacccuggccacgggcccccucaccacccugugggaggggucccccggcaaguucuggaacaccacgaucgccgugagcauggccaacaucuuccgggggagcuaccuggcgggcgccggccucgccuucucccugaugaagucccucgggggcgggcgccgggggaccggggcccagggcgagacccucggcgagaaguggaagcgccagcugaaccagcuguccaagagcgaguucaacaccuacaagcgguccgggaucauggaggucgaccgcagcgaggcgaaggagggccucaagcgcggggagacgaccaagcacgccgugucccgcggcaccgccaagcugcggugguucguggagcgcaaccuggucaagccggaggggaaggugaucgaccucggcugcggccgcggcggguggagcuacuacugcgccgggcugaagaaggugaccgaggucaagggguacacgaagggcggccccggccacgaggagcccauccccauggccaccuacggguggaaccuggugaagcugcacuccggcaaggacguguucuucaucccgcccgagaagugcgacacccuccugugcgacaucggggagagcucccccaaccccaccaucgaggagggccgcacgcugcggguccucaagaugguggagccguggcugcgcgggaaccaguucugcaucaagauccugaaccccuacaugcccagcguggucgagacccucgagcagaugcagcggaagcacggcggcaugcuggugcgcaacccccugucccggaacagcacccacgagauguacuggguguccugcgggaccggcaacaucgucagcgcggugaacaugaccucccgcaugcuccugaaccgguucacgauggcccaccgcaagccgaccuacgagcgcgacguggaccugggggccggcacccggcacgucgccguggagcccgagguggccaaccucgacaucaucggccagcgcaucgagaacaucaagcacgagcacaagagcaccuggcacuacgacgaggacaaccccuacaagacgugggcguaccacggguccuacgaggucaagcccagcggcagcgccuccagcauggugaacggggucgugaagcugcugaccaagccgugggacgugauccccauggucacccagaucgccaugaccgacacgacccccuucggccagcagcggguguucaaggagaagguggacacccgcacccccaaggccaagcgggggacggcccagaucauggaggucaccgcgaaguggcucuggggcuuccugucccgcaacaagaagccgcggaucugcacccgcgaggaguucacccggaaggugcgcagcaacgccgccaucggcgccguguucgucgacgagaaccaguggaacuccgcgaaggaggccguggaggacgagcgguucugggaccuggugcaccgcgagcgggagcuccacaagcaggggaagugcgccacgugcgucuacaacaugaugggcaagcgcgagaagaagcugggggaguucggcaaggccaaggggagccgggccaucugguacauguggcugggcgcgcgcuuccucgaguucgaggcccugggcuucaugaacgaggaccacugguucucccgggagaacagccuguccgggguggagggcgaggggcuccacaagcugggcuacauccugcgcgacaucagcaagauccccgggggcaacauguacgccgacgacaccgccggcugggacacccggaucaccgaggacgaccuccagaacgaggccaagaucacggacaucauggagcccgagcacgcgcugcuggccaaguccaucuucaagcucaccuaccagaacaaggugguccgcgugcagcggccggccaagaacgggaccgugauggacgucaucagccgccgcgaccagcggggcuccggccaggugggcaccuacggccugaacacguucaccaacauggaggcccagcugauccgccagauggagagcgaggggaucuucucccccagcgagcucgagacccccaaccuggcccggcgcgugcuggacuggcucgagaagcacggcgucgagcggcugaagcgcauggcgaucuccggggacgacugcguggugaagcccaucgacgaccgguucgccaccgcccugacggcccucaacgacaugggcaagguccgcaaggacaucccgcagugggagcccagcaagggguggaacgacuggcagcagguccccuucugcagccaccacuuccaccagcugaucaugaaggacggccgggagaucgugguccccugccgcaaccaggacgagcuggugggccgggcccgcgugucccagggggcgggcuggagccuccgggagaccgccugccuggggaaguccuacgcccagauguggcagcugauguacuuccaccgccgggaccuccgccuggccgcgaacgccaucugcagcgccgucccgguggacugggugcccaccucccggaccacguggagcauccacgcccaccaccaguggaugaccaccgaggacaugcuguccgucuggaaccgcguguggaucgaggagaaccccuggauggaggacaagacccacaucagcuccuggggcgacgugcccuaccucgggaagcgggaggaccaguggugcggcagccugaucggccugacggcccgcgcgaccugggccaccaacauccaggucgccaucaaccaggugcgccggcucaucgggaacgagaacuaccuggacuacaugaccuccaugaagcgcuucaagaacgagagcgacccggagggcgcccugugguga

SEQ ID NO: 8506 - RNA, 9879 nt, Artificial Sequence
  derived and/or modified CDS sequence (opt1) from DENV-1__GQ199799__SS-prME
agcgugaccaugcugcugaugcugaugcccaccgcccuggccuuccaccucaccacccggggcggggagccccacaugaucgugagcaagcaggagcggggcaagagccugcuguucaagaccuccgccggggugaacaugugcacccucaucgccauggaccugggcgaguucugcgaggacaccaugaccuacaagugcccccgcaucaccgaggccgagcccgacgacguggacugcuggugcaacgccaccgacacgugggugaccuacgggaccugcagccagaccggcgagcaccggcgggacaagcgguccguggcccuggcgccccacgugggccucgggcuggagacgcgcaccgagaccuggaugagcuccgagggcgccuggaagcagauccagcgggucgagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugccccacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaagaucguccaguacgagaaccugaaguacagcgugaucgugaccguccacaccggcgaccagcaccagguggggaacgaguccacggagcacggcaccaccgcgaccaucacgccccaggcccccagcacggagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccagcggggccuccaccagccaggagaccuggaaccggcaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcauguccuacgucaugugcaccgggagcuucaagcuggagaaggagguggcggagacccagcacggcacggugcucguccagaucaaguacgagggcaccgacgcccccugcaagauccccuucuccacccaggacgagaagggggugacccagaacggccggcugaucacggccaaccccaucgugaccgacaaggagaagcccgucaacaucgaggccgagccgcccuucggggagagcuacaucgugaucggcgcgggcgagaaggcccugaagcuguccugguucaagaaggggagcuccaucggcaagauguucgaggccaccgcccgcggggcccggcgcauggcgauccucggcgacaccgccugggacuucgggagcaucggcggcguguucacguccgucgggaagcuggugcaccagaucuucggcaccgccuacggggugcuguucagcggcgucuccuggaccaugaagaucgggaucggcgugcuccugaccuggcugggccucaacagccgcuccacgagccuguccaugaccugcaucgccguggggcuggucacccucuaccugggcgugauggugcaggccgacagcgggugcgucaucaacuggaagggccgggagcugaagugcgggagcggcaucuucgugaccaacgaggugcacacguggaccgagcaguacaaguuccaggcggacuccccgaagcgccucagcgccgccaucggcaaggccugggaggagggggucugcggcauccgguccgccacccgccuggagaacaucauguggaagcagaucagcaacgagcugaaccacauccuccuggagaacgacaugaagcugaccgugguggucggggacguggcgggcauccucgcccaggggaagaagaugauccggccccagcccauggaguacaaguacuccuggaaguccuggggcaaggccaagaucaucggcgccgacgugcagaacaccacguucaucaucgacgggcccaacaccccggagugccccgacgaccagcgcgcguggaacaucugggaggucgaggacuacggcuucgggaucuucaccaccaacaucuggcugaagcugcgggacuccuacacccaggugugcgaccaccgccucaugagcgccgccaucaaggacuccaaggccgugcacgccgacaugggcuacuggaucgagagcgagaagaacgagaccuggaagcuggcgcgggccuccuucaucgaggucaagaccugcaucuggcccaagagccacacccugugguccaacggcgugcucgagagcgagaugaucauccccaagaucuacgggggcccgaucucccagcacaacuaccgccccggguacuucacgcagaccgccggccccuggcaccuggggaagcuggagcucgacuucgaccugugcgagggcaccaccguggucguggacgagcacugcggcaaccgggggccgagccugcgcacgaccaccgugaccggcaagaucauccacgaguggugcugccgguccugcacgcugccgccccuccgcuucaagggggaggacggcugcugguacgggauggagauccggcccgucaaggagaaggaggagaaccuggucaagagcauggugagcgccggcuccggcgaggucgacagcuucucccucgggcugcugugcaucagcaucaugaucgaggaggugaugcgcucccgguggagccgcaagaugcucaugaccggcacccuggccguguucuuccugcucaucauggggcagcugaccuggaacgaccugauccggcucugcaucauggucggcgcgaacgccuccgaccgcauggggaugggcacgaccuaccuggcccugauggccaccuucaagaugcgcccgauguucgccgugggccuccuguuccggcgccugaccagccgggaggugcuccugcugacgaucgggcucucccuggucgcgagcguggagcugcccaacucccucgaggagcugggcgacgggcuggccaugggcaucaugauccucaagcugcugaccgacuuccagccccaccagcucugggccacccugcugagccucaccuucauccgcacgaccuucucccugcacuacgccuggaagaccauggcgaugguccugagcaucgugucccucuucccccugugccugagcaccacgucccagaagaccaccuggcucccggugcugcugggcagccucgggugcaagccccugaccauguuccugaucgccgagaacaagaucuggggccggaaguccuggccccucaacgaggggaucauggccgucggcaucgugagcauccugcugagcucccuccugaagaacgacgugccccuggccgggccgcucaucgccggcggcaugcugaucgcgugcuacgucaucagcggguccagcgccgaccugucccucgagaaggccgccgaggugagcugggaggaggaggccgagcacuccggcgcgagccacaacauccugguggagguccaggacgacgggacgaugaagaucaaggacgaggagcgcgacgacacccugaccauccuccugaaggccacccugcucgccguguccggcguguacccccugagcauccccgccacccuguucgucugguacuucuggcagaagaagaagcagcgguccggggugcucugggacacgcccagcccgcccgagguggagcgcgccguccuggacgacggcaucuaccggaucaugcagcgcggccugcuggggcggucccaggugggcgugggggucuuccaggagaacguguuccacaccauguggcacgugacccgcggcgcgguccucauguaccaggggaagcggcuggagcccagcugggccuccgugaagaaggaccugaucagcuacggcggcggguggcgccuccagggcuccuggaacaccggggaggaggugcaggucaucgccguggagcccggcaagaacccgaagaacgugcagacggcccccgggaccuucaagaccagcgagggcgaggucggcgccaucgcgcuggacuucaagcccgggaccuccggcagccccaucgugaaccgggaggggaagaucgugggccuguacggcaacggggucgugacgaccagcggcaccuacguguccgccaucgcccaggccaaggcgagccaggaggggccgcuccccgagaucgaggacgaggucuuccgcaagcggaaccugaccaucauggaccugcaccccggcuccgggaagacgcgccgguaccucccggccaucgugcgcgaggccaucaagcggcgccugcgcacccugauccucgcccccacccggguggucgccagcgagauggcggaggcccugaagggcaugcccauccgcuaccagaccacggccgugaaguccgagcacaccggcaaggagaucguggaccugaugugccacgccaccuucaccaugcggcuccugagccccguccgcgugccgaacuacaacaugaucaucauggacgaggcccacuucacggaccccuccagcaucgcggcccggggguacaucuccacccgcgugggcaugggggaggccgccgccaucuucaugaccgcgacgccgcccggcagcgucgaggccuucccgcaguccaacgccgugauccaggacgaggagcgggacauccccgagcgcagcuggaacuccggguacgaguggaucacggacuuccccggcaagaccgugugguucguccccagcaucaaguccggcaacgacaucgccaacugccugcggaagaacgggaagcgcgugauccagcucagccggaagaccuucgacaccgaguaccagaagacgaagaacaacgacugggacuacguggucaccaccgacaucuccgagaugggcgcgaacuuccgcgccgaccgggugaucgacccgcgccggugccugaagcccgugauccugaaggacgggcccgagcgcgucauccucgccggccccaugccggugaccgucgccagcgccgcgcagcggcgcgggcggaucggccgcaaccacaacaaggagggcgaccaguacaucuacauggggcagccccugaacaacgacgaggaccacgcccacuggacggaggccaagaugcugcucgacaacaucaacacccccgagggcaucauccccgcccuguucgagccggagcgcgagaaguccgccgcgaucgacggggaguaccggcugcgcggcgaggcccggaagaccuucguggagcucaugcgccgcggggaccugcccguguggcugagcuacaaggucgccagcgagggcuuccaguacuccgaccgccgguggugcuucgacggcgagcgcaacaaccaggugcucgaggagaacauggacguggagaucuggaccaaggagggggagcggaagaagcugcgcccccgguggcuggacgcccgcacguacagcgacccccucgcccugcgggaguucaaggaguucgcggccggccgccgguccgucagcggggaccugauccucgagaucggcaagcugccgcagcaccugacccagcgcgcccagaacgcccucgacaaccuggugaugcugcacaacuccgagcagggcgggcgggcguaccgccacgccauggaggagcuccccgacaccaucgagacccugaugcugcucgcccugaucgccgugcugacgggcggggucacccucuucuuccugagcggccgggggcugggcaagaccuccaucggccuccugugcgugauggccagcuccgugcugcucuggauggcgagcgucgagccccacuggaucgccgccuccaucauccuggaguucuuccugauggugcuccugauccccgagccggaccgccagcggacgccccaggacaaccagcuggccuacguggucaucgggcuccuguucaugauccugaccguggccgcgaacgagaugggccuccuggagacgaccaagaaggaccuggggaucggccacguggccgucgagaaccaccaccacgccgccaugcucgacguggaccugcaccccgccagcgcguggacccuguacgccguggccaccacgaucaucaccccgaugaugcgccacaccaucgagaacaccacggccaacaucucccucaccgccaucgcgaaccaggccgccauccugauggggcuggacaagggcuggcccaucagcaagauggacaucggcgucccccuccuggcccuggggugcuacucccaggugaacccccucacccugaccgcggccgugcugaugcucgucgcccacuacgccaucaucggcccggggcugcaggccaaggcgacgcgcgaggcccagaagcggaccgccgccggcaucaugaagaaccccaccguggacgggaucguggccaucgaccuggaccccgucguguacgacgcgaaguucgagaagcagcucggccagaucaugcugcugauccucugcaccagccagauccugcugaugcgcacgaccugggcccucugcgaguccaucacccuggccaccggcccccugacgacccucugggaggggagcccgggcaaguucuggaacaccaccaucgccguguccauggccaacaucuuccgggggagcuaccuggcgggcgccggccuggccuucagccucaugaagucccucgggggcgggcgccgggggacgggggcccagggcgagacccugggcgagaaguggaagcgccagcucaaccagcugagcaaguccgaguucaacaccuacaagcggagcgggaucauggaggucgaccgcuccgaggcgaaggagggccugaagcgcggggagaccacgaagcacgccgugagccgcggcaccgccaagcuccggugguucguggagcgcaaccuggucaagcccgaggggaaggugaucgaccugggcugcggccgcggcgggugguccuacuacugcgccgggcugaagaaggugaccgaggucaagggguacaccaagggcgggcccggccacgaggagcccaucccgauggccacguacggguggaaccucgugaagcugcacagcggcaaggacguguucuucaucccgcccgagaagugcgacacccugcucugcgacaucggggaguccagccccaacccgaccaucgaggagggccgcacccugcggguccugaagaugguggagcccuggcuccgcgggaaccaguucugcaucaagauccugaaccccuacaugcccuccguggucgagacgcuggagcagaugcagcggaagcacggcggcaugcucgugcgcaacccgcugagccggaacuccacccacgagauguacugggugagcugcgggaccggcaacaucgucuccgcggugaacaugaccagccgcaugcugcucaaccgcuucaccauggcccaccggaagcccacguacgagcgcgacguggaccugggggccggcacccggcacgucgccguggagcccgagguggccaaccuggacaucaucggccagcgcaucgagaacaucaagcacgagcacaaguccaccuggcacuacgacgaggacaaccccuacaagaccugggcguaccacgggagcuacgaggucaagccguccggcagcgccagcuccauggugaacggggucgugaagcuccugacgaagcccugggacgugauccccauggucacccagaucgccaugaccgacaccacgcccuucggccagcagcggguguucaaggagaagguggacacccgcaccccgaaggccaagcgggggaccgcccagaucauggaggucacggcgaaguggcuguggggcuuccucagccgcaacaagaagccccggaucugcacccgcgaggaguucacccggaaggugcgcuccaacgccgccaucggcgccguguucgucgacgagaaccaguggaacagcgcgaaggaggccguggaggacgagcgguucugggaccuggugcaccgcgagcgggagcugcacaagcaggggaagugcgcgaccugcgucuacaacaugaugggcaagcgcgagaagaagcucggggaguucggcaaggccaaggggucccgggccaucugguacauguggcugggcgcgcgcuuccuggaguucgaggcccucggcuucaugaacgaggaccacugguucagccgggagaacucccugagcgggguggagggcgaggggcugcacaagcucggcuacauccugcgcgacaucuccaagauccccgggggcaacauguacgccgacgacacggccggcugggacacccggaucaccgaggacgaccugcagaacgaggccaagaucaccgacaucauggagccggagcacgcgcuccuggccaagagcaucuucaagcugacguaccagaacaaggugguccgcgugcagcgccccgccaagaacgggaccgugauggacgucaucucccggcgcgaccagcggggcagcggccaggugggcaccuacggccucaacaccuucacgaacauggaggcccagcugauccgccagauggaguccgaggggaucuucagccccuccgagcuggagacccccaaccucgccggccgggugcuggacuggcuggagaagcacggggucgagcgccucaagcggauggcgaucagcggcgacgacugcguggugaagccgaucgacgaccgcuucgccaccgcccugaccgcccugaacgacauggggaagguccggaaggacaucccccagugggagcccuccaagggcuggaacgacuggcagcagguccccuucugcagccaccacuuccaccagcucaucaugaaggacggccgcgagaucguggucccgugccggaaccaggacgagcugguggggcgcgcccgggugagccagggcgcgggguggucccugcgcgagacggccugccucggcaagagcuacgcccagauguggcagcugauguacuuccaccggcgcgaccugcggcucgccgcgaacgccaucugcuccgccguccccguggacugggugcccaccagccgcaccaccugguccauccacgcccaccaccaguggaugacgaccgaggacaugcugagcgucuggaaccggguguggaucgaggagaaccccuggauggaggacaagacccacguguccagcuggggcgacgucccguaccugggcaagcgcgaggaccaguggugcggcucccucaucgggcugaccgcccgcgcgacgugggccaccaacauccagguggccaucaaccaggugcggcgccugcucggcaacgagaacuaccuggacuacaugaccagcaugaagcgguucaagaacgaguccgaccccgagggggcccugugguga

SEQ ID NO: 8507 - RNA, 9879 nt, Artificial Sequence
  derived and/or modified CDS sequence (opt1) from DENV-1__GQ199800__SS-prME
agcgugaccaugcugcucaugcugaugcccaccgcccuggccuuccaccucacgacccggggcggggagccccacaugaucguguccaagcaggagcggggcaagagccugcuguucaagaccuccgccggggugaacaugugcacccucaucgccauggaccugggcgaguucugcgaggacaccaugaccuacaagugcccccgcaucaccgaggccgagcccgacgacguggacugcuggugcaacgccaccgacacgugggucaccuacgggaccugcagccagaccggcgagcaccggcgggacaagcgguccguggcccuggcgccccacgugggccucgggcuggagacgcgcaccgagaccuggaugagcuccgagggcgccuggaagcagauccagcgggucgagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugcccgacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaagaucguccaguacgagaaccugaaguacagcgugaucgugaccguccacaccggcgaccagcaccagguggggaacgaguccacggagcacggcaccaccgcgaccaucacgccccaggcccccagcacggagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccagcggggccuccaccagccaggagaccuggaaccggcaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcauguccuacgucaugugcaccgggagcuucaagcuggagaaggagguggcggagacccagcacggcacggugcucguccagaucaaguacgagggcaccgacgcccccugcaagauccccuuccugacccaggacgagaagggggugacccagaacggccggcugaucacggccaacccgaucgugaccgacaaggagaagcccgucaacaucgaggccgagccgcccuucggggaguccuacaucgugaucggcgcgggcgagaaggcccugaagcucagcugguucaagaagggguccagcaucggcaagauguucgaggccaccgcccgcggggcccggcgcauggcgauccugggcgacaccgccugggacuucggguccaucggcggcguguucacgagcgucgggaagcuggugcaccagaucuucggcaccgccuacggggugcuguucuccggcgucagcuggaccaugaagaucgggaucggcgugcugcugaccuggcucggccugaacucccgcagcacgucccugagcaugaccugcaucgccguggggcucgucacccuguaccugggcgugauggugcaggccgacuccgggugcgucaucaacuggaagggccgggagcucaagugcgggagcggcaucuucgugaccaacgaggugcacacguggaccgagcaguacaaguuccaggcggacagcccgaagcgccuguccgccgccaucggcaaggccugggaggagggggucugcggcauccggagcgccacccgccuggagaacaucauguggaagcagaucuccaacgagcucaaccacauccugcuggagaacgacaugaaguucaccgugguggucggggacguggcgggcauccucgcccaggggaagaagaugauccggccccagcccauggaguacaaguacagcuggaaguccuggggcaaggccaagaucaucggcgccgacgugcagaacaccacguucaucaucgacgggcccaacaccccggagugccccgacgaccagcgcgcguggaacaucugggaggucgaggacuacggcuucgggaucuucaccaccaacaucuggcugaagcugcgggacagcuacacccaggugugcgaccaccgccucauguccgccgccaucaaggacagcaaggccgugcacgccgacaugggcuacuggaucgaguccgagaagaacgagaccuggaagcuggcgcgggccagcuucaucgaggucaagaccugcaucuggcccaagucccacacccuguggagcaacggcgugcucgaguccgagaugaucauccccaagaucuacgggggcccgaucagccagcacaacuaccgccccggguacuucacgcagaccgccggccccuggcaccuggggaagcuggagcucgacuucgaccugugcgagggcaccaccguggucguggacgagcacugcggcaaccgggggccgucccugcgcacgaccaccgugaccggcaagaucauccacgaguggugcugccggagcugcacgcugccgccccuccgcuucaagggggaggacggcugcugguacgggauggagauccggcccgucaaggagaaggaggagaaccuggugaaguccauggugagcgccggcagcggcgaggucgacuccuucagccucgggcugcugugcaucuccaucaugaucgaggaggugaugcgcagccgguggucccgcaagaugcucaugaccggcacccuggccguguucuuccugcucaucauggggcagcugaccuggaacgaccugauccggcucugcaucauggucggcgcgaacgccagcgaccgcauggggaugggcacgaccuaccuggcccugauggccaccuucaagaugcgcccgauguucgccgugggccuccuguuccggcgccugaccucccgggaggugcuccugcugacgaucgggcucagccuggucgcguccguggagcugcccaacagccucgaggagcugggcgacgggcuggccaugggcaucaugauccucaagcugcugaccgacuuccagucccaccagcucugggccacccugcugagccucaccuucaucaagacgaccuucucccugcacuacgccuggaagaccauggcgaugguccugagcaucgugucccucuucccccugugccugagcaccacgucccagaagaccaccuggcuccccgugcugcugggcagccucgggugcaagccgcugaccauguuccugaucgccgagaacaagaucuggggccgcaaguccuggccccucaacgaggggaucauggccgucggcaucgugagcauccugcugagcucccuccugaagaacgacgugccccuggccgggccccucaucgccggcggcaugcugaucgcgugcuacgucaucagcggguccagcgccgaccugucccucgagaaggccgccgaggugagcugggaggaggaggccgagcacuccggcgcgagccacaacauccugguggagguccaggacgacgggacgaugaagaucaaggacgaggagcgggacgacacccugaccauccuccugaaggccacccugcucgccguguccggcguguacccgcugagcauccccgccacccuguucgucugguacuucuggcagaagaagaagcagcgcuccggggugcucugggacacgcccagcccgcccgagguggagcgggccguccuggacgacggcaucuaccgcaucaugcagcggggccugcuggggcgcucccaggugggcgugggggucuuccaggagaacguguuccacaccauguggcacgugacccggggcgcgguccucauguaccaggggaagcgccuggagcccagcugggccuccgugaagaaggaccugaucagcuacggcggcggguggcggcuccagggcuccuggaacaccggggaggaggugcaggucaucgccguggagcccggcaagaaccccaagaacgugcagacggcccccgggaccuucaagaccagcgagggcgaggucggcgccaucgcgcuggacuucaagcccgggaccuccggcagccccaucgugaaccgcgaggggaagaucgugggccuguacggcaacggggucgugacgaccagcggcaccuacguguccgccaucgcccaggccaaggcgagccaggaggggccccucccggagaucgaggacgaggucuuccggaagcgcaaccugaccaucauggaccugcaccccggcuccgggaagacgcggcgcuaccuccccgccaucgugcgggaggccaucaagcgcaagcugcggacccugauccucgccccgacccgcguggucgccagcgagauggcggaggcccugaagggcaugcccauccgcuaccagaccacggccgugaaguccgagcacaccggcaaggagaucguggaccugaugugccacgccaccuucaccaugcggcuccugagccccguccgcgugcccaacuacaacaugaucaucauggacgaggcccacuucacggacccguccagcaucgcggcccggggguacaucuccacccgcgugggcaugggggaggccgccgccaucuucaugaccgcgacgccgcccggcagcgucgaggccuucccccaguccaacgccgugauccaggacgaggagcgggacaucccggagcgcagcuggaacuccggguacgaguggaucacggacuuccccggcaagaccgugugguucguccccagcaucaaguccggcaacgacaucgccaacugccugcggaagaacgggaagcgcgugauccagcucagccggaagaccuucgacaccgaguaccagaagacgaagaacaacgacugggacuacguggucaccaccgacaucuccgagaugggcgcgaacuuccgcgccgaccgggugaucgacccccgccggugccugaagccggugauccugaaggacgggcccgagcgcgucauccucgccggccccaugcccgugaccgucgccagcgccgcgcagcggcgcgggcggaucggccgcaaccacaacaaggagggcgaccaguacaucuacauggggcagccgcugaacaacgacgaggaccacgcccacuggacggaggccaagaugcugcucgacaacaucaacacccccgagggcaucauccccgcccuguucgagcccgagcgggagaaguccgccgcgaucgacggggaguaccgccugcgcggcgaggcccggaagaccuucguggagcucaugcgccgcggggaccugccgguguggcugagcuacaaggucgccagcgagggcuuccaguacuccgaccgccgguggugcuucgacggcgagcgcaacaaccaggugcucgaggagaacauggacguggagaucuggaccaaggagggggagcggaagaagcugcgcccccgguggcuggacgcccgcacguacagcgacccccucgcccugcgggaguucaaggaguucgcggccggccgccgguccgucagcggggaccugauccucgagaucggcaagcugccccagcaccugacccagcgcgcccagaacgcccucgacaaccuggugaugcugcacaacuccgagcagggcgggcgggcguaccgccacgccauggaggagcucccggacaccaucgagacccugaugcugcucgcccugaucgccgugcugacgggcggggucacccucuucuuccugagcggccgggggcugggcaagaccuccaucggccuccugugcgugauggccagcuccgugcugcucuggauggcgagcgucgagccccacuggaucgccgccuccaucauccuggaguucuuccugauggugcuccugauccccgagcccgaccgccagcggaccccgcaggacaaccagcuggccuacguggucaucgggcuccuguucaugauccugaccguggccgcgaacgagaugggccuccuggagacgaccaagaaggaccuggggaucggccacguggccgucgagaaccaccaccacgccgccaugcucgacguggaccugcaccccgccagcgcguggacccuguacgccguggccaccacgaucaucacccccaugaugcgccacaccaucgagaacaccacggccaacaucucccucaccgccaucgcgaaccaggccgccauccugauggggcuggacaagggcuggccgaucagcaagauggacaucggcgucccccuccuggcccuggggugcuacucccaggugaacccccucacccugaccgcggccgugcugaugcucgucgcccacuacgccaucaucggccccgggcugcaggccaaggcgacgcgggaggcccagaagcgcaccgccgccggcaucaugaagaacccgaccguggacgggaucguggccaucgaccuggaccccgucguguacgacgcgaaguucgagaagcagcucggccagaucaugcugcugauccucugcaccagccagauccugcugaugcgcacgaccugggcccucugcgaguccaucacccuggccaccggcccccugacgacccucugggaggggagccccggcaaguucuggaacaccaccaucgccguguccauggccaacaucuuccgggggagcuaccuggcgggcgccggccuggccuucagccucaugaagucccucgggggcgggcgccgggggacgggggcccagggcgagacccugggcgagaaguggaagcgccagcucaaccagcugagcaaguccgaguucaacaccuacaagcggagcgggaucauggaggucgaccgcuccgaggcgaaggagggccugaagcgcggggagaccacgaagcacgccgugagccgcggcaccgccaagcuccggugguucguggagcgcaaccuggucaagccggaggggaaggugaucgaccugggcugcggccgcggcgggugguccuacuacugcgccgggcugaagaaggugaccgaggucaagggguacaccaagggcgggcccggccacgaggagcccauccccauggccacguacggguggaaccucgugaagcugcacagcggcaaggacguguucuucaucccgcccgagaagugcgacacccugcucugcgacaucggggaguccagccccaaccccaccaucgaggagggccgcacccugcggguccugaagaugguggagccguggcuccgcgggaaccaguucugcaucaagauccugaaccccuacaugcccuccguggucgagacgcuggagcagaugcagcggaagcacggcggcaugcucgugcgcaacccccugagccggaacuccacccacgagauguacugggugagcugcgggaccggcaacaucgucuccgcggugaacaugaccagccgcaugcugcucaaccgguucaccauggcccaccgcaagccgacguacgagcgcgacguggaccugggggccggcacccggcacgucgccguggagcccgagguggccaaccuggacaucaucggccagcgcaucgagaacaucaagcacgagcacaaguccaccuggcacuacgacgaggacaaccccuacaagaccugggcguaccacgggagcuacgaggucaagcccuccggcagcgccagcuccauggugaacggggucgugaagcuccugacgaagccgugggacgugauccccauggucacccagaucgccaugaccgacaccacgcccuucggccagcagcggguguucaaggagaagguggacacccgcacccccaaggccaagcgggggaccgcccagaucauggaggucacggcgaaguggcuguggggcuuccucagccgcaacaagaagccgcggaucugcacccgcgaggaguucacccggaaggugcgcuccaacgccgccaucggcgccguguucgucgacgagaaccaguggaacagcgcgaaggaggccguggaggacgagcgguucugggaccuggugcaccgcgagcgggagcugcacaagcaggggaagugcgcgaccugcgucuacaacaugaugggcaagcgcgagaagaagcucggggaguucggcaaggccaaggggucccgggccaucugguacauguggcugggcgcgcgcuuccuggaguucgaggcccucggcuucaugaacgaggaccacugguucagccgggagaacucccugagcgggguggagggcgaggggcugcacaagcucggcuacauccugcgcgacaucuccaagauccccgggggcaacauguacgccgacgacacggccggcugggacacccggaucaccgaggacgaccugcagaacgaggccaagaucaccgacaucauggagcccgagcacgcgcuccuggccaagagcaucuucaagcugacguaccagaacaaggugguccgcgugcagcggccggccaagaacgggaccgugauggacgucaucucccgccgcgaccagcggggcagcggccaggugggcaccuacggccucaacaccuucacgaacauggaggcccagcugauccgccagauggaguccgaggggaucuucagccccuccgagcuggagacccccaaccucgccggccgggugcuggacuggcuggagaagcacggggucgagcgccucaagcggauggcgaucagcggcgacgacugcguggugaagcccaucgacgaccgcuucgccaccgcccugaccgcccugaacgacauggggaagguccggaaggacaucccgcagugggagcccuccaagggcuggaacgacuggcagcagguccccuucugcagccaccacuuccaccagcucaucaugaaggacggccgcgagaucgugguccccugccggaaccaggacgagcugguggggcgcgcccgggugagccagggcgcgggguggucccugcgcgagacggccugccucggcaagagcuacgcccagauguggcagcugauguacuuccaccggcgcgaccugcggcucgccgcgaacgccaucugcuccgccgucccgguggacugggugcccaccagccgcaccaccugguccauccacgcccaccaccaguggaugacgaccgaggacaugcugagcgucuggaaccggguguggaucgaggagaaccccuggauggaggacaagacccacaucuccagcuggggcgacgugcccuaccugggcaagcgcgaggaccaguggugcggcucccucaucgggcugaccgcccgggcgacgugggccaccaacauccaggucgccaucaaccaggugcgccgccugaucggcaacgagaacuaccucgacuacaugaccagcaugaagcgguucaagaacgaguccgacccggagggggcccugugguga

SEQ ID NO: 8508 - RNA, 9879 nt, Artificial Sequence
  derived and/or modified CDS sequence (opt1) from DENV-1__FJ882548__SS-prME
agcgugaccaugcugcucaugcugaugcccaccgcccuggccuuccaccucaccacccgcggcggggagccccacaugaucgugagcaagcaggagcggggcaagagccugcuguucaagaccuccgccggggugaacaugugcacccucaucgccauggaccugggcgagcugugcgaggacaccaugaccuacaagugcccccgcaucaccgaggccgagcccgacgacguggacugcuggugcaacgccaccgacacgugggugaccuacgggaccugcagccagaccggcgagcaccggcgcgacaagcgguccguggcccucgcgccccacgugggccuggggcuggagacgcgcaccgagaccuggaugagcuccgagggcgccuggaagcagauccagcgggucgagaccugggcccuccgccaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcggugcugcggaagcucugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacaccggcgaccagcaccagguggggaacgaguccacggagcacggcaccaccgcgaccaucacgccccaggcccccacgaccgagauccagcucaccgacuacggggcccugacccuggacugcagcccccgcacgggccucgacuucaacgagaugguccugcugaccaugaaggagaaguccuggcucgugcacaagcagugguuccuggaccugccccuccccuggaccagcggggccagcaccucccaggagacguggaaccggcaggaccugcuggugaccuucaagaccgcccacgcgaagaagcaggaggucguggugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgucaugugcaccggguccuucaagcucgagaaggagguggcggagacgcagcacggcaccgugcugguccagaucaaguacgagggcaccgacgcccccugcaagauccccuucagcacccaggacgagaagggggugacgcagaacggccggcugaucaccgccaacccgaucgugaccgacaaggagaagcccgucaacaucgaggccgagccgcccuucggggaguccuacaucgugaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcgucgggaagcugauccaccagaucuucggcaccgccuacgggguccuguucuccggcgugagcuggaccaugaagaucgggaucggcguccugcugacguggcucggccugaacucccgcagcaccucccugagcaugaccugcaucgccguggggcucgugacccuguaccugggcgucauggugcaggccgacuccgggugcgugaucaacuggaagggccgggagcucaagugcgggagcggcaucuucgucacgaacgaggugcacaccuggaccgagcaguacaaguuccaggcggacagcccgaagcgccuguccgccgccaucggcaaggccugggaggagggggugugcggcauccggagcgccacccgccuggagaacaucauguggaagcagaucuccaacgagcucaaccacauccugcuggagaacgacaugaagcucaccgucguggugggggacgucgcgggcauccuggggcagggcaagaagaugauccggccccagcccauggaguacaaguacagcuggaaguccuggggcaaggccaagaucaucggggccgacgcccagaacacgaccuucaucaucgacggccccaacaccccggagugccccgacgaccagcgcgcguggaacaucugggagguggaggacuacggguucggcaucuucaccacgaacaucuggcugaagcuccgggacagcuacacccaggugugcgaccaccgccugauguccgccgccaucaaggacagcaaggccguccacgccgacaugggcuacuggaucgaguccgagaagaacgagaccuggaagcuggcgcgggccagcuucaucgaggugaagaccugcaucuggcccaagucccacacgcucuggagcaacggggugcuggaguccgagaugaucauccccaagaucuacggcgggccgaucagccagcacaacuaccgccccggcuacuucacccagaccgccgggcccuggcaccugggcaagcucgagcuggacuucgaccugugcgagggcaccacggucgugguggacgagcacugcgggaaccggggcccgucccuccgcaccaccaccgucacggggaagaucauccacgaguggugcugccggagcugcacccugccgccccugcgcuuccggggcgaggacgggugcugguacggcauggagauccgccccgugaaggagaaggaggagaaccucgugaaguccauggucagcgccggcagcggggagguggacuccuucagccugggccugcucugcaucuccaucaugaucgaggaggugaugcggagccgcuggucccggaagaugcugaugaccgggacccuggccgucuucuuccuccugaucaugggccagcugacguggaacgaccucauccgccugugcaucauggugggggcgaacgccuucgaccgcaugggcaugggcaccaccuaccuggcccucauggccaccuucaagaugcggccgauguucgccguggggcugcuguuccgccggcucacgagccgcgagguccugcugcucaccaucggccugucccugguggcgagcguggagcuccccaacucccuggaggagcugggggacggccucgccaugggcaucaugauccugaagcugcucaccgacuuccagagccaccagcugugggccacccugcucucccugacguucaucaagaccaccuucagccugcacuacgccuggaagaccauggcgaugguccucuccaucgugagccugcugccccucugccuguccacgaccagccagaagaccaccuggcugcccguccuccuggggucccugggcugcaagccgcucacgauguuccugaucgccgagaacaagaucugggggcggaaguccuggccccugaacgagggcaucauggccguggggaucguguccauccuccugagcagccugcucaagaacgacgucccccuggccggcccccugaucgccggcgggaugcucaucgcgugcuacgugaucuccggcagcuccgccgaccugagccuggagaaggccgccgagguguccugggaggaggaggccgagcacagcggggcgucccacaacauccucgucgaggugcaggacgacggcaccaugaagaucaaggacgaggagcgcgacgacacccugaccauccugcucaaggccacccugcuggccgugagcggggucuacccgcucuccauccccgccacgcuguucgugugguacuucuggcagaagaagaagcagcggagcggcgugcugugggacacccccagcccgcccgaggucgagcgcgccgugcuggacgacggcaucuaccggaucaugcagcgcgggcuccugggccggagccaggugggggucggcguguuccaggagaacguguuccacaccauguggcacgucacccgcggggcggugcugauguaccagggcaagcggcucgagcccuccugggccagcgugaagaaggaccugaucuccuacggcgggggcuggcgccugcgggggagcuggaacacgggcgaggagguccaggugaucgccguggagcccgggaagaaccccaagaacguccagaccgcccccggcaccuucaagacccccgagggcgaggugggggccaucgcgcucgacuucaagcccggcacguccgggagccccaucgugaaccgcgagggcaagaucgucggccuguacgggaacggcguggugaccaccuccgggaccuacgucagcgccaucgcccaggccaaggcgagccaggagggcccgcugcccgagaucgaggacgagguguuccggaagcgcaaccucacgaucauggaccugcaccccggguccggcaagacccggcgcuaccugccggccaucgugcgggaggccaucaagcgcaagcuccgcacccugauccuggcccccacccgggucguggccagcgagauggcggaggcccucaagggcaugcccauccgcuaccagacgaccgccgugaaguccgagcacaccgggaaggagaucgucgaccugaugugccacgccaccuucacgaugcggcugcucagccccgugcgcgugccgaacuacaacaugaucaucauggacgaggcccacuucaccgaccccuccagcaucgcggcccggggcuacaucuccacccgcgucgggaugggcgaggccgccgccaucuucaugaccgcgacgccgcccgggagcguggaggccuucccgcaguccaacgccgugauccaggacgaggagcgggacauccccgagcgcagcuggaacuccggccacgaguggaucaccgacuuccccggcaagaccgucugguucgugcccagcaucaaguccgggaacgacaucgccaacugccugcggaagaacggcaagcgcgugauccagcugagccggaagaccuucgacacggaguaccagaagaccaagaacaacgacugggacuacgucgugaccaccgacaucuccgagaugggggcgaacuuccgcgccgaccgggugaucgacccgcgccggugccucaagcccgucauccugaaggacggccccgagcgcgugauccuggccgggcccaugccggugacggucgccagcgccgcgcagcggcgcggccggaucggccgcaaccacaacaaggagggggaccaguacaucuacaugggccagccccucaacaacgacgaggaccacgcccacuggaccgaggccaagaugcugcuggacaacaucaacacccccgaggggaucauccccgcccucuucgagccggagcgcgagaaguccgccgcgguggacggcgaguaccggcugcgcggggaggcccggaagaccuucgucgagcugaugcgccggggcgaccuccccguguggcugagcuacaagguggccuccgagggcuuccaguacagcgaccgccgguggugcuucgacggggagcgcaacaaccagguccuggaggagaacauggacguggagaucuggacgaaggagggcgagcggaagaagcuccgcccccgguggcuggacgcccgcaccuacagcgacccccuggcccuccgggaguucaaggaguucgcggccgggcgccgguccgugagcggcgaccugauccuggagaucggcaagcucccgcagcaccugacccagcgcgcccagaacgcccuggacaaccucgucaugcugcacaacuccgagcagggcgggcgggcguaccgccacgccauggaggagcugcccgacaccaucgagacgcucaugcugcuggcccucaucgccgugcugaccgggggcgugacccuguucuuccucagcgggcggggccugggcaagaccuccaucgggcugcucugcgucauggccagcuccgugcugcuguggauggcgagcguggagccccacuggaucgccgccuccaucauccucgaguucuuccugaugguccugcucauccccgagccggaccgccagcggacgccccaggacaaccagcuggccuacguggugaucggccuccucuucaugauccugacggucgccgcgaacgagauggggcugcucgagaccaccaagaaggaccugggcaucgggcacguggccguggagaaccaccaccacgccgccaugcuggacgucgaccuccaccccgccagcgcguggacccuguacgccguggccacgaccaucaucaccccgaugaugcgccacaccaucgagaacacgaccgccaacaucucccugaccgccaucgcgaaccaggccgccauccucaugggccuggacaagggcuggcccaucagcaagauggacaucggggugccccugcucgcccugggcugcuacucccaggucaacccccugacccucacggcggccgugcugaugcugguggcccacuacgccaucaucgggccgggccuccaggccaaggcgacccgcgaggcccagaagcggaccgccgccgggaucaugaagaaccccaccgucgacggcaucguggccaucgaccuggaccccguggucuacgacgcgaaguucgagaagcagcugggccagaucaugcuccugauccugugcacgagccagauccuccugaugcgcaccaccugggcccugugcgaguccaucacccucgccacggggccccugaccacccugugggagggcagcccggggaaguucuggaacaccacgaucgccguguccauggccaacaucuuccggggcagcuaccucgcgggcgccgggcuggccuucucccugaugaagucccucggcgggggccgccgggggaccggcgcccagggcgagacccugggggagaaguggaagcgccagcugaaccagcucagcaaguccgaguucaacaccuacaagcggagcggcaucauggagguggaccgcuccgaggcgaaggaggggcugaagcggggcgagacgaccaagcacgccgucagccgcgggaccgccaagcugcggugguucguggagcgcaaccuggugaagcccgagggcaaggucaucgaccucggcugcgggcggggcgggugguccuacuacugcgccggccugaagaaggugaccgaggugaagggguacacgaagggcggccccgggcacgaggagcccaucccgauggccaccuacggcuggaaccuggucaagcuccacagcgggaaggacguguucuucaucccgcccgagaagugcgacacccugcugugcgacaucggcgaguccagccccaacccgaccaucgaggaggggcgcacgcuccgggugcugaagauggucgagcccuggcugcgcggcaaccaguucugcaucaagauccucaaccccuacaugcccuccgugguggagacccuggagcagaugcagcggaagcacggcgggaugcugguccgcaacccgcucagccggaacuccacccacgagauguacugggugagcugcggcaccgggaacaucguguccgcggucaacaugaccagccgcaugcugcugaaccgcuucacgauggcccaccggaagcccaccuacgagcgcgacguggaccucggcaccggcacccggcacguggccgucgagcccgagguggccaaccuggacaucaucgggcagcgcaucgagaacaucaagcacgagcacaaguccacguggcacuacgacgaggacaaccccuacaagaccugggccuaccacggcagcuacgaggugaagccguccgggagcgcguccagcauggucaacggcguggucaagcugcucaccaagcccugggacgugauccccauggugacccagaucgccaugacggacaccacccccuucgggcagcagcgggucuucaaggagaagguggacacccgcacgccgaaggccaagcggggcaccgcccagaucauggaggugaccgcccgcuggcuguggggcuuccugagccggaacaagaagccccgcaucugcacccgggaggaguucacgcgcaagguccgguccaacgcggccaucggggccguguucguggacgagaaccaguggaacagcgccaaggaggcggucgaggacgagcgcuucugggaccucgugcaccgggagcgcgagcugcacaagcagggcaagugcgcgaccugcguguacaacaugauggggaagcgggagaagaagcugggcgaguucgggaaggccaagggcucccgcgccaucugguacauguggcucggcgcccgguuccuggaguucgaggcgcugggguucaugaacgaggaccacugguucagccgcgagaacucccucagcggcgucgagggggagggccugcacaagcugggguacauccuccgggacaucuccaagauccccggcggcaacauguacgccgacgacaccgccgggugggacacccgcaucacggaggacgaccugcagaacgaggccaagaucaccgacaucauggagccggagcacgcccugcucgcgaaggccaucuucaagcugaccuaccagaacaagguggugcgcguccagcggcccgccaagaacggcaccgugauggacgugaucagccgccgggaccagcgcggguccggccaggucggcacguacgggcugaacaccuucaccaacauggaggcccagcucauccggcagauggagagcgagggcaucuucucccccagcgagcuggagacccccaaccuggccgagcgcgcgcucgacuggcuggagaaguacgggguggagcggcugaagcgcauggccaucuccggcgacgacugcguggucaagccgaucgacgaccgguucgccacggcccucaccgcccugaacgacauggggaaggugcgcaaggacaucccccagugggagcccagcaagggcuggaacgacuggcagcagguccccuucugcucccaccacuuccaccagcugaucaugaaggacggccgggagaucgucgugccgugccgcaaccaggacgagcucguggggcgggcgcgcgucagccagggcgccggguggucccugcgggagaccgccugccugggcaagagcuacgcccagauguggcagcucauguacuuccaccgccgggaccugcgccuggcggccaacgccaucugcagcgccgugcccguggacuggguccccaccucccggacgaccuggagcauccacgcccaccaccaguggaugaccaccgaggacaugcucuccguguggaaccgcguguggaucgaggagaaccccuggauggaggacaagacgcacaucagcuccugggaggacgucccguaccuggggaagcgcgaggaccaguggugcggcagccugaucggccucaccgcgcgggccaccugggccaccaacauccagguggccaucaaccaggugcgccggcugaucgggaacgagaacuaccuggacuacaugaccuccaugaagcgcuucaagaacgagagcgaccccgagggcgcccucugguga

SEQ ID NO: 8509 - RNA, 9879 nt, Artificial Sequence
  derived and/or modified CDS sequence (opt1) from DENV-1__GQ199801__SS-prME
agcgugaccaugcugcucaugcugaugcccaccgcccuggccuuccaccucacgacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgaggccgagcccgacgacguggacugcuggugcaacgccaccgacacgugggugaccuacgggaccugcagccagaccggcgagcaccggcgggacaagcgguccguggcccucgcgccccacgugggccuggggcuggagacgcgcaccgagaccuggaugagcuccgagggcgccuggaagcagauccagcggguggagaccugggcccuccggcaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcggugcugcggaagcucugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccucaucacgugcgccaaguucaagugcgugacccgccuggagggcaagaucguccaguacgagaaccugaaguacagcgugaucgugaccguccacaccggcgaccagcaccagguggggaacgaguccacggagcacggcaccaccgcgaccaucacgccccaggcccccagcacggagauccagcucaccgacuacggggcccugacccuggacugcagcccccggaccggccucgacuucaacgagaugguccugcugacgaugaaggagaaguccuggcucgugcacaagcagugguuccuggaccugccgcuccccuggaccagcggggccuccaccagccaggagaccuggaaccgccaggaccugcuggugacguucaagaccgcccacgcgaagaagcaggaggucguggugcucggcucccaggagggcgccaugcacaccgcccugaccggggccacggagauccagaccagcggcaccaccacgaucuucgccgggcaccugaagugccggcucaagauggacaagcugacccugaagggcauguccuacgucaugugcaccgggagcuucaagcucgagaaggagguggcggagacccagcacggcacggugcugguccagaucaaguacgagggcaccgacgcccccugcaagauccccuucuccacccaggacgagaagggggugacccagaacggccgccugaucacggccaacccgaucgugaccgacaaggagaagcccgucaacaucgaggccgagccgcccuucggggagagcuacaucgugaucggcgcgggcgagaaggcccugaagcucuccugguucaagaaggggagcuccaucggcaagauguucgaggccaccgcccgcggggcccgccgcauggcgauccugggcgacaccgccugggacuucgggagcaucggcggcguguucacguccgucgggaagcuggugcaccagaucuucggcaccgccuacggggugcuguucagcggcgucuccuggaccaugaagaucgggaucggcgugcugcugaccuggcucggccugaacagccgguccacgagccuguccaugaccugcaucgccguggggcucgucacccuguaccugggcgugauggugcaggccgacagcgggugcgucaucaacuggaagggccgcgagcucaagugcgggagcggcaucuucgugaccaacgaggugcacacguggaccgagcaguacaaguuccaggcggacuccccgaagcggcugagcgccgccaucggcaaggccugggaggagggggucugcggcauccgcuccgccacccggcuggagaacaucauguggaagcagaucagcaacgagcucaaccacauccugcuggagaacgacaugaaguucaccgugguggucggggacguggcgggcauccucgcccaggggaagaagaugauccgcccccagcccauggaguacaaguacuccuggaaguccuggggcaaggccaagaucaucggcgccgacgugcagaacaccacguucaucaucgacgggcccaacaccccggagugccccgacgaccagcgggcguggaacaucugggaggucgaggacuacggcuucgggaucuucaccaccaacaucuggcugaagcugcgcgacuccuacacccaggugugcgaccaccggcucaugagcgccgccaucaaggacuccaaggccgugcacgccgacaugggcuacuggaucgagagcgagaagaacgagaccuggaagcuggcgcgcgccuccuucaucgaggucaagaccugcaucuggcccaagagccacacccugugguccaacggcgugcucgagagcgagaugaucauccccaagaucuacgggggcccgaucucccagcacaacuaccggcccggguacuucacgcagaccgccggccccuggcaccuggggaagcuggagcucgacuucaaccugugcgagggcaccaccguggucguggacgagcacugcggcaaccgcgggccgagccugcggacgaccaccgugaccggcaagaucauccacgaguggugcugccgcuccugcacgcugccgccccuccgguucaagggggaggacggcugcugguacgggauggagauccgccccgucaaggagaaggaggagaaccuggucaagagcauggugagcgccggcuccggcgaggucgacagcuucucccucgggcugcugugcaucagcaucaugaucgaggaggugaugcggucccgcuggagcaagaagaugcucaugaccggcacccuggccguguucuuccugcucaucauggggcagcugaccuggaacgaccugauccggcucugcaucauggucggcgcgaacgccuccgaccgcauggggaugggcacgaccuaccuggcccugauggccaccuucaagaugcgcccgaugcucgccgugggccugcuguuccggcgccucaccagccgggaggugcugcugcucacgaucgggcugucccuggucgcgagcguggagcuccccaacucccuggaggagcugggcgacgggcucgccaugggcaucaugauccugaagcugcucaccgacuuccagagccaccagcugugggccacccugcucucccugaccuucaucaagacgaccuacagccugcacuacgccuggaagaccauggcgaugguccucuccaucgugagccuguucccccugugccucuccaccacgagccagaagaccaccuggcugcccgugcugcucggcucccuggggugcaagccgcugaccauguuccucaucgccgagaacaagaucuggggccgcaagagcuggccccugaacgaggggaucauggccgucggcaucgugagcauccugcucuccagccugcugaagaacgacgugccccucgccgggccccugaucgccggcggcaugcugaucgcgugcuacgucaucuccgggagcuccgccgaccucagccuggagaaggccgccgagguguccugggaggaggaggccgagcacagcggcgcgucccacaacauccugguggagguccaggacgacgggacgaugaagaucaaggacgaggagcgggacgacacccucaccauccugcugaaggccacccuccuggccgugagcggcguguacccgcuguccauccccgccacccucuucgucugguacuucuggcagaagaagaagcagcgcagcggggugcugugggacacgcccagcccgcccgagguggagcgggccguccuggacgacggcaucuaccgcaucaugcagcggggccugcucgggcgcagccaggugggcgugggggucuuccaggagaacguguuccacaccauguggcacgugacccggggcgcgguccugauguaccaggggaagcgccuggagcccuccugggccagcgugaagaaggaccucaucuccuacggcggcggguggcggcugcagggcagcuggaacaccggggaggaggugcaggucaucgccguggagcccggcaagaaccccaagaacgugcagacggcccccgggaccuucaagaccuccgagggcgaggucggcgccaucgcgcuggacuucaagcccgggaccagcggcagccccaucgugaaccgcgaggggaagaucgugggccucuacggcaacggggucgugacgaccuccggcaccuacgugagcgccaucgcccaggccaaggcgucccaggaggggccccugccggagaucgagaacgaggucuuccggaagcgcaaccugaccaucauggaccuccaccccggcagcgggaagacgcggcgcuaccugcccgccaucgugcgggaggccaucaagcgcaagcugcggacccucauccuggccccgacccgcguggucgccuccgagauggcggaggcccugaagggcauccccauccgcuaccagaccacggccgucaagagcgagcacaccggcaaggagaucguggaccucaugugccacgccaccuucaccaugcggcugcugucccccguccgcgugcccaacuacaacaugaucaucauggacgaggcccacuucacggacccgagcuccaucgcggcccggggguacaucagcacccgcgugggcaugggggaggccgccgccaucuucaugaccgcgacgccgcccggcuccgucgaggccuucccccagagcaacgccgugauccaggacgaggagcgggacaucccggagcgcuccuggaacagcggguacgaguggaucacggacuuccccggcaagaccgugugguucguccccuccaucaagagcggcaacgacaucgccaacugccuccggaagaacgggaagcgcgugauccagcugucccggaagaccuucgacaccgaguaccagaagacgaagaacaacgacugggacuacguggucaccaccgacaucagcgagaugggcgcgaacuuccgcgccgaccgggugaucgacccccgccggugccugaagccggugauccucaaggacgggcccgagcgcgucauccuggccggccccaugcccgugaccgucgccuccgccgcgcagcggcgcgggcggaucggccgcaaccacaacaaggagggcgaccaguacaucuacauggggcagccgcugaacaacgacgaggaccacgcccacuggacggaggccaagaugcuccuggacaacaucaacacccccgagggcaucauccccgcccuguucgagcccgagcgggagaaguccgccgcgaucgacggggaguaccgccuccgcggcgaggcccggaagaccuucguggagcugaugcgccgcggggaccugccgguguggcucagcuacaaggucgccuccgagggcuuccaguacagcgaccgccgguggugcuucgacggcgagcgcaacaaccaggugcuggaggagaacauggacguggagaucuggaccaaggagggggagcggaagaagcugcgcccccgguggcucgacgcccgcacguacuccgacccccuggcccugcgggaguucaaggaguucgcggccggccgccggagcgucuccggggaccucauccuggagaucggcaagcugccccagcaccucacccagcgcgcccagaacgcccuggacaaccuggugaugcuccacaacagcgagcagggcgggcgggcguaccgccacgccauggaggagcugccggacaccaucgagacccugaugcuccuggcccugaucgccgugcucacgggcggggucacccuguucuuccuguccggccgggggcucggcaagaccagcaucggccugcugugcgugauggccuccagcgugcuccuguggauggcguccgucgagccccacuggaucgccgccagcaucauccuggaguucuuccucauggugcugcugauccccgagcccgaccgccagcggaccccgcaggacaaccagcucgccuacguggucaucgggcugcuguucaugauccucaccguggccgcgaacgagaugggccugcuggagacgaccaagaaggaccucgggaucggccacguggccgucgagaaccaccaccacgccgccaugcuggacguggaccugcaccccgccuccgcguggacccucuacgccguggccaccacgaucaucacccccaugaugcgccacaccaucgagaacaccacggccaacaucagccugaccgccaucgcgaaccaggccgccauccugauggggcucgacaagggcuggccgaucuccaagauggacaucggcgucccccugcuggcccucgggugcuacagccaggugaacccccugacccugaccgcggccgugcucaugcuggucgcccacuacgccaucaucggccccgggcugcaggccaaggcgacgcgggaggcccagaagcgcaccgccgccggcaucaugaagaacccgaccguggacgggaucguggccaucgaccucgaccccgucguguacgacgcgaaguucgagaagcagcugggccagaucaugcugcucauccugugcaccucccagauccugcucaugcgcacgaccugggcccugugcgagagcaucacccuggccaccggcccccucacgacccugugggaggggucccccggcaaguucuggaacaccaccaucgccgugagcauggccaacaucuuccgggggagcuaccuggcgggcgccggccucgccuucucccugaugaagucccucgggggcgggcgccgggggacgggggcccagggcgagacccucggcgagaaguggaagcgccagcugaaccagcuguccaagagcgaguucaacaccuacaagcgguccgggaucauggaggucgaccgcagcgaggcgaaggagggccucaagcgcggggagaccacgaagcacgccgugucccgcggcaccgccaagcugcggugguucguggagcgcaaccuggucaagccggaggggaaggugaucgaccugggcugcggccgcggcggguggagcuacuacugcgccgggcucaagaaggugaccgaggucaagggguacaccaagggcgggcccggccacgaggagcccauccccauggccacguacggguggaaccuggugaagcugcacuccggcaaggacguguucuucaucccgcccgagaagugcgacacccuccugugcgacaucggggagagcucccccaaccccaccaucgaggagggccgcacccugcggguccucaagaugguggagccguggcugcgcgggaaccaguucugcaucaagauccugaaccccuacaugcccagcguggucgagacgcucgagcagaugcagcggaagcacggcggcaugcuggugcgcaacccccugucccggaacagcacccacgagauguacuggguguccugcgggaccggcaacaucgucagcgcggugaacaugaccucccgcaugcuccugaaccgguucaccauggcccaccgcaagccgacguacgagcgcgacguggaccugggggccggcacccggcacgucgccguggagcccgagguggccaaccucgacaucaucggccagcgcaucgagaacaucaagcacgagcacaagagcaccuggcacuacgacgaggacaaccccuacaagaccugggcguaccacggguccuacgaggucaagcccagcggcagcgccuccagcauggugaacggggucgugaagcugcugacgaagccgugggacgugauccccauggucacccagaucgccaugaccgacaccacgcccuucggccagcagcggguguucaaggagaagguggacacccgcacccccaaggccaagcgggggaccgcccagaucauggaggucacggcgaaguggcucuggggcuuccugucccgcaacaagaagccgcggaucugcacccgcgaggaguucacccggaaggugcgcagcaacgccgccaucggcgccguguucgucgacgagaaccaguggaacuccgcgaaggaggccguggaggacgagcgguucugggaccuggugcaccgcgagcgggagcuccacaagcaggggaagugcgcgaccugcgucuacaacaugaugggcaagcgcgagaagaagcugggggaguucggcaaggccaaggggagccgggccaucugguacauguggcugggcgcgcgcuuccucgaguucgaggcccugggcuucaugaacgaggaccacugguucucccgggagaacagccuguccgggguggagggcgaggggcuccacaagcugggcuacauccugcgcgacaucagcaagauccccgggggcaacauguacgccgacgacacggccggcugggacacccggaucaccgaggacgaccuccagaacgaggccaagaucaccgacaucauggagcccgagcacgcgcugcuggccaaguccaucuucaagcucacguaccagaacaaggugguccgcgugcagcggccggccaagaacgggaccgugauggacgucaucagccgccgcgaccagcggggcuccggccaggugggcaccuacggccugaacaccuucacgaacauggaggcccagcugauccgccagauggagagcgaggggaucuucucccccagcgagcucgagacccccaaccuggccggccgggugcuggacuggcucgagaagcacggggucgagcgccugaagcggauggcgaucuccggcgacgacugcguggugaagcccaucgacgaccgcuucgccaccgcccugaccgcccucaacgacauggggaagguccggaaggacaucccgcagugggagcccagcaagggcuggaacgacuggcagcagguccccuucugcagccaccacuuccaccagcugaucaugaaggacggccgcgagaucgugguccccugccggaaccaggacgagcugguggggcgcgcccgggugucccagggcgcgggguggagccuccgcgagacggccugccugggcaaguccuacgcccagauguggcagcugauguacuuccaccggcgcgaccuccggcuggccgcgaacgccaucugcagcgccgucccgguggacugggugcccaccucccgcaccaccuggagcauccacgcccaccaccaguggaugacgaccgaggacaugcuguccgucuggaaccggguguggaucgaggagaaccccuggauggaggacaagacccacaucagcuccuggggcgacgugcccuaccucggcaagcgcgaggaccaguggugcggcagccugaucgggcugaccgcccgggcgacgugggccaccaacauccaggucgccaucaaccaggugcgccgccucaucggcaacgagaacuaccuggacuacaugaccuccaugaagcgguucaagaacgagagcgacccggagggggcccugugguga

SEQ ID NO: 8510 - RNA, 9879 nt, Artificial Sequence
  derived and/or modified CDS sequence (opt1) from DENV-1__GQ199802__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgagaccgagcccgacgacguggacugcuggugcaacgccacggacaccugggugaccuacgggaccugcagccagacgggcgagcaccggcgcgacaagcgguccguggcccucgcgccccacgugggccuggggcuggagacccggaccgagaccuggaugagcuccgagggcgcguggaagcagauccagcgggucgagacgugggcccuccgccaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagguggccgagacccagcacggcaccgugcugguccagaucaaguacgagggcaccgacgcgcccugcaagauccccuucagcacgcaggacgagaagggggugacccagaacggccggcugaucaccgccaacccgaucgugaccgacaaggagaagcccgucaacaucgaggccgagccgcccuucggggaguccuacaucgugaucggcgccggcgagaaggcgcugaagcucagcugguucaagaagggguccagcaucggcaagauguucgaggccacggcccgcggggcccggcgcauggccauccugggcgacaccgcgugggacuucggguccaucggcggcguguucaccagcgucgggaagcuggugcaccagaucuucggcaccgccuacggggugcuguucuccggcgucagcuggacgaugaagaucgggaucggcgugcugcugaccuggcucggccugaacucccgcagcaccucccugagcaugaccugcaucgccguggggcucgucacgcuguaccugggcgugauggugcaggccgacuccgggugcgucaucaacuggaagggccgggagcucaagugcgggagcggcaucuucgugaccaacgaggugcacaccuggaccgagcaguacaaguuccaggccgacagcccgaagcgccuguccgcggccaucggcaaggccugggaggagggggucugcggcauccggagcgccacccgccuggagaacaucauguggaagcagaucuccaacgagcucaaccacauccugcuggagaacgacaugaaguucacggugguggucggggacguggccggcauccucgcgcaggggaagaagaugauccggccccagcccauggaguacaaguacagcuggaaguccuggggcaaggccaagaucaucggcgccgacgugcagaacaccaccuucaucaucgacgggcccaacaccccggagugccccgacgaccagcgcgccuggaacaucugggaggucgaggacuacggcuucgggaucuucacgaccaacaucuggcugaagcugcgggacagcuacacccaggugugcgaccaccgccucauguccgcggccaucaaggacagcaaggccgugcacgccgacaugggcuacuggaucgaguccgagaagaacgagaccuggaagcuggcccgggcgagcuucaucgaggucaagacgugcaucuggcccaagucccacacccuguggagcaacggcgugcucgaguccgagaugaucauccccaagaucuacgggggcccgaucagccagcacaacuaccgccccggguacuucacccaggccgccggccccuggcaccuggggaagcuggagcucgacuucgaccugugcgagggcaccacgguggucguggacgagcacugcggcaaccgggggccgucccugcgcaccaccaccgugacgggcaagaucauccacgaguggugcugccggagcugcacccugccgccccuccgcuucaagggggaggacggcugcugguacgggauggagauccggcccgucaaggagaaggaggagaaccuggugaaguccauggugagcgccggcagcggcgaggucgacuccuucagccucgggcugcugugcaucuccaucaugaucgaggaggugaugcgcagccgguggucccgccggaugcucaugaccggcacccuggccguguucuuccugcucaucauggggcagcugacguggaacgaccugauccgccucugcaucauggucggcgcgaacgccagcgaccgcauggggaugggcaccaccuaccuggcccugauggccaccuucaagaugcggccgauguucgccgugggccuccuguuccgccggcugacgucccgcgaggugcuccugcugaccaucgggcucagccuggucgcguccguggagcugcccaacagccucgaggagcugggcgacgggcuggccaugggcaucaugauccucaagcugcugaccgacuuccagucccaccagcucugggccacccugcugagccucacguucaucaagaccaccuucucccugcacuacgccuggaagaccauggcgaugguccugagcaucgugucccucuucccccugugccugagcacgaccucccagaagaccaccuggcuccccgugcugcugggcagccucgggugcaagccgcugacgauguuccugaucgccgagaacaagaucuggggccggcgcuccuggccccucaacgaggggaucauggccgucggcaucgugagcauccugcugagcucccuccugaagaacgacgugccccuggccgggccccucaucgccggcggcaugcugaucgcgugcuacgucaucagcggguccagcgccgaccugucccucgagaaggccgccgaggugagcugggaggaggaggccgagcacuccggcgcgagccacaacauccugguggagguccaggacgacgggaccaugaagaucaaggacgaggagcgggacgacacccugaccauccuccugaaggccacccugcucgccguguccggcguguacccgcugagcauccccgccacgcuguucgucugguacuucuggcagaagaagaagcagcgcuccggggugcucugggacacccccagcccgcccgagguggagcgggccguccuggacgacggcaucuaccgcaucaugcagcggggccugcuggggcgcucccaggugggcgugggggucuuccaggagaacguguuccacaccauguggcacgugacccggggcgcgguccucauguaccaggggaagcgccuggagcccagcugggccuccgugaagaaggaccugaucagcuacggcggcggguggcggcuccagggcuccuggaacacgggggaggaggugcaggucaucgccguggagcccggcaagaaccccaagaacgugcagaccgcccccgggaccuucaagacccccgagggcgaggucggcgccaucgcgcuggacuucaagcccgggacgagcggcucccccaucgugaaccgcgaggggaagaucgugggccuguacggcaacggggucgugaccaccagcggcaccuacgugagcgccaucgcccaggccaaggcgucccaggaggggccgcuccccgagaucgaggacgaggucuuccggaagcgcaaccugacgaucauggaccugcaccccggcagcgggaagacccggcgcuaccucccggccaucgugcgggaggccaucaagcgcaagcugcgcacccugauccucgcccccacccggguggucgccuccgagauggcggaggcccugaagggcaugcccauccgcuaccagacgaccgccgucaagagcgagcacaccggcaaggagaucguggaccugaugugccacgccaccuucacgaugcggcuccugucccccguccgcgugccgaacuacaacaugaucaucauggacgaggcccacuucaccgaccccagcuccaucgcggcccggggguacaucagcacccgcgugggcaugggggaggccgccgccaucuucaugaccgcgacgccgcccggcuccgucgaggccuucccgcagagcaacgccgugauccaggacgaggagcgggacauccccgagcgcuccuggaacagcggguacgaguggaucaccgacuuccccggcaagaccgugugguucguccccuccaucaagagcggcaacgacaucgccaacugccugcggaagaacgggaagcgcgugauccagcucucccggaagaccuucgacacggaguaccagaagaccaagaacaacgacugggacuacguggucaccaccgacaucagcgagaugggcgcgaacuuccgcgccgaccgggugaucgacccgcgccggugccugaagcccgugauccugaaggacgggcccgagcgcgucauccucgccggccccaugccggugacggucgccuccgccgcgcagcggcgcgggcggaucggccgcaaccacaacaaggagggcgaccaguacaucuacauggggcagccccugaacaacgacgaggaccacgcccacuggaccgaggccaagaugcugcucgacaacaucaacacccccgagggcaucauccccgcccuguucgagccggagcgcgagaaguccgccgcgaucgacggggaguaccggcugcgcggcgaggcccggaagaccuucguggagcucaugcgccgcggggaccugcccguguggcuguccuacaaggucgccagcgagggcuuccaguacagcgaccgccgguggugcuucgacggcgagcgcaacaaccaggugcucgaggagaacauggacguggagaucuggacgaaggagggggagcggaagaagcugcgcccccgguggcuggacgcccgcaccuacuccgacccccucgcccugcgggaguucaaggaguucgcggccggccgccggagcgucuccggggaccugauccucgagaucggcaagcugccgcagcaccugacccagcgcgcccagaacgcccucgacaaccuggugaugcugcacaacagcgagcagggcgggcgggcguaccgccacgccauggaggagcuccccgacaccaucgagacgcugaugcugcucgcccugaucgccgugcugaccggcggggucacccucuucuuccuguccggccgggggcugggcaagaccagcaucggccuccugugcgugauggccuccagcgugcugcucuggauggcguccgucgagccccacuggaucgccgccagcaucauccuggaguucuuccugauggugcuccugauccccgagccggaccgccagcggacgccccaggacaaccagcuggccuacguggucaucgggcuccuguucaugauccugacgguggccgcgaacgagaugggccuccuggagaccaccaagaaggaccuggggaucggccacguggccgucgagaaccaccaccacgccgccaugcucgacguggaccugcaccccgccuccgcguggacccuguacgccguggccacgaccaucaucaccccgaugaugcgccacaccaucgagaacacgaccgccaacaucagccucaccgccaucgcgaaccaggccgccauccugauggggcuggacaagggcuggcccaucuccaagauggacaucggcgucccccuccuggcccuggggugcuacagccaggugaacccccucacccugacggcggccgugcugaugcucgucgcccacuacgccaucaucggcccggggcugcaggccaaggcgacccgcgaggcccagaagcggaccgccgccggcaucaugaagaaccccaccguggacgggaucguggccaucgaccuggaccccgucguguacgacgcgaaguucgagaagcagcucggccagaucaugcugcugauccucugcacgucccagauccugcugaugcgcaccaccugggcccucugcgagagcaucacccuggccacgggcccccugaccacccucugggagggguccccgggcaaguucuggaacaccacgaucgccgugagcauggccaacaucuuccggggguccuaccuggcgggcgccggccuggccuucagccucaugaagucccucgggggcgggcgccgggggaccggggcccagggcgagacccugggcgagaaguggaagcgccagcucaaccagcuguccaagagcgaguucaacaccuacaagcgguccgggaucauggaggucgaccgcagcgaggcgaaggagggccugaagcgcggggagacgaccaagcacgccgugucccgcggcaccgccaagcuccggugguucguggagcgcaaccuggucaagcccgaggggaaggugaucgaccugggcugcggccgcggcggguggagcuacuacugcgccgggcugaagaaggugaccgaggucaagggguacacgaagggcggccccggccacgaggagcccaucccgauggccaccuacggguggaaccucgugaagcugcacuccggcaaggacguguucuucaucccgcccgagaagugcgacacccugcucugcgacaucggggagagcucccccaacccgaccaucgaggagggccgcacgcugcggguccugaagaugguggagcccuggcuccgcgggaaccaguucugcaucaagauccugaaccccuacaugcccagcguggucgagacccuggagcagaugcagcggaagcacggcggcaugcucgugcgcaacccgcugucccggaacagcacccacgagauguacuggguguccugcgggaccggcaacaucgucagcgcggugaacaugaccucccgcaugcugcucaaccgcuucacgauggcccaccggaagcccaccuacgagcgcgacguggaccugggggccggcacccggcacgucgccguggagcccgagguggccaaccuggacaucaucggccagcgcaucgagaacaucaagcacgagcacaagagcaccuggcacuacgacgaggacaaccccuacaagacgugggcguaccacggguccuacgaggucaagccgagcggcuccgccagcagcauggugaacggggucgugaagcuccugaccaagcccugggacgugauccccauggucacccagaucgccaugaccgacacgacccccuucggccagcagcggguguucaaggagaagguggacacccgcaccccgaaggccaagcgggggacggcccagaucauggaggucaccgcgaaguggcuguggguguuccucucccgcaacaagaagccccggaucugcacccgcgaggaguucacccggaaggugcgcagcaacgccgccaucggcgccgucuucguggacgagaaccaguggaacuccgcgaaggaggccguggaggacgagcgguucugggaccugguccaccgcgagcgggagcugcacaagcagggcaagugcgccacgugcguguacaacaugauggggaagcgcgagaagaagcucggcgaguucgggaaggccaagggcagccgggccaucugguacauguggcugggggcgcgcuuccuggaguucgaggcccucggcuucaugaacgaggaccacugguucucccgggagaacagccuguccggcguggagggggagggccugcacaagcucggguacauccugcgcgacaucagcaagauccccggcgggaacauguacgccgacgacaccgccggcugggacacccggaucaccgaggacgaccugcagaacgaggcccgcaucacggacaucauggagccggagcacgcgcuccuggccaaguccaucuucaagcugaccuaccagaacaaggucgugcgcgugcagcggcccgccaagaacggcaccgucauggacgugaucagccgccgggaccagcgcggguccggccagguggggaccuacggccucaacacguucaccaacauggaggcccagcugauccggcagauggagagcgagggcaucuucucccccagcgagcuggagacccccaaccucgccgagcgcguccuggacuggcuggagaaguacgggguggagcggcucaagcgcauggcgaucuccggcgacgacugcguggucaagccgaucgacgaccgguucgccaccgcccugacggcccugaacgacauggggaaggugcgcaaggacaucccccagugggagcccagcaagggcuggaacgacuggcagcagguccccuucugcucccaccacuuccaccagcucaucaugaaggacgggcgggagaucgucgugccgugccgcaaccaggacgagcuggugggccgggcccgcgucagccagggcgcgggguggagccugcgggagaccgccugccucggcaaguccuacgcccagauguggcagcugauguacuuccaccgccgggaccugcgccucgccgcgaacgccaucugcagcgccgugcccguggacuggauccccaccucccggaccacguggagcauccacgcccaccaccaguggaugaccaccgaggacaugcuguccgucuggaaccgcguguggaucgaggagaaccccuggauggaggacaagacccacaucagcuccuggggcgacgugccguaccugggcaagcgcgaggaccaguggugcgggagccucaucggccugacggcccgggcgaccugggccaccaacauccaggucgccaucaaccaggugcgccggcugaucggcaacgagaacuaccucgacuacaugaccuccaugaagcgcuucaagaacgagagcgaccccgagggggcccugugguga

SEQ ID NO: 8511 - RNA, 9879 nt, Artificial Sequence
  derived and/or modified CDS sequence (opt1) from DENV-1__JF937597__SS-prME
agcgugaccaugcugcucaugcugaugcccaccgcccuggccuuccaccucaccacccgcggcggggagccccacaugaucgugagcaagcaggagcggggcaagagccugcuguucaagaccagcgccggggugaacaugugcacccucaucgccauggaccugggcgagcugugcgaggacacgaugaccuacaagugcccccgcaucaccgaggccgagcccgacgacguggacugcuggugcaacgccaccgacacgugggugaccuacgggaccugcagccagaccggcgagcaccggcgcgacaagcgguccguggcccucgcgccccacgugggccuggggcuggagacgcgcaccgagaccuggaugagcuccgagggcgccuggaagcagauccagcggguggagaccugggcccuccgccaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcggugcugcggaagcucugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacaccggcgaccagcaccagguggggaacgaguccacggagcacggcaccaccgcgaccaucacgccccaggcccccacgaccgagauccagcucaccgacuacggggcccugacccuggacugcagcccccgcacgggccucgacuucaacgagaugguccugcugaccaugaaggagaaguccuggcucgugcacaagcagugguuccuggaccugccccuccccuggaccagcggggccagcaccucccaggagacguggaaccggcaggaccugcuggugaccuucaagaccgcccacgcgaagaagcaggaggucguggugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgucaugugcaccggguccuucaagcucgagaaggagguggcggagacgcagcacggcaccgugcugguccagaucaaguacgagggcaccgacgcccccugcaagauccccuucagcacccaggacgagaagggggugacgcagaacggccggcugaucaccgccaacccgaucgugaccgacaaggagaagcccgucaacaucgaggccgagccgcccuucggggaguccuacaucgugaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcgucgggaagcuggugcaccagaucuucggcaccgccuacgggguccucuucuccggcgucagcuggaccaugaagaucgggaucggcgugcugcugacguggcucggccugaacucccgcagcaccucccugagcaugaccugcaucgccguggggcucgucacccuguaccugggcgccauggugcaggcggacuccgggugcgugaucaacuggaagggccgggagcucaagugcgggagcggcaucuucgucacgaacgaggugcacaccuggaccgagcaguacaaguuccaggccgacagcccgaagcgccuguccgccgccaucggcaaggccugggaggagggggugugcggcauccggagcgcgacccgccuggagaacaucauguggaagcagaucuccaacgagcucaaccacauccugcuggagaacgacaugaagcucaccgucguggugggggacgucgccggcauccuggggcagggcaagaagaugauccggccccagcccauggaguacaaguacagcuggaaguccuggggcaaggccaagaucaucggggccgacgcgcagaacacgaccuucaucaucgacggccccaacaccccggagugccccgacgaccagcgcgccuggaacaucugggagguggaggacuacggguucggcaucuucaccacgaacaucuggcugaagcuccgggacagcuacacccaggugugcgaccaccgccugauguccgccgccaucaaggacagcaaggccguccacgcggacaugggcuacuggaucgaguccgagaagaacgagaccuggaagcuggcccgggccagcuucaucgaggugaagaccugcaucuggcccaagucccacacgcucuggagcaacggggugcuggaguccgagaugaucauccccaagaucuacggcgggccgaucagccagcacaacuaccgccccggcuacuucacccagaccgccgggcccuggcaccugggcaagcucgagcuggacuucgaccugugcgagggcaccacggucgugguggacgagcacugcgggaaccggggcccgucccuccgcaccaccaccgucacggggaagaucauccacgaguggugcugccggagcugcacccugccgccccugcgcuuccggggcgaggacgggugcugguacggcauggagauccgccccgugaaggagaaggaggagaaccucgugaaguccauggucagcgccggcagcggggagguggacuccuucagccugggccugcucugcaucuccaucaugaucgaggaggugaugcggagccgcuggucccggaagaugcugaugaccgggacccuggcggucuucuuccuccugaucaugggccagcugacguggaacgaccucauccgccugugcaucauggugggggccaacgccagcgaccgcaugggcaugggcaccaccuaccuggcccucauggccaccuucaagaugcggccgauguucgcgguggggcugcuguuccgccggcucacgucccgcgagguccugcugcucaccaucggccugagccugguggccuccguggagcuccccaacagccuggaggagcugggggacggccucgccaugggcaucaugauccugaagcugcucaccgacuuccagucccaccagcugugggccacccugcucagccugacguucaucaagaccaccuucucccugcacuacgcguggaagaccauggccaugguccucagcaucgugucccuguucccccugugccucagcacgaccucccagaagaccaccuggcugcccguccugcucgggagccugggcugcaagccgcugacgauguuccucaucgccgagaacaagaucugggggcggaaguccuggccccugaacgagggcaucauggccguggggaucgugagcauccugcucagcucccugcugaagaacgacgucccccucgccggcccccugaucgcgggcgggaugcugaucgccugcuacgugaucagcggcuccagcgccgaccucucccuggagaaggccgccgaggugagcugggaggaggaggcggagcacuccggggccagccacaacauccuggucgaggugcaggacgacggcaccaugaagaucaaggacgaggagcgcgacgacacccucaccauccugcugaaggccacccuccuggccguguccggggucuacccgcugagcauccccgccacccucuucgugugguacuucuggcagaagaagaagcagcgguccggcgugcugugggacacccccagcccgcccgaggucgagcgcgcggugcuggacgacggcaucuaccggaucaugcagcgcgggcugcucggccggucccaggugggggucggcguguuccaggagaacguguuccacaccauguggcacgucacccgcggggccgugcugauguaccagggcaagcggcuggagcccagcugggccuccgugaagaaggaccucaucagcuacggcgggggcuggcgccugcggggguccuggaacacgggcgaggagguccaggugaucgccguggagcccgggaagaaccccaagaacguccagaccgcccccggcaccuucaagacccccgagggcgaggugggggcgaucgcccuggacuucaagcccggcacgagcgggucccccaucgugaaccgcgagggcaagaucgucggccucuacgggaacggcguggugaccaccagcgggaccuacgucagcgccaucgcccaggcgaaggccucccaggagggcccgcugcccgagaucgaggacgagguguuccggaagcgcaaccugacgaucauggaccuccaccccgggagcggcaagacccggcgcuaccugccggccaucgugcgggaggccaucaagcgcaagcugcgcacccucauccuggcccccacccgggucguggcguccgagauggccgaggcccugaagggcaugcccauccgcuaccagacgaccgccgucaagagcgagcacaccgggaaggagaucgucgaccucaugugccacgccaccuucacgaugcggcugcugucccccgugcgcgugccgaacuacaacaugaucaucauggacgaggcgcacuucaccgaccccagcuccaucgccgcccggggcuacaucagcacccgcgucgggaugggcgaggccgccgcgaucuucaugaccgccacgccgcccggguccguggaggccuucccgcagagcaacgccgugauccaggacgaggagcgggacauccccgagcgcuccuggaacagcggcuacgaguggaucaccgacuuccccggcaagaccgucugguucgugcccuccaucaagagcgggaacgacaucgcgaacugccuccggaagaacggcaagcgcgugauccagcugucccggaagaccuucgacacggaguaccagaagaccaagaacaacgacugggacuacgucgugaccaccgacaucagcgagaugggggccaacuuccgcgccgaccgggugaucgacccgcgccggugccugaagcccgucauccucaaggacggccccgagcgcgugauccuggccgggcccaugccggugacggucgccuccgcggcccagcggcgcggccggaucggccgcaaccacaacaaggagggggaccaguacaucuacaugggccagccccugaacaacgacgaggaccacgcccacuggaccgaggccaagaugcuccuggacaacaucaacacccccgaggggaucauccccgcccuguucgagccggagcgcgagaaguccgcggccguggacggcgaguaccggcuccgcggggaggcccggaagaccuucgucgagcugaugcgccggggcgaccugcccguguggcucuccuacaagguggccagcgagggcuuccaguacagcgaccgccgguggugcuucgacggggagcgcaacaaccagguccuggaggagaacauggacguggagaucuggacgaaggagggcgagcggaagaagcugcgcccccgguggcucgacgcccgcaccuacuccgacccccuggcgcugcgggaguucaaggaguucgccgccgggcgccggagcguguccggcgaccucauccuggagaucggcaagcugccgcagcaccucacccagcgcgcccagaacgcgcuggacaaccuggucaugcuccacaacagcgagcagggcgggcgggccuaccgccacgccauggaggagcugcccgacaccaucgagacgcugaugcuccuggcccugaucgccgugcucaccgggggcgugacccuguucuuccuguccgggcggggccucggcaagaccagcaucgggcugcugugcgucauggcguccagcgugcuccuguggauggccuccguggagccccacuggaucgccgccagcaucauccuggaguucuuccucaugguccugcugauccccgagccggaccgccagcggacgccccaggacaaccagcucgccuacguggugaucggccugcuguucaugauccucacggucgcggccaacgagauggggcugcuggagaccaccaagaaggaccucggcaucgggcacguggccguggagaaccaccaccacgccgccaugcuggacgucgaccugcaccccgcguccgccuggacccucuacgccguggccacgaccaucaucaccccgaugaugcgccacaccaucgagaacacgaccgccaacaucagccugaccgcgaucgccaaccaggccgccauccugaugggccucgacaagggcuggcccaucuccaagauggacaucggggugccccugcuggcgcucggcugcuacagccaggucaacccccugacccugacggccgccgugcucaugcugguggcccacuacgccaucaucgggccgggccugcaggcgaaggccacccgcgaggcccagaagcggaccgccgccgggaucaugaagaaccccaccgucgacggcaucguggcgaucgaccucgaccccguggucuacgacgccaaguucgagaagcagcugggccagaucaugcugcucauccugugcacgucccagauccugcucaugcgcaccaccugggcccugugcgagagcaucacccuggccacggggccccucaccacccugugggagggcuccccggggaaguucuggaacaccacgaucgccgugagcauggcgaacaucuuccggggcuccuaccuggccggcgccgggcucgccuucagccugaugaagucccugggcgggggccgccgggggaccggcgcgcagggcgagacccucggggagaaguggaagcgccagcugaaccagcuguccaagagcgaguucaacaccuacaagcgguccggcaucauggagguggaccgcagcgaggccaaggaggggcucaagcggggcgagacgaccaagcacgccgucucccgcgggaccgccaagcugcggugguucguggagcgcaaccuggugaagcccgagggcaaggucaucgaccugggcugcgggcggggcggguggagcuacuacugcgccggccucaagaaggugaccgaggugaagggguacacgaagggcggccccgggcacgaggagcccaucccgauggcgaccuacggcuggaaccuggucaagcugcacuccgggaaggacguguucuucaucccgcccgagaagugcgacacccuccugugcgacaucggcgagagcucccccaacccgaccaucgaggaggggcgcacgcugcgggugcucaagauggucgagcccuggcugcgcggcaaccaguucugcaucaagauccugaaccccuacaugcccagcgugguggagacccucgagcagaugcagcggaagcacggcgggaugcugguccgcaacccgcugucccggaacagcacccacgagauguacuggguguccugcggcaccgggaacaucgugagcgccgucaacaugaccucccgcaugcuccugaaccgcuucacgauggcccaccggaagcccaccuacgagcgcgacguggaccugggcaccggcacccggcacguggccgucgagcccgagguggccaaccucgacaucaucgggcagcgcaucgagaacaucaagcacgagcacaagagcacguggcacuacgacgaggacaaccccuacaagaccugggcguaccacggcuccuacgaggugaagccgagcggguccgccagcagcauggucaacggcguggucaagcugcugaccaagcccugggacgugauccccauggugacccagaucgccaugacggacaccacccccuucgggcagcagcgggucuucaaggagaagguggacacccgcacgccgaaggccaagcggggcaccgcccagaucauggaggugaccgcgcgcuggcucuggggcuuccugucccggaacaagaagccccgcaucugcacccgggaggaguucacgcgcaagguccggagcaacgccgccaucggggccguguucguggacgagaaccaguggaacuccgcgaaggaggccgucgaggacgagcgcuucugggaccuggugcaccgggagcgcgagcuccacaagcagggcaagugcgcgaccugcguguacaacaugauggggaagcgggagaagaagcugggcgaguucgggaaggccaagggcagccgcgccaucugguacauguggcugggcgcgcgguuccucgaguucgaggcccugggguucaugaacgaggaccacugguucucccgcgagaacagccuguccggcgucgagggggagggccuccacaagcugggguacauccugcgggacaucagcaagauccccggcggcaacauguacgccgacgacaccgccgggugggacacccgcaucacggaggacgaccuccagaacgaggccaagaucaccgacaucauggagccggagcacgcgcugcuggccaaggccaucuucaagcucaccuaccagaacaagguggugcgcguccagcggcccgccaagaacggcaccgugauggacgugaucucccgccgggaccagcgcgggagcggccaggucggcacguacgggcugaacaccuucaccaacauggaggcccagcugauccggcagauggaguccgagggcaucuucagccccuccgagcucgagacccccaaccuggcggagcgcgcccugaacuggcucgagaaguacgggguggagcggcugaagcgcauggccaucagcggcgacgacugcguggucaagccgaucgacgaccgguucgccacggcccugaccgcgcucaacgacauggggaaggugcgcaaggacaucccccagugggagcccuccaagggcuggaacgacuggcagcagguccccuucugcagccaccacuuccaccagcugaucaugaaggacggccgggagaucgucgugccgugccgcaaccaggacgagcugguggggcgggcccgcgucucccagggcgccggguggagccuccgggagaccgccugccugggcaagagcuacgcgcagauguggcagcugauguacuuccaccgccgggaccuccgccuggccgccaacgccaucugcuccgccgugcccguggacuggguccccaccagccggacgaccugguccauccacgcgcaccaccaguggaugaccaccgaggacaugcugagcguguggaaccgcguguggaucgaggagaaccccuggauggaggacaagacgcacaucuccagcugggaggacgucccguaccucgggaagcgcgaggaccaguggugcggcucccugaucggccugaccgcccgggccaccugggccaccaacauccagguggccaucaaccaggugcgccggcucaucgggaacgagaacuaccuggacuacaugaccagcaugaagcgcuucaagaacgaguccgaccccgagggcgcgcugugguga

SEQ ID NO: 8512 - RNA, 9879 nt, Artificial Sequence
  derived and/or modified CDS sequence (opt1) from DENV-1__GQ868609__SS-prME
agcgugaccaugcugcucaugcugaugcccaccgcccuggccuuccaccucaccacccgcggcggggagccccacaugaucgugaccaagcaggagcggggcaagagccugcuguucaagaccagcgccggggugaacaugugcacccucaucgccauggaccugggcgagcugugcgaggacaccaugaccuacaagugcccccggaucaccgaggccgagcccgacgacguggacugcuggugcaacgccaccgacaccugggugaccuacgggaccugcagccagacgggcgagcaccggcgcgacaagcggagcguggcccucgcgccccacgugggccuggggcuggagacccgcaccgagaccuggauguccagcgagggcgccuggaagcagauccagcgggucgagacgugggcccuccgccaccccggguucaccgugaucgcccuguuccuggcgcacgccaucggcaccuccaucacccagaaggggaucaucuucauccuccugaugcuggugacgcccagcauggccaugcggugcgucggcaucggcucccgcgacuucguggaggggcucagcggcgccaccuggguggacgucgugcuggagcacggguccugcgugaccaccauggccaaggacaagcccacgcuggacaucgagcuccugaagaccgaggucaccaaccccgcggugcugcggaagcucugcaucgaggccaagaucagcaacaccacgaccgacucccgcugccccacccagggcgaggccacccugauggaggagcaggacgccaacuucgugugccggcgcacguucgucgaccggggcugggggaacggcugcgggcuguucggcaaggggagccucaucacgugcgccaaguucaagugcgugaccaagcuggagggcaagaucgugcaguacgagaaccugaaguacuccgucaucgugaccgugcacacgggcgaccagcaccaggucgggaacgagagcaccgagcacggcaccaccgcgaccaucacgccccaggcccccaccuccgagauccagcucaccgacuacggggcccugacccuggacugcagcccccgcacgggccucgacuucaacgagauggugcugcugaccaugaaggagaaguccuggcucguccacaagcagugguuccuggaccugccgcuccccuggaccagcggggccagcaccucccaggagacguggaaccggcaggaccugcuggugaccuucaagaccgcccacgcgaagaagcaggagguggucgugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgugaugugcaccggguccuucaagcucgagaaggaggucgcggagacgcagcacggcaccgugcuggugcagaucaaguacgagggcaccgacgcccccugcaagauccccuucagcacccaggacgagaagggggucacgcagaacggccggcugaucaccgccaacccgaucgugaccgacaaggagaagcccgugaacaucgaggccgagccgcccuucggggaguccuacaucgucaucggcgcgggcgagaaggcccugaagcucagcugguucaagaagggguccagcaucggcaagauguucgaggccaccgcccgcggggcccggcgcauggcgauccugggcgacacggccugggacuucggguccgugggcggcguguucaccagcgucgggaagcuggugcaccagaucuucggcaccgccuacgggguccuguucuccggcgucagcuggaccaugaagaucgggaucggcgugcugcugacguggcucggccugaacucccgcagcaccucccugagcaugaccugcaucgccguggggcucgucacccuguaccugggcgugauggugcaggccgacuccgggugcgucaucaacuggaagggccgggagcucaagugcgggagcggcaucuucgugacgaacgaggugcacaccuggaccgagcaguacaaguuccaggcggacagcccgaagcgccuguccgccgccaucggcaaggccugggaggagggggucugcggcauccggagcgccacccgccuggagaacaucauguggaagcagaucuccaacgagcucaaccacauccugcuggagaacgacaugaaguucaccgugguggucggggacguggugggcauccucgcgcaggggaagaagaugauccggccccagcccauggagcacaaguacagcuggaaguccuggggcaaggccaagaucaucggcgccgacguccagaacacgaccuucaucaucgacgggcccaacaccccggagugccccgacgaccagcgcgccuggaacaucugggagguggaggacuacggcuucgggaucuucaccacgaacaucuggcugcggcugcgcgacagcuacacccaggugugcgaccaccggcucauguccgcggccaucaaggacagcaaggccguccacgccgacaugggcuacuggaucgaguccgagaagaacgagaccuggaagcuggcccgcgcgagcuucaucgaggugaagaccugcaucuggcccaagucccacacgcuguggagcaacggcgugcucgaguccgagaugaucauccccaagaucuacgggggcccgaucagccagcacaacuaccggcccggguacuucacccagaccgccggccccuggcaccuggggaagcuggagcucgacuucgaccugugcgagggcaccacggucgugguggacgagcacugcggcaaccgcgggccgucccugcggaccaccaccgucacgggcaagaucauccacgaguggugcugccgcagcugcacccugccgccccuccgguucaagggggaggacggcugcugguacgggauggagauccgccccgugaaggagaaggaggagaaccuggugaaguccauggucagcgccggcagcggcgagguggacuccuucagccucgggcugcugugcaucuccaucaugaucgaggaggugaugcggagccgcuggucccggaagaugcucaugaccggcacccuggccgucuuccugcuccugaucauggggcagcugacguggaacgaccucauccgccugugcaucauggugggcgccaacgcgagcgaccgcauggggaugggcaccaccuaccuggcccucauggccaccuucaagaugcggccgauguucgccgugggccugcuguuccgccggcucacgucccgcgagguccugcugcucaccaucgggcugagccugguggccuccgucgagcuccccaacagccuggaggagcugggcgacgggcucgcgaugggcaucaugauccugaagcugcucaccgacuuccagucccaccagcugugggccacccugcucagccugacguucaucaagaccacccugucccuccacuacgccuggaagaccauggccauggugcugagcaucgugucccuguucccccucugccugagcacgaccucccagaagaccaccuggcugcccguccuccugggcagccuggggugcaagccgcucacgauguuccugaucaccgagaacaagaucuggggccggaaguccuggccccugaacgaggggaucauggcggugggcguggucagcauccuccugagcucccugcucaagaacgacgugccccuggccgggccccugaucgccggcggcaugcucaucgccugcuacgugaucagcggguccagcgccgaccugucccuggagaaggcggccgaggucagcugggaggaggaggccgagcacuccggcgccagccacaacauccucguggaggugcaggacgacgggaccaugaagaucaaggacgaggagcgcgacgacacccugaccauccugcucaaggccacgcugcuggcggucuccggcguguacccgcucagcauccccgccacccuguucgugugguacuucuggcagaagaagaagcagcgguccgggguccugugggacacccccagcccgcccgagguggagcgcgccgugcuggacgacggcaucuaccggaucaugcagcgcggccuccuggggcggucccaggucggcguggggguguuccaggagaacgucuuccacaccauguggcacgugacgcgcggcgccgugcugauguaccaggggaagcggcucgagcccagcugggccuccgucaagaaggaccugaucagcuacggcggcggguggcgccugcagggcuccuggaacaccggggaggagguccaggugaucgcggucgagcccggcaagaaccccaagaacgugcagaccgcccccgggaccuucaagacgcccgagggcgaggugggcgccaucgcccucgacuucaagcccgggaccagcggcucccccaucgucaaccgggaggggaagaucgugggccuguacggcaacgggguggucaccaccagcggcacguacgugagcgccaucgcgcaggccaaggccucccaggaggggccgcugcccgagaucgaggacgagguguuccgcaagcggaaccucaccaucauggaccugcaccccggcagcgggaagacccgccgguaccugccggccaucguccgcgaggcgaucaagcggaagcuccgcacccugauccuggcccccacgcgcgugguggccuccgagauggccgaggcccucaagggcaugcccauccgguaccagaccaccgcggucaagagcgagcacaccggcaaggagaucguggaccugaugugccacgccacguucaccaugcgccugcucucccccgugcgggucccgaacuacaacaugaucaucauggacgaggcccacuucaccgaccccagcuccaucgccgcccgcggguacaucagcacccgggugggcaugggggaggcggccgccaucuucaugacggccacgccgcccggcuccguggaggccuucccgcagagcaacgcggucauccaggacgaggagcgcgacauccccgagcgguccuggaacagcggguacgaguggaucaccgacuuccccggcaagaccgugugguucgugcccuccaucaagagcggcaacgacaucgccaacugccugcgcaagaacgggaagcgggucauccagcugucccgcaagacguucgacaccgaguaccagaagaccaagaacaacgacugggacuacguggugaccacggacaucagcgagaugggcgccaacuuccgggccgaccgcgucaucgacccgcggcgcugccucaagcccgugauccugaaggacgggcccgagcgggucauccuggcgggccccaugccggugaccguggccuccgccgcccagcgccgggggcgcaucggccggaaccacaacaaggagggcgaccaguacaucuacauggggcagccccucaacaacgacgaggaccacgcccacuggaccgaggcgaagaugcugcuggacaacaucaacacccccgagggcaucauccccgcccucuucgagccggagcgcgagaaguccgccgccaucgacggggaguaccgccugcggggcgaggcccgcaagacguucgucgagcugaugcggcgcggggaccuccccguguggcuguccuacaagguggcgagcgagggcuuccaguacagcgaccggcgcuggugcuucgacggcgagcggaacaaccagguccuggaggagaacauggacguggagaucuggaccaaggagggggagcgcaagaagcuccggccccgcuggcuggacgcccggaccuacuccgacccccuggcccuccgcgaguucaaggaguucgccgccggccggcgcagcguguccggggaccugauccuggagaucggcaagcucccgcagcaccugacccagcgggcgcagaacgcccuggacaaccucgucaugcugcacaacagcgagcagggcgggcgcgccuaccggcacgccauggaggagcugcccgacacgaucgagacccucaugcugcuggcgcucaucgccgugcugaccggcggggugacccuguucuuccucuccggccgcgggcugggcaagaccagcaucggccugcucugcgucauggccuccagcgugcugcuguggauggccuccguggagccccacuggaucgccgcgagcaucauccucgaguucuuccugaugguccugcucauccccgagccggaccggcagcgcacgccccaggacaaccagcuggccuacguggugaucgggcuccucuucaugauccugaccgucgccgccaacgagaugggccugcucgagaccaccaagaaggaccuggggaucggccacguggccguggagaaccaccaccacgcgacgaugcuggacgucgaccuccaccccgccuccgccuggacccuguacgccguggccaccaccaucaucacgccgaugaugcggcacaccaucgagaacaccaccgcgaacaucagccugacggccaucgccaaccaggccgccauccucauggggcuggacaagggcuggcccaucuccaagauggacaucggcgugccccugcucgcgcuggggugcuacagccaggucaacccccugacccucaccgccgccgugcugaugcugguggcccacuacgcgaucaucggcccggggcuccaggccaaggccacccgcgaggcccagaagcgcacggccgcgggcaucaugaagaaccccaccgucgacgggaucguggccaucgaccuggaccccguggucuacgacgccaaguucgagaagcagcugggccagaucaugcuccugauccugugcaccucccagauccuccugaugcggaccacgugggcccugugcgagagcaucacccucgccaccggcccccugaccacgcugugggagggguccccgggcaaguucuggaacaccaccaucgcggugagcauggccaacaucuuccgcggguccuaccucgccggcgccggccuggccuucagccugaugaagucccucgggggcgggcggcgcggcaccggggcgcagggcgagacgcugggcgagaaguggaagcggcagcugaaccagcucuccaagagcgaguucaacaucuacaagcgcuccgggaucauggagguggaccggagcgaggccaaggagggccugaagcgcggggagaccacccggcacgccgucucccgcggcaccgccaagcugcggugguucguggagcgcaaccuggugaagcccgaggggaaggucaucgaccucggcugcggccgcggcggguggagcuacuacugcgcggggcugaagaaggugacggaggugaagggguacaccaagggcgggcccggccacgaggagcccaucccgauggccaccuacggguggaaccuggucaagcuccacuccggcaaggacguguucuucacgccgcccgagaagugcgacacgcugcugugcgacaucggggagagcucccccaacccgaccaucgaggagggccgcacccuccgggugcugaagauggucgagcccuggcugcgcgggaaccaguucugcaucaagauccucaaccccuacaugcccagcgugguggagacccuggagcagaugcagcggaagcacggcggcaugcugguccgcaacccgcucucccggaacagcacccacgagauguacuggguguccugcgggacgggcaacaucgugagcgccgucaacaugaccucccgcaugcugcugaaccgcuucaccauggcccaccggaagcccaccuacgagaaggacguggaccucggggccggcacgcgccacguggcggucgagcccgagguggccaaccuggacaucaucggccagcggaucgagaacaucaagcacgagcacaagagcaccuggcacuacgacgaggacaaccccuacaagaccugggccuaccacggguccuacgaggucaagccgagcggcuccgccagcagcauggugaacgggguggucaagcugcucaccaagcccugggacgugauccccauggugacgcagaucgccaugaccgacaccacccccuucggccagcagcgcgucuucaaggagaagguggacacgcggaccccgaaggcgaagcgcgggaccgcccagaucauggaggugaccgcccgguggcuguggggcuuccugucccgcaacaagaagccccggaucugcacgcgcgaggaguucacccggaagguccgcagcaacgccgccaucggcgcgguguucguggacgagaaccaguggaacuccgccaaggaggccgucgaggacgagcgguucugggaccucgugcagaaggagcgcgagcugcacaagcaggggaagugcgcgaccugcguguacaacaugaugggcaagcgggagaagaagcugggggaguucggcaaggcgaaggggagccgcgccaucugguacauguggcucggcgcccgguuccuggaguucgaggcccugggcuucaugaacgaggaccacugguucucccgcgagaacagccucuccggggucgagggcgaggggcugcacaagcugggcuacauccuccgggacaucagcaagauccccgggggcaacauguacgccgacgacaccgcgggcugggacacgcgcaucaccgaggacgaccugcagaacgaggccaagaucaccgacaucauggagccggagcacgcccugcucgccaccuccaucuucaagcugacguaccagaacaagguggugcggguccagcgccccgccaagaacgggaccgugauggacgugaucagccgccgggaccagcgcggcuccgggcaggucggcaccuacggccugaacaccuucacgaacauggaggcgcagcucauccggcagauggagagcgaggggaucuuccugcccuccgagcuggagacccccaaccucgccgagcgcgugcuggacuggcuggagaaguacggcguggagcggcucaagcgcauggccaucagcggggacgacugcgucgugaagccgaucgacgaccgguucgccaccgcccugaccgcgcugaacgacaugggcaaggugcgcaaggacaucccccagugggagcccuccaagggguggaacgacuggcagcagguccccuucugcagccaccacuuccaccagcucaucaugaaggacggccgggagaucguggugccgugccgcaaccaggacgagcuggucggccgggcccgcgugucccagggggccggcuggagccugcgggagacggccugccucggcaagagcuacgcccagauguggcagcugauguacuuccaccgccgggaccugcgccucgcggccaacgccaucugcuccgccgugcccgucgacugggugcccaccagccggaccaccugguccauccacgcgcaccaccaguggaugacgaccgaggacaugcugagcguguggaaccgcgucuggaucgaggagaaccccuggauggaggacaagacccacguguccagcuggggcgacgugccguaccuggggaagcgggaggaccaguggugcggcucccucaucggccugaccgcccgcgccaccugggccagcaacauccaggucgccaucaaccaggugcgccggcugaucgggaacgagaacuaccucgacuacaugacguccaugaagcgcuucaagaacgagggcgaccccgagggggcgcugugguga

SEQ ID NO: 8513 - RNA, 9879 nt, Artificial Sequence
  derived and/or modified CDS sequence (opt1) from DENV-1__GQ199803__SS-prME
agcgugaccaugcugcucaugcugaugcccaccgcccuggccuuccaccucaccauccgcggcggggagccccacaugaucguguccaagcaggagcggggcaagagccugcuguucaagaccuccgccggggugaacaugugcacccucaucgccauggaccugggcgagcugugcgaggacaccaugaccuacaagugcccccgcaucaccgaggccgagcccgacgacguggacugcuggugcaacgccaccgacaccugggugaccuacgggaccugcagccagaccggcgagcaccggcgcgacaagcgguccguggcccucgcgccccacgugggccuggggcuggagacccgcaccgagaccuggaugagcuccgagggcgccuggaagcagauccagcgggucgagaccugggcccuccgccaccccggguucaccgugaucgcccuguuccuggcgcacgccaucggcacgagcaucacccagaaggggaucaucuucauccuccugaugcuggugacccccuccauggccaugcggugcgucggcaucggcagccgcgacuucguggaggggcucuccggcgccaccuggguggacgucgugcuggagcacgggagcugcgugacgaccauggccaaggacaagcccacccuggacaucgagcuccugaagaccgaggucacgaaccccgcggugcugcggaagcucugcaucgaggccaagaucuccaacaccaccaccgacagccgcugcccgacgcagggcgaggccacccugguggaggagcaggacgccaacuucgucugccggcgcaccuucguggaccggggcugggggaacggcugcgggcuguucggcaaggggucccucaucacgugcgccaaguucaagugcgugacgaagcuggagggcaagaucguccaguacgagaaccugaaguacagcgugaucgugaccguccacaccggcgaccagcaccagguggggaacgaguccaccgagcacggcacgaccgcgaccaucacgccccaggcccccaccacggagauccagcucaccgacuacggggcccugacccuggacugcagcccccgcaccggccucgacuucaacgagaugguccugcugacgaugaaggagaaguccuggcucgugcacaagcagugguuccuggaccugccccuccccuggaccagcggggccagcaccucccaggagaccuggaaccggcaggaccugcuggugacguucaagaccgcccacgcgaagaagcaggaggucguggugcucggcagccaggagggcgccaugcacaccgcccugaccggggccacggagauccagaccuccggcaccaccacgaucuucgccgggcaccugaagugccgccucaagauggacaagcugacccugaagggcaugagcuacgucaugugcaccggguccuucaagcucgagaaggagguggcggagacccagcacggcacggugcugguccagaucaaguacgagggcaccgacgcccccugcaagauccccuucagcacccaggacgagaagggggugacccagaacggccggcugaucacggccaacccgaucgugaccgacaaggagaagcccgucaacaucgaggccgagccgcccuucggggaguccuacaucgugaucggcgcgggcgagaaggcccugaagcucagcugguucaagaagggguccagcaucggcaagauguucgaggccaccgcccgcggggcccggcgcauggcgauccugggcgacaccgccugggacuucggguccaucggcggcguguucacgagcgucgggaagcuggugcaccagaucuucggcaccgccuacgggguccucuucuccggcgucagcuggaccaugaagaucgggaucggcgugcugcugaccuggcucggccugaacucccgcagcacgucccugagcaugaccugcaucgccguggggcucgucacccuguaccugggcgugauggugcaggccgacuccgggugcgucaucaacuggaagggccgggagcucaagugcgggagcggcaucuucgugaccaacgaggugcacacguggaccgagcaguacaaguuccaggcggacagcccgaagcgccuguccgccgccaucggcaaggccugggaggagggggucugcggcauccggagcgccacccgccuggagaacaucauguggaagcagaucuccaacgagcucaaccacauccugcuggagaacgacaugaagcucaccgugguggucggggacguggcgggcauccuggggcagggcaagaagaugauccggccccagcccauggaguacaaguacagcuggaaguccuggggcaaggccaagaucaucggggccgacgcccagaacaccacguucaucaucgacggccccaacaccccggagugccccgacgaccagcgcgcguggaacaucugggagguggaggacuacggguucggcaucuucaccaccaacaucuggcugaagcuccgggacagcuacacgcaggucugcgaccaccgccugauguccgccgccaucaaggacagcaaggccgugcacgccgacaugggcuacuggaucgaguccgagaagaacgagaccuggaagcuggcgcgggccagcuucaucgaggugaagaccugcaucuggcccaagucccacacccucuggagcaacgggguccuggaguccgagaugaucauccccaagaucuacggcgggccgaucagccagcacaacuaccgccccggcuacuucacgcagaccgccgggcccuggcaccugggcaagcucgagcuggacuucgaccugugcgagggcaccaccgugguggucgacgagcacugcgggaaccggggcccgucccuccgcacgaccaccgugaccgggaagaucauccacgaguggugcugccggagcugcacgcugccgccccugcgcuuccggggcgaggacgggugcugguacggcauggagauccgccccgugaaggagaaggaggagaaccucgucaaguccauggugagcgccggcagcggggagguggacuccuucagccugggccugcucugcaucuccaucaugaucgaggaggucaugcggagccgcuggucccggaagaugcugaugaccgggacccuggccguguucuuccuccugaucaugggccagcugaccuggaacgaccucauccgccugugcaucauggugggggcgaacgccagcgaccgcaugggcaugggcacgaccuaccuggcccucauggccaccuucaagaugcggccgauguucgccgucgggcugcuguuccgccggcucaccucccgcgaggugcugcugcucacgaucggccugagccugguggcguccgucgagcuccccagcucccuggaggagcugggggacggccucgccaugggcaucaugauccugaagcugcucaccgacuuccagagccaccagcugugggccacccugcucucccugaccuucaucaagacggccuucagccugcacuacgcguggaagaccauggccauggugcucuccaucgucagccuguucccccugugccucuccaccaccagccagaagacgaccuggcugcccgugcugcucgggucccugggcugcaagccgcugaccauguuccucaucgccgagaacaagaucugggggcggaaguccuggccccugaacgagggcaucauggccguggggaucgucagcauccugcucuccagccugcugaagaacgacgugccccucgccggcccccugaucgcgggcgggaugcugaucgccugcuacgugaucuccggcagcuccgccgaccucagccuggagaaggccgccgaggucuccugggaggaggaggcggagcacagcggggccucccacaacauccugguggaggugcaggacgacggcaccaugaagaucaaggacgaggagcgcgacgacacgcucaccauccugcugaaggccacccuccuggccgucagcgggguguacccgcuguccauccccgccacccucuucgugugguacuucuggcagaagaagaagcagcggagcggcguccugugggacacccccagcccgcccgagguggagcgcgcggugcuggacgacggcaucuaccggaucaugcagcgcgggcugcucggccggagccaggucggggugggcguguuccaggagaacgucuuccacacgauguggcacgugacccgcggggccgugcugauguaccagggcaagcggcuggagcccuccugggccagcgucaagaaggaccucaucuccuacggcgggggcuggcgccugcgggggagcuggaacaccggcgaggagguccaggugaucgccgucgagcccgggaagaaccccaagaacgugcagaccgcccccggcacguucaagacccccgagggcgaggugggggcgaucgcccuggacuucaagcccggcaccuccgggagccccaucgucaaccgcgagggcaagaucgugggccucuacgggaacggcguggucaccacgagcgggaccuacguguccgccaucgcccaggcgaaggccagccaggagggcccgcugcccgagaucgaggacgagguguuccggaagcgcaaccugaccaucauggaccuccaccccggguccggcaagacccggcgcuaccugccggccaucguccgggaggccaucaagcgcaagcugcgcacgcucauccuggcccccacccgggugguggcgagcgagauggccgaggcccugaagggcaugcccauccgcuaccagaccaccgccgucaaguccgagcacacggggaaggagaucguggaccucaugugccacgccaccuucaccaugcggcugcugagccccgugcgcgucccgaacuacaacaugaucaucauggacgaggcgcacuucaccgaccccuccagcaucgccgcccggggcuacaucuccacgcgcguggggaugggcgaggccgccgcgaucuucaugaccgccacgccgcccgggagcguggaggccuucccgcaguccaacgccgucauccaggacgaggagcgggacauccccgagcgcagcuggaacuccggcuacgaguggaucaccgacuuccccggcaagacggugugguucgugcccagcaucaaguccgggaacgacaucgcgaacugccuccggaagaacggcaagcgcgucauccagcugagccggaagaccuucgacaccgaguaccagaagaccaagaacaacgacugggacuacguggugacgaccgacaucuccgagaugggggccaacuuccgcgccgaccgggucaucgacccgcgccggugccugaagcccgugauccucaaggacggccccgagcgcgugauccuggccgggcccaugccggucaccguggccagcgcggcccagcggcgcggccggaucggccgcaaccacaacaaggagggggaccaguacaucuacaugggccagccccugaacaacgacgaggaccacgcccacuggaccgaggccaagaugcuccuggacaacaucaacacgcccgaggggaucauccccgcccuguucgagccggagcgcgagaaguccgcggccgucgacggcgaguaccggcuccgcggggaggcccggaagaccuucguggagcugaugcgccggggcgaccugcccguguggcucagcuacaaggucgccagcgagggcuuccaguacuccgaccgccgguggugcuucgacggggagcgcaacaaccaggugcuggaggagaacauggacguggagaucuggaccaaggagggcgaccggaagaagcugcgcccccgguggcucgacgcccgcaccuacagcgacccccuggcgcugcgggaguucaaggaguucgccgccgggcgccgguccgucagcggcgaccucauccuggagaucggcaagcugccgcagcaccucacgcagcgcgcccagaacgcgcuggacaaccuggugaugcuccacaacuccgagcagggcgggcgggccuaccgccacgccauggaggagcugcccgacaccaucgagacccugaugcuccuggcccugaucgccgugcucaccgggggcgucacgcuguucuuccugagcgggcggggccucggcaagaccuccaucgggcugcugugcgugauggcgagcuccgugcuccuguggauggccagcgucgagccccacuggaucgccgccuccaucauccuggaguucuuccucauggugcugcugauccccgagccggaccgccagcggacgccccaggacaaccagcucgccuacguggucaucggccugcuguucaugauccucaccguggcggccaacgagauggggcugcuggagaccacgaagaaggaccucggcaucgggcacguggccgucgagaaccaccaccacgccgccaugcuggacguggaccugcaccccgcgagcgccuggacccucuacgccguggccaccaccaucaucacgccgaugaugcgccacaccaucgagaacaccaccgccaacaucucccugacggcgaucgccaaccaggccgccauccugaugggccucgacaagggcuggcccaucagcaagauggacaucggggucccccugcuggcgcucggcugcuacucccaggugaacccccugacccugaccgccgccgugcucaugcuggucgcccacuacgccaucaucgggccgggccugcaggcgaaggccacccgcgaggcccagaagcggacggccgccgggaucaugaagaaccccaccguggacggcaucguggcgaucgaccucgaccccgucguguacgacgccaaguucgagaagcagcugggccagaucaugcugcucauccugugcaccagccagauccugcucaugcgcaccacgugggcccugugcgaguccaucacccuggccaccgggccccucaccacgcugugggagggcagcccggggaaguucuggaacaccaccaucgccguguccauggcgaacaucuuccggggcagcuaccuggccggcgccgggcucgccuucagccugaugaagucccugggcgggggccgccgggggaccggcgcgcagggcgagacgcucggggagaaguggaagcgccagcugaaccagcugagcaaguccgaguucaacaccuacaagcggagcggcaucauggaggucgaccgcuccgaggccaaggaggggcucaagcggggcgagaccaccaagcacgccgugagccgcgggacggccaagcugcggugguucguggagcgcaaccuggucaagcccgagggcaaggugaucgaccugggcugcgggcggggcgggugguccuacuacugcgccggccucaagaaggugaccgaggucaagggguacaccaagggcggccccgggcacgaggagcccaucccgauggcgaccuacggcuggaaccuggugaagcugcacagcgggaaggacguguucuucaucccgcccgagaagugcgacacgcuccugugcgacaucggcgaguccagccccaacccgaccaucgaggaggggcgcacccugcggguccucaagaugguggagcccuggcugcgcggcaaccaguucugcaucaagauccugaaccccuacaugcccuccguggucgagacccucgagcagaugcagcggaagcacggcgggaugcuggugcgcaacccgcugagccggaacuccacgcacgagauguacugggugagcugcggcaccgggaacaucgucuccgccgugaacaugaccagccgcaugcuccugaaccgcuucaccauggcccaccggaagcccaccuacgagcgcgacguggaccugggcacgggcacccggcacgucgccguggagcccgagguggccaaccucgacaucaucgggcagcgcaucgagaacaucaagcacgagcacaaguccaccuggcacuacgacgaggacaaccccuacaagaccugggcguaccacggcagcuacgaggucaagccguccgggagcgccagcuccauggugaacggcgucgugaagcugcugacgaagcccugggacgugauccccauggucacccagaucgccaugaccgacaccacgcccuucgggcagcagcggguguucaaggagaagguggacacccgcaccccgaaggccaagcggggcaccgcccagaucauggaggucacggcgcgcuggcucuggggcuuccugagccggaacaagaagccccgcaucugcacccgggaggaguucacccgcaaggugcgguccaacgccgccaucggggccguguucgucgacgagaaccaguggaacagcgcgaaggaggccguggaggacgagcgcuucugggaccuggugcaccgggagcgcgagcuccacaagcagggcaagugcgcgaccugcgucuacaacaugauggggaagcgggagaagaagcugggcgaguucgggaaggccaagggcucccgcgccaucugguacauguggcugggcgcgcgguuccucgaguucgaggcccugggguucaugaacgaggaccacugguucagccgcgagaacucccugagcggcguggagggggagggccuccacaagcugggguacauccugcgggacaucuccaagauccccggcggcaacauguacgccgacgacacggccgggugggacacccgcaucaccgaggacgaccuccagaacgaggccaagaucaccgacaucauggagccggagcacgcgcugcuggccaaggccaucuucaagcucacguaccagaacaaggugguccgcgugcagcggcccgccaagaacggcaccgugauggacgucaucagccgccgggaccagcgcggguccggccaggugggcaccuacgggcugaacaccuucacgaacauggaggcccagcugauccggcagauggagagcgagggcaucuucucccccagcgagcucgagacccccaaccuggcggagcgcgcccuggacuggcucgagaaguacgggguggagcggcugaagcgcauggccaucuccggcgacgacugcgucgugaagccgaucgacgaccgguucgccaccgcccugaccgcgcucaacgacauggggaaggugcgcaaggacaucccccagugggagcccagcaagggcuggaacgacuggcagcagguccccuucugcucccaccacuuccaccagcugaucaugaaggacggccgggagaucguggugccgugccgcaaccaggacgagcuggucgggcgggcccgcgugagccagggcgccggguggagccuccgggagacggccugccugggcaaguccuacgcgcagauguggcagcugauguacuuccaccgccgggaccuccgccuggccgccaacgccaucugcagcgccgugcccgucgacugggugcccaccucccggaccaccuggagcauccacgcgcaccaccaguggaugacgaccgaggacaugcuguccguguggaaccgcgucuggaucgaggagaaccccuggauggaggacaagacccacaucagcuccugggaggacgugccguaccucgggaagcgcgaggaccaguggugcggcagccugaucggccugaccgcccgggccacgugggccaccaacauccagguggccaucaaccagguccgccggcucaucgggaacgagaacuaccuggacuacaugaccuccaugaagcgcuucaagaacgagagcgaccccgagggcgcgcugugguga

SEQ ID NO: 8514 - RNA, 9879 nt, Artificial Sequence
  derived and/or modified CDS sequence (opt1) from DENV-1__GQ199804__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgagaccgagcccgacgacguggacugcuggugcaacgccacggacaccugggugaccuacgggaccugcagccagacgggcgagcaccggcgggacaagcgguccguggcccucgcgccccacgugggccuggggcuggagacccgcaccgagaccuggaugagcuccgagggcgcguggaagcagauccagcgggucgagacgugggcccuccggcaccccggguucaccgugaucgcccuguuccuggcccacgugaucggcaccagcaucacccagaaggggaucaucuucauccuccugaugcuggucacgcccuccauggcgaugcggugcgugggcaucggcagccgcgacuucguggaggggcucuccggcgccaccugggucgacguggugcuggagcacgggagcugcgucaccaccauggccaaggacaagcccacgcuggacaucgagcuccugaagaccgaggugaccaaccccgccgugcugcggaagcucugcaucgaggccaagaucuccaacaccacgaccgacagccgcugcccgacccagggcgacgcgacccuggucgaggagcaggacgccaacuucgugugccggcgcacguucguggaccggggcugggggaacggcugcgggcuguucggcaaggggucccucaucacgugcgccaaguucaagugcgucaccaagcuggagggcaagaucgugcaguacgagaaccugaaguacagcgugaucgucaccgugcacacgggcgaccagcaccaggucgggaacgaguccaccgagcacggcaccaccgccaccaucacgccccaggcccccaccaccgagauccagcucaccgacuacggggcgcugacgcuggacugcagcccccgcaccggccucgacuucaacgagauggugcugcugaccaugaaggagaaguccuggcucgugcacaagcagugguuccuggaccugccccuccccuggaccagcggggccagcacgucccaggagaccuggaaccggcaggaccugcuggucaccuucaagaccgcccacgccaagaagcaggagguggugguccucggcagccaggagggcgccaugcacacggcgcugaccggggccaccgagauccagaccuccggcacgaccaccaucuucgccgggcaccugaagugccgccucaagauggacaagcugacccugaagggcaugagcuacgugaugugcacgggguccuucaagcucgagaaggagguggccgagacccagcacggcaccguccuggugcagaucaaguacgagggcaccgacgcccccugcaagauccccuucagcacgcaggacgagaagggggugacccagaacggccggcugaucaccgcgaacccgaucgucaccgacaaggagaagcccgugaacaucgaggccgagccgcccuucggggaguccuacaucaucaucggcgccggcgagaaggcccugaagcucagcugguucaagaagggguccagcaucggcaagauguucgaggcgacggcccgcggggcccggcgcauggccauccugggcgacaccgccugggacuucggguccaucggcggcguguucaccagcgucgggaagcuggugcaccagaucuucggcaccgcguacggggugcuguucuccggcgucagcuggacgaugaagaucgggaucggcgugcugcugaccuggcucggccugaacucccgcagcaccucccugagcaugaccugcaucgccguggggcucgucacgcuguaccugggcgugauggugcaggccgacuccgggugcgucaucaacuggaagggccgggagcucaagugcgggagcggcaucuucgugaccaacgaggugcacaccuggaccgagcaguacaaguuccaggccgacagcccgaagcgccuguccgccgcgaucggcaaggccugggaggagggggucugcggcauccggagcgccacccgccuggagaacaucauguggaagcagaucuccaacgagcucaaccacauccugcuggagaacgacaugaaguucacggugguggucggggacguggccggcauccucgcccaggggaagaagaugauccggccccagcccauggaguacaaguacagcuggaaguccuggggcaaggcgaagaucaucggcgccgacgugcagaacaccaccuucaucaucgacgggcccaacaccccggagugccccgacgaccagcgcgccuggaacaucugggaggucgaggacuacggcuucgggaucuucacgaccaacaucuggcugaagcugcgggacagcuacacccaggugugcgaccaccgccucauguccgccgcgaucaaggacagcaaggccgugcacgccgacaugggcuacuggaucgaguccgagaagaacgagaccuggaagcuggcccgggccagcuucaucgaggucaagacgugcaucuggcccaagucccacacccuguggagcaacggcgugcucgaguccgagaugaucauccccaagaucuacgggggcccgaucagccagcacaacuaccgccccggguacuucacccagaccgcgggccccuggcaccuggggaagcuggagcucgacuucgaccugugcgagggcacgaccguggucguggacgagcacugcggcaaccgggggccgucccugcgcaccaccacggugaccggcaagaucauccacgaguggugcugccggagcugcacccugccgccccuccgcuuccgcggggaggacggcugcugguacgggauggagauccgccccgucaaggagaaggaggagaaccuggugaaguccauggugagcgccggcagcggcgaggucgacuccuucagccucgggcugcugugcaucuccaucaugaucgaggaggugaugcggagccgcuggucccggaagaugcucaugaccggcacgcuggccguguucuuccugcucaucauggggcagcugaccuggaacgaccugauccgccucugcaucauggucggcgccaacgccagcgaccgcauggggaugggcaccaccuaccuggcgcugauggccacguucaagaugcggccgauguucgccgugggccuccuguuccgccggcugaccucccgcgaggugcuccugcugaccaucgggcucagccuggucgccuccguggagcugcccaacagccucgaggagcugggcgacgggcuggccaugggcaucaugauccucaagcugcugaccgacuuccagucccaccagcucugggcgacgcugcugagccucaccuucaucaagaccaccuucucccugcacuacgccuggaagacgauggccaugguccugagcaucgugucccucuucccccugugccugagcaccaccucccagaagaccacguggcuccccgugcugcugggcagccucgggugcaagccgcugaccauguuccugaucgccgagaacaagaucuggggccggcgcuccuggccccucaacgaggggaucauggcggucggcaucgugagcauccugcugagcucccuccugaagaacgacgugccccuggccgggccccucaucgccggcggcaugcugaucgccugcuacgucaucagcggguccagcgccgaccugucccucgagaaggcggccgaggugagcugggaggaggaggccgagcacuccggcgccagccacaacauccugguggagguccaggacgacgggaccaugaagaucaaggacgaggagcgggacgacacccugaccauccuccugaaggccacgcugcucgcgguguccggcguguacccgcugagcauccccgccacccuguucgucugguacuucuggcagaagaagaagcagcgcuccggggugcucugggacacccccagcccgcccgagguggagcgggccguccuggacgacggcaucuaccgcaucaugcagcggggccugcuggggcgcucccaggugggcgugggggucuuccaggagaacguguuccacaccauguggcacgugacgcggggcgccguccucauguaccaggggaagcgccuggagcccagcugggccuccgugaagaaggaccugaucagcuacggcggcggguggcggcuccagggcuccuggaacaccggggaggaggugcaggucaucgcgguggagcccggcaagaaccccaagaacgugcagaccgcccccgggaccuucaagacgcccgagggcgaggucggcgccaucgcccuggacuucaagcccgggaccagcggcucccccaucgugaaccgcgaggggaagaucgugggccuguacggcaacggggucgugaccaccagcggcacguacgugagcgccaucgcgcaggccaaggccucccaggaggggccgcuccccgagaucgaggacgaggucuuccggaagcgcaaccugaccaucauggaccugcaccccggcagcgggaagacccggcgcuaccucccggccaucgugcgggaggcgaucaagcgcaagcugcgcacccugauccucgcccccacgcggguggucgccuccgagauggccgaggcccugaagggcaugcccauccgcuaccagaccaccgcggucaagagcgagcacaccggcaaggagaucguggaccugaugugccacgccacguucaccaugcggcuccugucccccguccgcgugccgaacuacaacaugaucaucauggacgaggcccacuucaccgaccccagcuccaucgccgcccggggguacaucagcacccgcgugggcaugggggaggcggccgccaucuucaugacggccacgccgcccggcuccgucgaggccuucccgcagagcaacgcggugauccaggacgaggagcgggacauccccgagcgcuccuggaacagcggguacgaguggaucaccgacuuccccggcaagaccgugugguucguccccuccaucaagagcggcaacgacaucgccaacugccugcggaagaacgggaagcgcgugauccagcucucccggaagacguucgacaccgaguaccagaagaccaagaacaacgacugggacuacguggucaccacggacaucagcgagaugggcgccaacuuccgcgccgaccgggugaucgacccgcgccggugccugaagcccgugauccugaaggacgggcccgagcgcgucauccucgcgggccccaugccggugaccgucgccuccgccgcccagcggcgcgggcggaucggccgcaaccacaacaaggagggcgaccaguacaucuacauggggcagccccugaacaacgacgaggaccacgcccacuggaccgaggcgaagaugcugcucgacaacaucaacacccccgagggcaucauccccgcccuguucgagccggagcgcgagaaguccgccgccaucgacggggaguaccggcugcgcggcgaggcccggaagacguucguggagcucaugcgccgcggggaccugcccguguggcuguccuacaaggucgcgagcgagggcuuccaguacagcgaccgccgguggugcuucgacggcgagcgcaacaaccaggugcucgaggagaacauggacguggagaucuggaccaaggagggggagcggaagaagcugcgcccccgguggcuggacgcccgcaccuacuccgacccccucgcccugcgggaguucaaggaguucgccgccggccgccggagcgucuccggggaccugauccucgagaucggcaagcugccgcagcaccugacccagcgcgcgcagaacgcccucgacaaccuggugaugcugcacaacagcgagcagggcgggcgggccuaccgccacgccauggaggagcuccccgacacgaucgagacccugaugcugcucgcgcugaucgccgugcugaccggcggggucacccucuucuuccuguccggccgggggcugggcaagaccagcaucggccuccugugcgugauggccuccagcgugcugcucuggauggccuccgucgagccccacuggaucgccgcgagcaucauccuggaguucuuccugauggugcuccugauccccgagccggaccgccagcggacgccccaggacaaccagcuggccuacguggucaucgggcuccuguucaugauccugaccguggccgccaacgagaugggccuccuggagaccaccaagaaggaccuggggaucggccacguggccgucgagaaccaccaccacgcggccaugcucgacguggaccugcaccccgccuccgccuggacgcuguacgccguggcgaccaccaucaucaccccgaugaugcgccacacgaucgagaacaccaccgccaacaucagccucaccgccaucgccaaccaggccgcgauccugauggggcuggacaagggcuggcccaucuccaagauggacaucggcgucccccuccuggcccuggggugcuacagccaggugaacccccucacgcugaccgccgccgugcugaugcucgucgcgcacuacgccaucaucggcccggggcugcaggccaaggccacccgcgaggcccagaagcggaccgcggccggcaucaugaagaaccccacgguggacgggaucguggccaucgaccuggaccccgucguguacgacgccaaguucgagaagcagcucggccagaucaugcugcugauccucugcaccucccagauccugcugaugcgcaccaccugggcccucugcgagagcaucacgcuggcgaccggcccccugaccacccucugggagggguccccgggcaaguucuggaacacgaccaucgccgugagcauggccaacaucuuccggggguccuaccuggccggcgccggccuggcguucagccucaugaagucccucgggggcgggcgccgggggaccggggcccagggcgagacccugggcgagaaguggaagcgccagcucaaccagcuguccaagagcgaguucaacacguacaagcgguccgggaucauggaggucgaccgcagcgaggccaaggagggccugaagcgcggggagaccaccaagcacgccgugucccgcggcaccgcgaagcuccggugguucguggagcgcaaccuggucaagcccgaggggaaggugaucgaccugggcugcggccgcgggggcuggagcuacuacugcgccgggcugaagaaggugacggaggucaagggcuacaccaagggcggccccggccacgaggagcccaucccgauggccaccuacggguggaaccucgugaagcugcacuccggcaaggacguguucuucaucccgcccgagaagugcgacacccugcucugcgacaucggggagagcucccccaacccgacgaucgaggagggccgcacccugcggguccugaagaugguggagcccuggcuccgcgggaaccaguucugcaucaagauccugaaccccuacaugcccagcguggucgagacccuggagcagaugcagcggaagcacggcggcaugcucgugcgcaacccgcugucccggaacagcacccacgagauguacuggguguccugcgggaccggcaacaucgucagcgccgugaacaugacgucccgcaugcugcucaaccgcuucaccauggcccaccggaagcccaccuacgagcgcgacguggaccugggggcgggcacccggcacgucgccguggagcccgagguggccaaccuggacaucaucggccagcgcaucgagaacaucaagcacgagcacaagagcacguggcacuacgacgaggacaaccccuacaagaccugggccuaccacggguccuacgaggucaagccgagcggcuccgccagcagcauggugaacggggucgugaagcuccugaccaagcccugggacgugauccccauggucacccagaucgcgaugacggacaccacccccuucggccagcagcggguguucaaggagaagguggacacccgcacgccgaaggccaagcgggggaccgcccagaucauggaggucaccgccaaguggcuguggggcuuccucucccgcaacaagaagccccggaucugcacccgcgaggaguucacgcggaaggugcgcagcaacgccgcgaucggcgccguguucgucgacgagaaccaguggaacuccgccaaggaggccguggaggacgagcgguucugggaccuggugcaccgcgagcgggagcugcacaagcaggggaagugcgcgaccugcgucuacaacaugaugggcaagcgcgagaagaagcucggggaguucggcaaggccaaggggagccgggccaucugguacauguggcugggcgcccgcuuccuggaguucgaggcccucggcuucaugaacgaggaccacugguucucccgggagaacagccuguccgggguggagggcgaggggcugcacaagcucggcuacauccugcgcgacaucagcaagauccccgggggcaacauguacgcggacgacaccgccggcugggacacccggaucacggaggacgaccugcagaacgaggcccgcaucaccgacaucauggagccggagcacgcccuccuggccaaguccaucuucaagcugaccuaccagaacaaggugguccgcgugcagcggcccgcgaagaacgggaccgugauggacgucaucagccgccgggaccagcgcggcuccggccagguggggacguacggccucaacaccuucaccaacauggaggcccagcugauccggcagauggagagcgaggggaucuucucccccagcgagcuggagacccccaaccucgccgagcgcgugcuggacuggcuggagaaguacggcgucgagcggcucaagcgcauggccaucuccggggacgacugcguggugaagccgaucgacgaccgguucgccacggcgcugaccgcccugaacgacaugggcaagguccgcaaggacaucccccagugggagcccagcaagggguggaacgacuggcagcagguccccuucugcucccaccacuuccaccagcucaucaugaaggacggccgggagaucguggucccgugccgcaaccaggacgagcuggugggccgggcccgcgugagccagggggccggcuggagccugcgggagaccgccugccucgggaaguccuacgcgcagauguggcagcugauguacuuccaccgccgggaccugcgccucgccgccaacgccaucugcagcgcgguccccguggacuggauccccaccucccggacgaccuggagcauccacgcccaccaccaguggaugaccaccgaggacaugcuguccguguggaaccgcgucuggaucgaggagaaccccuggauggaggacaagacgcacaucagcuccuggggcgacgugccguaccuggggaagcgcgaggaccaguggugcggcagccucaucggccugaccgcccgggccaccugggccaccaacauccagguggcgaucaaccagguccgccggcugaucgggaacgagaacuaccucgacuacaugaccuccaugaagcgcuucaagaacgagagcgaccccgagggcgcccugugguga

SEQ ID NO: 8515 - RNA, 9879 nt, Artificial Sequence
  derived and/or modified CDS sequence (opt1) from DENV-1__GQ199805__SS-prME
agcgugaccaugcugcucaugcugaugcccaccgcccuggccuuccaccucaccacccggggcggggagccccacaugaucgugaccaagcaggagcggggcaagagccugcuguucaagaccagcgcgggggugaacaugugcacccucaucgccauggaccugggcgagcugugcgaggacaccaugaccuacaagugcccccggaucaccgaggccgagcccgacgacguggacugcuggugcaacgccaccgacaccugggucaccuacgggaccugcagccagacgggcgagcaccggcgcgacaagcggagcguggcccucgcgccccacgugggccuggggcuggagacccgcaccgagaccuggauguccagcgagggcgccuggaagcagauccagcgggucgagacgugggcccuccgccaccccggguucaccgugaucgcccuguuccuggcgcacgugaucggcaccuccaucacccagaaggggaucaucuucauccuccugaugcuggucacgcccagcauggccaugcggugcgugggcaucggcucccgcgacuucguggaggggcucagcggcgccaccugggucgacguggugcuggagcacggguccugcgucaccaccauggccaaggacaagcccacgcuggacaucgagcuccugaagaccgaggugaccaaccccgccgugcugcggaagcucugcaucgaggcgaagaucagcaacaccacgaccgacucccgcugccccacccagggcgaggccacccugauggaggagcaggacgccaacuucgucugccggcgcacguucguggaccggggcugggggaacggcugcgggcuguucggcaaggggagccucaucacgugcgccaaguucaagugcgugaccaagcuggagggcaagaucguccaguacgagaaccugaaguacuccgugaucgugaccguccacacgggcgaccagcaccagguggggaacgagagcaccgagcacggcaccaccgccaccaucacgccccaggcgcccaccuccgagauccagcucaccgacuacggggcccugacccuggacugcagcccccgcacgggccucgacuucaacgagaugguccugcugaccaugaaggagaaguccuggcucgugcacaagcagugguuccuggaccugccgcuccccuggaccagcggggccagcaccucccaggagacguggaaccggcaggaccugcuggugaccuucaagaccgcccacgccaagaagcaggaggucguggugcucggcagccaggagggcgcgaugcacaccgcccugacgggggccaccgagauccagaccuccggcaccacgaccaucuucgccgggcaccugaagugccgccucaagauggacaagcugacccugaagggcaugagcuacgucaugugcaccggguccuucaagcucgagaaggagguggccgagacgcagcacggcaccgugcugguccagaucaaguacgagggcaccgacgcgcccugcaagauccccuucagcacccaggacgagaagggggugacgcagaacggccggcugaucaccgccaacccgaucgugaccgacaaggagaagcccgucaacaucgaggccgagccgcccuucggggaguccuacaucgugaucggcgccggcgagaaggcgcugaagcucagcugguucaagaagggguccagcaucggcaagauguucgaggccaccgcccgcggggcccggcgcauggccauccugggcgacacggcgugggacuucggguccaucggcggcguguucaccagcgucgggaagcuggugcaccagaucuucggcaccgccuacggggugcuguucuccggcgucagcuggaccaugaagaucgggcugggcgugcugcucacguggcugggccugaacucccgcagcaccucccucagcaugaccugcaucgccguggggcuggucacccuguaccucggcgugauggugcaggccgacuccgggugcgucaucaacuggaagggccgggagcugaagugcgggagcggcaucuucgugacgaacgaggugcacaccuggaccgagcaguacaaguuccaggccgacagcccgaagcgccuguccgcggccaucggcaaggccugggaggagggggucugcggcauccggagcgccacccgccucgagaacaucauguggaagcagaucuccaacgagcugaaccacauccugcucgagaacgacaugaaguucaccgugguggucggggacguggugggcauccuggcccaggggaagaagaugauccggccccagcccauggagcacaaguacagcuggaaguccuggggcaaggcgaagaucaucggcgccgacguccagaacacgaccuucaucaucgacgggcccaacaccccggagugccccgacgaccagcgcgccuggaacaucugggagguggaggacuacggcuucgggaucuucaccacgaacaucuggcugaagcuccgggacagccacacccaggugugcgaccaccgccugauguccgccgcgaucaaggacagcaaggccguccacgccgacaugggcuacuggaucgaguccgagaagaacgagaccuggaagcuggcccgggccagcuucaucgaggugaagaccugcaucuggcccaagucccacacgcucuggagcaacggcgugcuggaguccgagaugaucauccccaagaucuacgggggcccgaucagccagcacaacuaccgccccggguacuucacccagaccgcgggccccuggcaccuggggaagcucgagcuggacuucgaccugugcgagggcaccacggucgugguggacgagcacugcggcaaccgggggccgucccuccgcaccaccaccgucacgggcaagaucauccacgaguggugcugccggagcugcacccugccgccccugcgcuucaagggggaggacggcugcugguacgggauggagauccggcccgugaaggagaaggaggagaaccucgugaaguccauggucagcgccggcagcggcgagguggacuccuucagccuggggcugcucugcaucuccaucaugaucgaggaggugaugcgcagccgguggucccgcaagaugcugaugaccggcacccuggccgucuuccuccugcugaucauggggcagcucacguggaacgaccugacccggcugugcaucauggugggcgccaacgccagcgaccgcauggggaugggcaccaccuaccucgcgcugauggccacguucaagaugcgcccgauguucgccgugggccuccuguuccggcgccugaccucccgggagguccugcuccugaccaucgggcugagccucguggccuccgucgagcugcccaacagccuggaggagcucggcgacgggcuggccaugggcaucaugauccugaagcuccugaccgacuuccagucccaccagcugugggcgacgcuccugagccugaccuucaucaagaccacccucucccugcacuacgccuggaagacgauggccauggugcugagcaucgugucccucuucccccugugccugagcaccaccucccagaagaccacguggcuccccguccugcugggcagccucgggugcaagccgcuggccauguuccugaucgcggagaacaagaucuggggccgcaaguccuggccccucaacgaggggaucauggccgugggcguggucagcauccugcugagcucccuccugaagaacgacgugccccuggccgggccccucaucgccggcggcaugcugaucgccugcuacgugaucagcggguccagcgcggaccugucccucgagaaggccgccgaggucagcugggaggaggaggccgagcacuccggcgccagccacaacauccugguggaggugcaggacgacgggaccaugaagaucaaggacgaggagcgggacgacacccugaccauccuccugaaggcgacccugcucgccgucuccggcguguacccgcugagcauccccgccacgcuguucgugugguacuucuggcagaagaagaagcagcgcuccgggguccugugggacacccccagcccgcccgagguggagcgggccgugcucgacgacggcaucuaccgcaucaugcagcggggccugcuggggcgcucccaggucggcguggggguguuccaggagaacgucuuccacaccauguggcacgugacccggggcgccgugcucauguaccaggggaagcgccuggagcccagcugggcguccgucaagaaggaccugaucagcuacggcggcggguggcggcuccagggcuccuggaacacgggggaggagguccaggugaucgccgucgagcccggcaagaaccccaagaacgugcagaccgcccccgggaccuucaagacccccgagggcgaggugggcgccaucgcccuggacuucaagcccgggacgagcggcucccccaucgucaaccgcgaggggaagaucgugggccuguacggcaacgggguggucaccaccagcggcaccuacgugagcgcgaucgcccaggccaaggccucccaggaggggccgcuccccgagaucgaggacgagguguuccggaagcgcaaccugacgaucauggaccugcaccccggcagcgggaagacccggcgcuaccucccggcgaucguccgggaggccaucaagcgcaagcugcggacccugauccucgcccccacccgcgugguggccuccgagauggccgaggcgcugaagggcaugcccauccgcuaccagacgaccgccgucaagagcgagcacaccggcaaggagaucguggaccugaugugccacgccaccuucacgaugcggcuccugucccccgugcgcgucccgaacuacaacaugaucaucauggacgaggcccacuucaccgaccccagcuccaucgccgcgcggggguacaucagcacccgcgugggcaugggggaggccgccgccaucuucaugaccgccacgccgcccggcuccguggaggcguucccgcagagcaacgccgucauccaggacgaggagcgggacauccccgagcgcuccuggaacagcggguacgaguggaucaccgacuuccccggcaagaccgugugguucgugcccuccaucaagagcggcaacgacaucgccaacugccugcggaagaacgggaagcgcgucauccagcucucccggaagaccuucgacacggaguaccagaagaccaagaacaacgacugggacuacguggugaccaccgacaucagcgagaugggcgccaacuuccgcgcggaccgggucaucgacccgcgccggugccugaagcccgugauccugaaggacgggcccgagcgcgucauccucgccggccccaugccggugacgguggccuccgccgcccagcggcgcgggcggaucggccgcaaccacaacaaggagggcgaccaguacaucuacauggggcagccccugaacaacgacgaggaccacgcgcacuggaccgaggccaagaugcugcucgacaacaucaacacccccgagggcaucauccccgcccuguucgagccggagcgggagaaguccgccgccaucgacggggaguaccgccugcgcggcgaggcgcggaagaccuucgucgagcucaugcgccgcggggaccugcccguguggcuguccuacaagguggccagcgagggcuuccaguacagcgaccgccgguggugcuucgacggcgagcgcaacaaccagguccucgaggagaacauggacguggagaucuggacgaaggagggggagcggaagaagcugcgcccccgguggcuggacgcccgcaccuacuccgacccccucgcccugcgggaguucaaggaguucgccgcgggccgccggagcguguccggggaccugauccucgagaucggcaagcugccgcagcaccugacccagcgcgcccagaacgcccucgacaaccuggucaugcugcacaacagcgagcagggcgggcgggccuaccgccacgcgauggaggagcuccccgacaccaucgagacgcugaugcugcucgcccugaucgccgugcugaccggcggggugacccucuucuuccuguccggccgggggcugggcaagaccagcaucggccuccugugcgucauggccuccagcgugcugcucuggauggccuccguggagccccacuggaucgcggccagcaucauccuggaguucuuccugaugguccuccugauccccgagccggaccgccagcggacgccccaggacaaccagcuggccuacguggugaucgggcuccuguucaugauccugacggucgccgccaacgagaugggccuccuggagaccaccaagaaggaccuggggaucggccacguggcgguggagaaccaccaccacgccaccaugcucgacgucgaccugcaccccgccuccgccuggacgcuguacgccguggcgaccaccaucaucaccccgaugaugcgccacacgaucgagaacaccaccgccaacaucagccucaccgccaucgccaaccaggccgcgauccugauggggcuggacaagggcuggcccaucuccaagauggacaucggcgugccccuccuggcccuggggugcuacagccaggucaacccccucacgcugaccgccgccgugcugaugcucguggcgcacuacgccaucaucggcccggggcugcaggccaaggccacccgggaggcccagaagcgcaccgcggccggcaucaugaagaaccccacggucgacgggaucguggccaucgaccuggaccccguggucuacgacgccaaguucgagaagcagcucggccagaucaugcugcugauccucugcaccucccagauccugcugaugcgcaccaccugggcccucugcgagagcaucacgcuggcgaccggcccccugaccacccucugggagggguccccgggcaaguucuggaacacgaccaucgccgugagcauggccaacaucuuccggggguccuaccuggccggcgccggccuggcguucagccucaugaagucccucgggggcgggcgccgggggaccggggcccagggcgagacccugggcgagaaguggaagcgccagcucaaccagcuguccaagagcgaguucaacaucuacaagcgguccgggaucauggagguggaccgcagcgaggccaaggagggccugaagcgcggggagacgacccgccacgccgucucccggggcaccgcgaagcugcgcugguucguggagcggaaccucgugaagcccgaggggaaggucaucgaccugggcugcggccgcgggggcuggagcuacuacugcgccgggcugaagaaggugaccgaggugaagggcuacacgaagggcgggcccggccacgaggagcccaucccgauggccaccuacggguggaaccucgucaagcugcacuccggcaaggacguguucuucacgccgcccgagaagugcgacacccugcucugcgacaucggggagagcucccccaacccgacgaucgaggagggccggacccugcgcgugcugaagauggucgagcccuggcuccgggggaaccaguucugcaucaagauccugaaccccuacaugcccagcgugguggagacccuggagcagaugcagcgcaagcacggcggcaugcucguccggaacccgcugucccgcaacagcacccacgagauguacuggguguccugcgggaccggcaacaucgugagcgccgucaacaugacgucccggaugcugcucaaccgcuucaccauggcccaccgcaagcccaccuacgagcgggacguggaccugggggcgggcacccgccacguggccgucgagcccgagguggccaaccuggacaucaucggccagcggaucgagaacaucaagcacgagcacaagagcacguggcacuacgacgaggacaaccccuacaagaccugggccuaccacggguccuacgaggucaagccgagcggcuccgccagcagcauggugaacgggguggucaagcuccugaccaagcccugggacgugauccccauggugacccagaucgcgaugacggacaccacccccuucggccagcagcgcgucuucaaggagaagguggacacccggacgccgaaggccaagcgcgggaccgcccagaucauggaggugaccgcccgguggcuguggggcuuccucucccgcaacaagaagccccggaucugcacccgcgaggaguucacgcggaagguccgcagcaacgccgcgaucggcgccguguucguggacgagaaccaguggaacuccgccaaggaggccgucgaggacgagcgguucugggaccuggugcagaaggagcgcgagcugcacaagcaggggaagugcgcgaccugcguguacaacaugaugggcaagcgggagaagaagcucggggaguucggcaaggccaaggggagccgcgccaucugguacauguggcugggcgcccgguuccuggaguucgaggcccucggcuucaugaacgaggaccacugguucucccgcgagaacagccuguccggggucgagggcgaggggcugcacaagcucggcuacauccugcgggacaucagcaagauccccgggggcaacauguacgcggacgacaccgccggcugggacacccgcaucacggaggacgaccugcagaacgaggcccggaucaccgacaucauggagccggagcacgcccuccuggccaccuccaucuucaagcugaccuaccagaacaagguggugcgcguccagcgccccgcgaagaacgggacggugauggacgugaucagccggcgcgaccagcggggcuccgggcaggucggcaccuacggccucaacaccuucaccaacauggaggcccagcugauccgccagauggagagcgaggggaucuuccugcccuccgagcucgagacgcagaaccuggccgagcgggugcuggacuggcucgagaaguacggcguggagcgccugaagcggauggccaucagcggggacgacugcgucgugaagcccaucgacgaccgcuucgccaccgcgcugaccgcccucaacgacaugggcaaggugcggaaggacaucccgcagugggagcccuccaagggguggaacgacuggcagcagguccccuucugcagccaccacuuccaccagcugaucaugaaggacggccgcgagaucguggugcccugccggaaccaggacgagcuggucggccgcgcccgggugucccagggggccggcuggagccuccgcgagaccgccugccugggcaagagcuacgcgcagauguggcagcugauguacuuccaccggcgcgaccuccggcuggccgccaacgccaucugcuccgcggugccggucgacugggugcccacgagccgcaccaccugguccauccacgcccaccaccaguggaugaccacggaggacaugcugagcguguggaaccgggucuggaucgaggagaaccccuggauggaggacaagacccacguguccagcuggggcgacgugcccuaccucgggaagcgcgaggaccaguggugcggcucccugaucggccugaccgcccgcgccaccugggccagcaacauccaggucgcgaucaaccaggugcggcgccucaucgggaacgagaacuaccuggacuacaugaccuccaugaagcgguucaagaacgagggcgacccggagggggcccugugguga

SEQ ID NO: 8516 - RNA, 9879 nt, Artificial Sequence
  derived and/or modified CDS sequence (opt1) from DENV-1__GQ199806__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgaguucugcgaggacacgaugaccuacaagugcccccgcaucaccgaggccgagcccgacgacguggacugcuggugcaacgccaccgacaccugggucaccuacgggaccugcagccagaccggcgagcaccggcgggacaagcgguccguggcccuggcgccccacgugggccucgggcuggagacgcgcaccgagaccuggaugagcuccgagggcgccuggaagcagauccagcgggucgagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcgauccugcggaagcugugcaucgaggccaagaucuccaacaccaccacggacagccgcugcccgacccagggcgaggccacccucguggaggagcaggacgccaacuucgugugccggcgcaccuucgucgaccggggcugggggaacggcugcgggcuguucggcaaggggucccugaucacgugcgccaaguucaagugcgugaccaagcucgagggcaagaucgugcaguacgagaaccugaaguacagcgucaucgugaccgugcacaccggcgaccagcaccaggucgggaacgaguccacggagcacggcaccaccgcgaccaucacgccccaggcccccagcacggagauccagcugaccgacuacggggcccucacccuggacugcagcccccggaccggccuggacuucaacgagauggugcuccugacgaugaaggagaaguccuggcugguccacaagcagugguuccucgaccugccgcugcccuggaccagcggggccuccaccagccaggagaccuggaaccggaaggaccuccuggugacguucaagaccgcccacgcgaagaagcaggaggccgugguccugggcucccaggagggcgccaugcacaccgcccucaccggggccacggagauccagaccagcggcaccaccacgaucuucgcggggcaccugaagugccgccugaagauggacaagcucacccugaagggcauguccuacgugaugugcaccgggagcuucaagcuggagaaggagguggccgagacccagcacggcacgguccucgugcagaucaaguacgagggcaccgacgcccccugcaagauccccuucuccacccaggacgagaagggggugacccagaacggccggcugaucacggccaacccgaucgucaccgacaaggagaagcccgugaacaucgaggcggagccgcccuucggggagagcuacaucgugaucggcgccggcgagaaggcccugaagcuguccugguucaagaaggggagcuccaucggcaagauguucgaggccaccgcccgcggggcgcggcgcauggccauccucggcgacaccgccugggacuucgggagcaucggcggcgucuucacguccguggggaagcuggugcaccagaucuucggcaccgccuacgggguccuguucagcggcguguccuggaccaugaagaucgggaucggcgugcuccugaccuggcugggccucaacagccgcuccacgagccuguccaugaccugcaucgucguggggcuggugacccucuaccugggcgucauggugcaggccgacagcgggugcgugaucaacuggaagggccgggagcugaagugcgggagcggcaucuucgucaccaacgaggugcacacguggaccgagcaguacaaguuccaggcggacuccccgaagcgccucagcgccgccaucggcaaggccugggaggagggggugugcggcauccgguccgccacccgccuggagaacaucauguggaagcagaucagcaacgagcugaaccacauccuccuggagaacgacaugaaguucaccgucguggugggggacgucgcgggcauccuggcccaggggaagaagaugauccggccccagcccauggaguacaaguacuccuggaaguccuggggcaaggccaagaucaucggcgccgacgugcagaacaccacguucaucaucgacgggcccaacaccccggagugccccgacgaccagcgcgcguggaacaucugggagguggaggacuacggcuucgggaucuucaccaccaacaucuggcucaagcugcgggacuccuacacgcaggucugcgaccaccgccugaugagcgccgccaucaaggacuccaaggccgugcacgccgacaugggcuacuggaucgagagcgagaagaacgagaccuggaagcucgcgcgggccuccuucaucgaggugaagaccugcaucuggcccaagagccacacccugugguccaacggcguccuggagagcgagaugaucauccccaagaucuacgggggcccgaucucccagcacaacuaccgccccggguacuucacgcagaccgccggccccuggcaccucgggaagcuggagcuggacuucgaccucugcgagggcaccaccgugguggucgacgagcacugcggcaaccgggggccgagccugcgcacgaccaccgugaccggcaagaucauccacgaguggugcugccgguccugcacgcugccgccccugcgcuucaagggggaggacggcugcugguacgggauggagauccggcccgugaaggagaaggaggagaaccuggucaagagcauggugagcgccggcuccggcgagguggacagcuucucccuggggcuccugugcaucagcaucaugaucgaggaggucaugcgcucccgguggagccgcaagaugcugaugaccggcacccucgccguguucuuccugcugaucauggggcagcucaccuggaacgaccugauccggcugugcaucauggugggcgcgaacgccuccgaccgcauggggaugggcacgaccuaccucgcccugauggccaccuucaagaugcgcccgauguucgccgucggccuccuguuccggcgccugaccagccgggaggugcugcuccugacgaucgggcugucccucguggcgagcgucgagcugcccaacucccuggaggagcucggcgacgggcuggccaugggcaucaugauccugaagcuccugaccgacuuccagagccaccagcugugggccacccuccugucccugaccuucaucaagacgaccuucagccuccacuacgccuggaagaccauggcgauggugcuguccaucgucagccuguucccccucugccuguccaccacgagccagaagaccaccuggcugcccgugcuccugggcucccuggggugcaagccgcucaccauguuccugaucgccgagaacaagaucuggggccgcaagagcuggccccugaacgaggggaucauggccgugggcaucgucagcauccuccuguccagccugcucaagaacgacgugccccuggccgggccccugaucgccggcggcaugcucaucgcgugcuacgugaucuccgggagcuccgccgaccugagccuggagaaggccgccgaggucuccugggaggaggaggccgagcacagcggcgcgucccacaacauccucguggaggugcaggacgacgggacgaugaagaucaaggacgaggagcgggacgacacccugaccauccugcucaaggccacccugcuggccgucagcggcguguacccgcucuccauccccgccacccuguucgugugguacuucuggcagaagaagaagcagcgcagcgggguccugugggacacgcccagcccgcccgagguggagcgggccgugcucgacgacggcaucuaccgcaucaugcagcggggccugcuggggcgcagccaggucggcguggggguguuccaggagaacgucuuccacaccauguggcacgugacccggggcgcggugcugauguaccaggggaagcgccucgagcccuccugggccagcgucaagaaggaccugaucuccuacggcggcggguggcggcugcagggcagcuggaacaccggggaggagguccaggugaucgccgucgagcccggcaagaaccccaagaacgugcagacggcccccgggaccuucaagaccuccgagggcgaggugggcgccaucgcgcucgacuucaagcccgggaccagcggcagccccaucgucaaccgcgaggggaagaucgugggccuguacggcaacgggguggucacgaccuccggcaccuacgugagcgccaucgcccaggccaaggcgucccaggacgggccccugccggagaucgaggacgagguguuccggaagcgcaaccucaccaucauggaccugcaccccggcagcgggaagacgcggcgcuaccugcccgccaucguccgggaggccaucaagcgcaagcuccggacccugauccuggccccgacccgcgugguggccuccgagauggcggaggcccucaagggcaugcccauccgcuaccagaccacggccgucaagagcgagcacaccggcaaggagaucguggaccugaugugccacgccaccuucaccaugcggcugcucucccccgugcgcguccccaacuacaacaugaucaucauggacgaggcccacuucacggacccgagcuccaucgcggcccggggguacaucagcacccgcgugggcaugggggaggccgccgccaucuucaugaccgcgacgccgcccggcuccguggaggccuucccccagagcaacgccgucauccaggacgaggagcgggacaucccggagcgcuccuggaacagcggguacgaguggaucacggacuuccccggcaagaccgugugguucgugcccuccaucaagagcggcaacgacaucgccaacugccugcggaagaacgggaagcgcgucauccagcugucccggaagaccuucgacaccgaguaccagaagacgaagaacaacgacugggacuacguggugaccaccgacaucagcgagaugggcgcgaacuuccgcgccgaccgggucaucgacccccgccggugccucaagccggugauccugaaggacgggcccgagcgcgugauccuggccggccccaugcccgucaccguggccuccgccgcgcagcggcgcgggcggaucggccgcaaccacaacaaggagggcgaccaguacaucuacauggggcagccgcucaacaacgacgaggaccacgcccacuggacggaggccaagaugcugcuggacaacaucaacacccccgagggcaucauccccgcccucuucgagcccgagcgggagaaguccgccgcgaucgacggggaguaccgccugcgcggcgaggcccggaagaccuucgucgagcugaugcgccgcggggaccucccgguguggcugagcuacaagguggccuccgagggcuuccaguacagcgaccgccgguggugcuucgacggcgagcgcaacaaccagguccuggaggagaacauggacguggagaucuggaccaaggagggggagcggaagaagcuccgcccccgguggcuggacgcccgcacguacuccgacccccuggcccuccgggaguucaaggaguucgcggccggccgccggagcguguccggggaccugauccuggagaucggcaagcucccccagcaccugacccagcgcgcccagaacgcccuggacaaccucgucaugcugcacaacagcgagcagggcgggcgggcguaccgccacgccauggaggagcugccggacaccaucgagacccucaugcugcuggcccucaucgccgugcugacgggcggggugacccuguucuuccucuccggccgggggcugggcaagaccagcaucggccugcucugcgucauggccuccagcgugcugcuguggauggcguccguggagccccacuggaucgccgccagcaucauccucgaguucuuccugaugguccugcucauccccgagcccgaccgccagcggaccccgcaggacaaccagcuggccuacguggugaucgggcuccucuucaugauccugaccgucgccgcgaacgagaugggccugcucgagacgaccaagaaggaccuggggaucggccacguggccguggagaaccaccaccacgccgccaugcuggacgucgaccuccaccccgccuccgcguggacccuguacgccguggccaccacgaucaucacccccaugaugcgccacaccaucgagaacaccacggccaacaucagccugaccgccaucgcgaaccaggccgccauccucauggggcuggacaagggcuggccgaucuccaagauggacaucggcgugccccugcucgcccuggggugcuacagccaggucaacccccugacccucaccgcggccgugcugaugcugguggcccacuacgccaucaucggccccgggcuccaggccaaggcgacgcgggaggcccagaagcgcaccgccgccggcaucaugaagaacccgaccgucgacgggaucguggccaucgaccuggaccccguggucuacgacgcgaaguucgagaagcagcugggccagaucaugcuccugauccugugcaccucccagauccuccugaugcgcacgaccugggcccugugcgagagcaucacccucgccaccggcccccugacgacccugugggaggggucccccggcaaguucuggaacaccaccaucgccgugagcauggccaacaucuuccgggggagcuaccucgcgggcgccggccuggccuucucccugaugaagucccucgggggcgggcgccggggcacgggggcccagggcgagacccugggcgagaaguggaagcgccagcugaaccagcucuccaagagcgaguucaacaccuacaagcgguccgggaucauggagguggaccgcagcgaggcgaaggagggccugaagcgcggggagaccacgaagcacgccgucucccgcggcaccgccaagcugcggugguucguggagcgcaaccucgugaagccggaggggaaggucaucgaccugggcugcggccgcggcggguggagcuacuacugcgccgggcugaagaaggugaccgaggugaagggguacaccaagggcggccccggccacgaggagcccauccccauggccacguacggguggaaccuggucaagcucaacuccggcaaggacguguucuucaucccgcccgagaagugcgacacccugcugugcgacaucggggagagcucccccaaccccaccaucgaggagggccgcacccuccgggugcugaagauggucgagccguggcugcgcgggaaccaguucugcaucaagauccucaaccccuacaugcccagcgugguggagacgcuggagcagaugcagcggaagcacggcggcaugcugguccgcaacccccucucccggaacagcacccacgagauguacuggguguccugcgggaccggcaacaucgugagcgcggucaacaugaccucccgcaugcugcugaaccgguucaccauggcccaccgcaagccgacguacgagcgcgacguggaccucggggccggcacccggcacguggccgucgagcccgagguggccaaccuggacaucaucggccagcgcaucgagaacaucaaguacgagcacaagagcaccuggcacuacgacgaggacaaccccuacaagaccugggcguaccacggguccuacgaggugaagcccagcggcagcgccuccagcauggucaacgggguggucaagcugcucacgaagccgugggacgugauccccauggugacccagaucgccaugaccgacaccacgcccuucggccagcagcgggucuucaaggagaagguggacacccgcacccccaaggccaagcgggggaccgcccagaucauggaggugacggcgaaguggcuguggggcuuccugucccgcaacaagaagccgcggaucugcacccgcgaggaguucacccggaagguccgcagcaacgccgccaucggcgccguguucguggacgagaaccaguggaacuccgcgaaggaggccgucgaggacgagcgguucugggaccucgugcaccgcgagcgggagcugcacaagcaggggaagugcgcgaccugcguguacaacaugaugggcaagcgcgagaagaagcugggggaguucggcaaggccaaggggagccgggccaucugguacauguggcucggcgcgcgcuuccuggaguucgaggcccugggcuucaugaacgaggaccacugguucucccgggagaacagccucuccggggucgagggcgaggggcugcacaagcugggcuacauccuccgcgacaucagcaagauccccgggggcaacauguacgccgacgacacggccggcugggacacccggaucaccgaggacgaccugcagaacgaggccaagaucaccgacaucauggagcccgagcacgcgcugcucgccaaguccaucuucaagcugacguaccagaacaagguggugcgcguccagcggccggccaagaacgggaccgugauggacgugaucagccgccgcgaccagcggggcuccgggcaggucggcaccuacggccugaacaccuucacgaacauggaggcccagcucauccgccagauggagagcgaggggaucuucucccccagcgagcuggagacccccaaccuggccggccgggugcucgacuggcuggagaagcacgggguggagcgccugaagcggauggcgaucuccggcgacgacugcgucgugaagcccaucgacgaccgcuucgccaccgcccucaccgcccugaacgacauggggaaggugcggaaggacaucccgcagugggagcccagcaagggcuggaacgacuggcagcagguccccuucugcagccaccacuuccaccagcugaucaugaaggacggccgcgagaucguggugcccugccggaaccaggacgagcucgucgggcgcgcccgggugucccagggcgcgggguggagccugcgcgagacggccugccugggcaaguccuacgcccagauguggcagcucauguacuuccaccggcgcgaccugcggcuggccgcgaacgccaucugcagcgccgugccggucgacugggugcccaccucccgcaccaccuggagcauccacgcccaccaccaguggaugacgaccgaggacaugcucuccguguggaaccgggucuggaucgaggagaaccccuggauggaggacaagacccacaucagcuccugggaggacgugcccuaccuggggaagcgcgaggaccaguggugcggcagccugaucggccucaccgcccgggcgacgugggccaccaacauccagguggccaucaaccagguccgccgccugaucgggaacgagaacuaccuggacuacaugaccuccaugaagcgguucaagaacgagagcgacccggagggcgcccucugguga

SEQ ID NO: 8517 - RNA, 9879 nt, Artificial Sequence
  derived and/or modified CDS sequence (opt1) from DENV-1__GQ199809__SS-prME
agcgugaccaugcugcucaugcugaugcccaccgcccuggccuuccaccucaccacccggggcggggagccccacaugaucgugaccaagcaggagcggggcaagagccugcuguucaagaccagcgcgggggugaacaugugcacccucaucgccauggaccugggggagcugugcgaggacaccaugaccuacaagugcccccggaucaccgaggccgagcccgacgacguggacugcuggugcaacgccaccgacaccugggugaccuacgggaccugcagccagaccggggagcaccggcgcgacaagcggagcguggcccucgcgccccacgugggccuggggcuggagacccgcaccgagaccuggauguccagcgagggcgccuggaagcagauccagcggguggagacgugggcccuccgccaccccggguucaccgugaucgcccuguuccuggcgcacgccaucggcaccuccaucacccagaaggggaucaucuucauccuccugaugcuggugacgcccagcauggccaugcggugcgucggcaucggcucccgcgacuucguggaggggcucagcggcgccaccuggguggacgucgugcuggagcacggguccugcgugaccaccauggccaaggacaagcccacgcuggacaucgagcuccugaagaccgaggucaccaaccccgcggugcugcggaagcucugcaucgaggccaagaucagcaacaccacgaccgacucccgcugccccacccagggcgaggccacccugauggaggagcaggacgccaacuucgugugccggcgcacguucgucgaccggggcugggggaacggcugcgggcuguucggcaaggggagccucaucacgugcgccaaguucaagugcgugaccaagcuggagggcaagaucgugcaguacgagaaccugaaguacuccgucaucgugaccgugcacacgggcgaccagcaccaggucgggaacgagagcaccgagcacggcaccaccgcgaccaucacgccccaggcccccaccuccgagauccagcucaccgacuacggggcccugacccuggacugcagcccccgcacgggccucgacuucaacgagauggugcugcugaccaugaaggagaaguccuggcucguccacaagcagugguuccuggaccugccgcuccccuggaccagcggggccagcaccucccaggagacguggaaccggcaggaccugcuggugaccuucaagaccgcccacgcgaagaagcaggagguggucgugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgugaugugcaccggguccuucaagcucgagaaggaggucgcggagacgcagcacggcaccgugcuggugcagaucaaguacgagggcaccgacgcccccugcaagauccccuucagcacccaggacgagaagggggucauccagaacggccggcugaucacggccaacccgaucgugaccgacaaggagaagcccgugaacaucgaggccgagccgcccuucggggaguccuacaucgucaucggcgugggcgagaaggcgcugaagcucagcugguucaagaagggguccagcaucggcaagauguucgaggccaccgcccgcggggcccggcgcauggccauccugggcgacaccgcgugggacuucggguccaucggcggcguguucacgagcgucgggaagcuggugcaccagaucuucggcaccgccuacgggguccuguucuccggcgucagcuggaccaugaagaucgggaucggcgugcugcugaccuggcucggccugaacucccgcagcacgucccugagcaugaccugcaucgccguggggcucgucacccuguaccugggcgugauggugcaggccgacuccgggugcgucaucaacuggaagggccgggagcucaagugcgggagcggcaucuucgugaccaacgaggugcacacguggaccgagcaguacaaguuccaggccgacagcccgaagcgccuguccgcggccaucggcaaggccugggaggagggggucugcggcauccggagcgugacccgccuggagaacaucauguggaagcagaucuccaacgagcucaaccacauccugcuggagaacgacaugaaguucaccguggucgugggggacguggucggcauccucgcccaggggaagaagaugauccggccccagcccauggagcacaaguacagcuggaaguccuggggcaaggccaagaucaucggcgcggacgugcagaacaccacguucaucaucgacgggcccaacaccccggagugccccgacgaccagcgcgccuggaacaucugggagguggaggacuacggcuucgggaucuucaccaccaacaucuggcugaagcugcgggacagcuacacgcaggccugcgaccaccgccucauguccgccgcgaucaaggacagcaaggccguccacgccgacaugggcuacuggaucgaguccgagaagaacgagaccuggaagcuggcccgggccagcuucaucgaggugaagaccugcaucuggcccaagucccacacccuguggagcaacggcgugcucgaguccgagauggucauccccaagaucuacgggggcccgaucagccagcacaacuaccgccccggguacuucacgcagaccgcgggccccuggcaccuggggaagcuggagcucgacuucgaccugugcgagggcaccaccgugguggucgacgagcacugcggcaaccgggggccgucccugcgcacgaccaccgugaccggcaagaucauccacgaguggugcugccggagcugcacgcugccgccccuccgcuucaagggggaggacggcugcugguacgggauggagauccggcccgugaaggagaaggaggagaaccuggucaaguccauggugagcgccggcagcggcgagguggacuccuucagccucgggcugcugugcaucuccaucaugaucgaggaggucaugcgcagccgguggucccgcaagaugcucaugaccggcacccuggccguguuccugcuccugaucauggggcagcugaccuggaacgaccucauccggcugugcaucauggugggcgccaacgccagcgaccgcauggggaugggcacgaccuaccuggcgcucauggccaccuucaagaugcgcccgauguucgccgucggccugcuguuccggcgccucaccucccgggaggugcugcugcucacgaucgggcugagccuggucgccuccguggagcuccccaacagccuggaggagcugggcgacgggcucgccaugggcaucaugauccugaagcugcucaccgacuuccagucccaccagcugugggcgacccugcucagccugaccuucaucaagacgacccugucccuccacuacgccuggaagaccauggccauggugcugagcaucgucucccuguucccccucugccugagcaccacgucccagaagaccaccuggcugcccgugcuccugggcagccuggggugcaagccgcucaccauguuccugaucgccgagaacaagaucuggggccgcaaguccuggccccugaacgaggggaucauggcggugggcgucgugagcauccuccugagcucccugcucaagaacgacgugccccuggccgggccccugaucgccggcggcaugcucaucgccugcuacgucaucagcggguccagcgccgaccugucccuggagaaggcggccgaggugagcugggaggaggaggccgagcacuccggcgccagccacaacauccucguggagguccaggacgacgggacgaugaagaucaaggacgaggagcgggacgacacccugaccauccugcucaaggccacccugcuggcgguguccggcguguacccgcucagcauccccgccacccuguucgucugguacuucuggcagaagaagaagcagcgcuccggggugcugugggacacgcccagcccgcccgagguggagcgggccguccuggacgacggcaucuaccgcaucaugcagcggggccuccuggggcgcucccaggugggcgugggggucuuccaggagaacguguuccacaccauguggcacgugacccggggcgccguccugauguaccaggggaagcgccucgagcccagcugggccuccgugaagaaggaccugaucagcuacggcggcggguggcggcugcagggcuccuggaacaccggggaggaggugcaggucaucgcgguggagcccggcaagaaccccaagaacgugcagacggcccccgggaccuucaagacccccgagggcgaggucggcgccaucgcccucgacuucaagcccgggaccagcggcucccccaucgugaaccgcgaggggaagaucgugggccuguacggcaacggggucgugacgaccagcggcaccuacgugagcgccaucgcgcaggccaaggccucccaggaggggccgcugcccgagaucgaggacgaggucuuccggaagcgcaaccucaccaucauggaccugcaccccggcagcgggaagacgcggcgcuaccugccggccaucgugcgggaggcgaucaagcgcaagcuccggacccugauccuggcccccacccgcguggucgccuccgagauggccgaggcccucaagggcaugcccauccgcuaccagaccacggcggucaagagcgagcacaccggcaaggagaucguggaccugaugugccacgccaccuucaccaugcggcugcucucccccguccgcgugccgaacuacaacaugaucaucauggacgaggcccacuucacggaccccagcuccaucgccgcccggggguacaucagcacccgcgugggcaugggggaggcggccgccaucuucaugaccgccacgccgcccggcuccgucgaggccuucccgcagagcaacgcggugauccaggacgaggagcgggacauccccgagcgcuccuggaacagcggguacgaguggaucacggacuuccccggcaagaccgugugguucguccccuccaucaagagcggcaacgacaucgccaacugccugcggaagaacgggaagcgcgugauccagcugucccggaagaccuucgacaccgaguaccagaagacgaagaacaacgacugggacuacguggucaccaccgacaucagcgagaugggcgccaacuuccgcgccgaccgggugaucgacccgcgccggugccucaagcccgucauccugaaggacgggcccgagcgcgugauccuggcgggccccaugccggugaccgucgccuccgccgcccagcggcgcgggcggaucggccgcaaccacaacaaggagggcgaccaguacaucuacauggggcagccccucaacaacgacgaggaccacgcccacuggacggaggcgaagaugcugcuggacaacaucaacacccccgagggcaucauccccgcccucuucgagccggagcgggagaaguccgccgccaucgacggggaguaccgccugcgcggcgaggcccggaagaccuucguggagcugaugcgccgcggggaccuccccguguggcuguccuacaaggucgcgagcgagggcuuccaguacagcgaccgccgguggugcuucgacggcgagcgcaacaaccaggugcuggaggagaacauggacguggagaucuggaccaaggagggggagcggaagaagcuccgcccccgguggcuggacgcccgcacguacuccgacccccuggcccuccgggaguucaaggaguucgccgccggccgccggagcgucuccggggaccugauccuggagaucggcaagcucccgcagcaccugacccagcgcgcgcagaacgcccuggacaaccucgugaugcugcacaacagcgagcagggcgggcgggccuaccgccacgccauggaggagcugcccgacaccaucgagacccucaugcugcuggcgcucaucgccgugcugacgggcggggucacccuguucuuccucuccggccgggggcugggcaagaccagcaucggccugcucugcgugauggccuccagcgugcugcuguggauggccuccgucgagccccacuggaucgccgcgagcaucauccucgaguucuuccugauggugcugcucauccccgagccggaccgccagcggacgccccaggacaaccagcuggccuacguggucaucgggcuccucuucaugauccugaccguggccgccaacgagaugggccugcucgagacgaccaagaaggaccuggggaucggccacguggccgucgagaaccaccaccacgcgaccaugcuggacguggaccuccaccccgccuccgccuggacccuguacgccguggccacgaccaucaucaccccgaugaugcgccacaccaucgagaacacgaccgcgaacaucagccugaccgccaucgccaaccaggccgccauccucauggggcuggacaagggcuggcccaucuccaagauggacaucggcgucccccugcucgcgcuggggugcuacagccaggugaacccccugacccucacggccgccgugcugaugcuggucgcccacuacgcgaucaucggcccggggcuccaggccaaggccacccgggaggcccagaagcgcaccgccgcgggcaucaugaagaaccccaccguggacgggaucguggccaucgaccuggaccccgucguguacgacgccaaguucgagaagcagcugggccagaucaugcuccugauccugugcacgucccagauccuccugaugcgcaccaccugggcccugugcgagagcaucacccucgccacgggcccccugaccacccugugggagggguccccgggcaaguucuggaacaccacgaucgcggugagcauggccaacaucuuccggggguccuaccucgccggcgccggccuggccuucagccugaugaagucccucgggggcgggcgccggggcaccggggcgcagggcgagacccugggcgagaaguggaagcgccagcugaaccagcucuccaagagcgaguucaacaucuacaagcgguccgggaucauggaggucgaccgcagcgaggccaaggagggccugaagcgcggggagaccacgcgccacgccgugucccggggcaccgccaagcugcgcugguucguggagcggaaccuggucaagcccgaggggaaggugaucgaccucggcugcggccgcgggggcuggagcuacuacugcgcggggcugaagaaggugaccgaggucaagggcuacaccaagggcgggcccggccacgaggagcccaucccgauggccacguacggguggaaccuggugaagcuccacuccggcaaggacguguucuucacgccgcccgagaagugcgacacccugcugugcgacaucggggagagcucccccaacccgaccaucgaggagggccggacgcuccgcguccugaagaugguggagcccuggcugcgggggaaccaguucugcaucaagauccucaaccccuacaugcccagcguggucgagacccuggagcagaugcagcgcaagcacggcggcaugcuggugcggaacccgcucucccgcaacagcacccacgagauguacuggguguccugcgggaccggcaacaucgucagcgccgugaacaugaccucccggaugcugcugaaccgcuucacgauggcccaccgcaagcccaccuacgagcgggacguggaccucggggccggcacccgccacgucgcgguggagcccgaggucgccaaccuggacaucaucggccagcggaucgagaacaucaagcacgagcacaagagcaccuggcacuacgacgaggacaaccccuacaagacgugggccuaccacggguccuacgaggugaagccgagcggcuccgccagcagcauggugaacggggucgugaagcugcucaccaagcccugggacgugauccccauggucacccagaucgccaugaccgacacgacccccuucggccagcagcgcguguucaaggagaagguggacacccggaccccgaaggcgaagcgcgggacggcccagaucauggaggucaccgcccgguggcuguggggcuuccugucccgcaacaagaagccccggaucugcacccgcgaggaguucacccggaaggugcgcagcaacgccgccaucggcgcgguguucgucgacgagaaccaguggaacuccgccaaggaggccguggaggacgagcgguucugggaccucgugcagaaggagcgcgagcugcacaagcaggggaagugcgccacgugcgucuacaacaugaugggcaagcgggagaagaagcugggggaguucggcaaggcgaaggggagccgcgccaucugguacauguggcucggcgcccgguuccuggaguucgaggcccugggcuucaugaacgaggaccacugguucucccgcgagaacagccucuccgggguggagggcgaggggcugcacaagcugggcuacauccuccgggacaucagcaagauccccgggggcaacauguacgccgacgacaccgcgggcugggacacccgcaucaccgaggacgaccugcagaacgaggccaagaucacggacaucauggagccggagcacgcccugcucgccaccuccaucuucaagcugaccuaccagaacaaggugguccgggugcagcgccccgccaagaacgggaccgugauggacgucaucagccgccgggaccagcgcggcuccggccaggugggcacguacggccugaacaccuucaccaacauggaggcgcagcucauccggcagauggagagcgaggggaucuuccugcccuccgagcuggagacccccaaccucgccgagcgcgugcuggacuggcuggagaagcacggcgucgagcggcucaagcgcauggccaucagcggggacgacugcguggugaagccgaucgacgaccgguucgccacggcccugaccgcgcugaacgacaugggcaagguccgcaaggacaucccccagugggagcccuccaagggguggaacgacuggcagcagguccccuucugcagccaccacuuccaccagcucaucaugaaggacggccgggagaucguggucccgugccgcaaccaggacgagcuggugggccgggcccgcgugucccagggggccggcuggagccugcgggagaccgccugccucggcaagagcuacgcccagauguggcagcugauguacuuccaccgccgggaccugcgccucgcggccaacgccaacugcuccgccguccccguggacugggugcccaccagccggacgaccugguccauccacgcgcaccaccaguggaugaccaccgaggacaugcugagcgucuggaaccgcguguggaucgaggagaaccccuggauggaggacaagacgcacguguccagcuggggcgacgucccguaccuggggaagcgggaggaccaguggugcggcucccucaucggccugaccgcccgcgccaccugggccagcaacauccagguggccaucaaccaggugcgccggcugaucgggaacgagaacuaccucgacuacaugaccuccaugaagcgcuucaagaacgagggcgaccccgagggggcgcugugguga

SEQ ID NO: 8518 - RNA, 9879 nt, Artificial Sequence
  derived and/or modified CDS sequence (opt1) from DENV-1__GQ199810__SS-prME
agcgugaccaugcugcugaugcugaugcccaccgcccuggccuuccaccucaccacccggggcggggagccccacaugaucgucagcaagcaggagcggggcaagagccugcuguucaagaccuccgccggggugaacaugugcacccucaucgccauggaccugggcgagcugugcgaggacaccaugaccuacaagugcccccggaucaccgagaccgagcccgacgacguggacugcuggugcaacgccacggacaccugggucaccuacgggaccugcagccagacgggcgagcaccggcgggacaagcgguccguggcccucgcgccccacgugggccuggggcuggagacccgcaccgagaccuggaugagcuccgagggcgcguggaagcagauccagcgggucgagacgugggcccuccggcaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagguggccgagacccagcacggcaccgugcugguccagaucaaguacgagggcaccgacgcgcccugcaagauccccuuccugacgcaggacgagaagggggugacccagaacggccggcugaucaccgccaacccgaucgugaccgacaaggagaagcccgucaacaucgaggccgagccgcccuucggggagagcuacaucaucaucggcgccggcgagaaggcgcucaagcuguccugguucaagaaggggagcuccaucggcaagauguucgaggccacggcccgcggggcccggcgcauggccauccugggcgacaccgcgugggacuucgggagcaucggcggcguguucaccuccguggggaagcucguccaccagaucuucggcaccgccuacggggugcuguucagcggcguguccuggacgaugaagaucgggaucggcguccugcucaccuggcugggccugaacagccgcuccaccagccucuccaugaccugcaucgccguggggcuggugacgcuguaccucggcgucauggugcaggccgacagcgggugcgugaucaacuggaagggccgggagcugaagugcggguccggcaucuucgucaccaacgaggugcacaccuggaccgagcaguacaaguuccaggccgacagcccgaagcgccugagcgcggccaucggcaaggccugggaggagggggugugcggcauccgguccgccacccgccucgagaacaucauguggaagcagaucagcaacgagcugaaccacauccugcucgagaacgacaugaaguucacggucguggugggggacgucgccggcauccuggcgcaggggaagaagaugauccggccccagcccauggaguacaaguacuccuggaaguccuggggcaaggccaagaucaucggcgccgacgugcagaacaccaccuucaucaucgacgggcccaacaccccggagugccccgacgaccagcgcgccuggaacaucugggagguggaggacuacggcuucgggaucuucacgaccaacaucuggcugaagcuccgggacucccacacccaggucugcgaccaccgccugaugagcgcggccaucaaggacuccaaggccgugcacgccgacaugggcuacuggaucgagagcgagaagaacgagaccuggaagcuggcccgggcguccuucaucgaggugaagacgugcaucuggcccaagagccacacccucugguccaacggcguccuggagagcgagaugaucauccccaagaucuacgggggcccgaucucccagcacaacuaccgccccggguacuucacccagaccgccggccccuggcaccuggggaagcucgagcuggacuucgaccugugcgagggcacgaccgugguggucgacgagcacugcggcaaccgggggccgagccuccgcaccaccacggugaccggcaagaucauccacgaguggugcugccgguccugcacccugccgccccugcgcuuccgcggggaggacggcugcugguacgggauggagauccgccccgugaaggagaaggaggagaaccucgucaagagcaugguguccgccggcagcggcgagguggacagcuucucccuggggcugcucugcaucagcaucaugaucgaggaggucaugcggucccgcuggagccggaagaugcugaugaccggcacgcuggccguguucuuccuccugaucauggggcagcugaccuggaacgaccucauccgccugugcaucauggugggcgccaacgcguccgaccgcauggggaugggcaccaccuaccuggcccucauggccacguucaagaugcggccgauguucgccgucggccugcuguuccgccggcucaccagccgcgaggugcugcugcucaccaucgggcugucccugguggccagcgucgagcuccccaacucccuggaggagcugggcgacgggcucgcgaugggcaucaugauccugaagcugcucaccgacuuccagagccaccagcugugggccacgcugcucucccugaccuucaucaagaccaccuucagccugcacuacgccuggaagacgauggccauggugcucuccaucgucagccuguucccccugugccucuccaccaccagccagaagaccacguggcugcccgugcugcucggcucccuggggugcaagccgcugaccauguuccucaucgcggagaacaagaucuggggccggcgcagcuggccccugaacgaggggaucauggccgugggcaucgucuccauccugcucagcagccugcugaagaacgacgugccccucgccgggccccugaucgccggcggcaugcugaucgccugcuacgugaucuccgggagcuccgcggaccucagccuggagaaggccgccgaggucuccugggaggaggagguggagcacagcggcgccucccacaacauccugguggagguccaggacgacgggaccaugaagaucaaggacgaggagcgggacgacacccucaccauccugcugaaggccacgcuccuggcggugagcggcguguacccgcuguccauccccgccacccucuucgucugguacuucuggcagaagaagaagcagcgcagcggggugcugugggacacccccagcccgcccgagguggagcgggccguccuggacgacggcaucuaccgcaucaugcagcggggccugcucgggcgcagccaggugggcgugggggucuuccaggagaacguguuccacaccauguggcacgugacgcggggcgccguccugauguaccaggggaagcgccuggagcccuccugggccagcgugaagaaggaccucaucuccuacggcggcggguggcggcugcagggcagcuggaacaccggggaggaggugcaggucaucgcgguggagcccggcaagaaccccaagaacgugcagaccgcccccgggaccuucaagacgcccgagggcgaggucggcgccaucgcccuggacuucaagcccgggaccuccggcagccccaucgugaaccgcgaggggaagaucgugggccucuacggcaacggggucgugaccaccuccggcacguacgugagcgccaucgcgcaggccaaggccagccaggaggggccgcugcccgagaucgaggacgaggucuuccggaagcgcaaccugaccaucauggaccuccaccccggcuccgggaagacccggcgcuaccugccggccaucgugcgggaggcgaucaagcgcaagcugcgcacccucauccuggcccccacgcggguggucgccagcgagauggccgaggcccugaagggcaugcccauccgcuaccagaccaccgcggugaaguccgagcacaccggcaaggagaucguggaccucaugugccacgccacguucaccaugcggcugcugagccccguccgcgugccgaacuacaacaugaucaucauggacgaggcccacuucaccgaccccuccagcaucgccgcccggggguacaucuccacccgcgugggcaugggggaggcggccgccaucuucaugacggccacgccgcccggcagcgucgaggccuucccgcaguccaacgcggugauccaggacgaggagcgggacauccccgagcgcagcuggaacuccggguacgaguggaucaccgacuuccccggcaagaccgugugguucguccccagcaucaaguccggcaacgacaucgccaacugccuccggaagaacgggaagcgcgugauccagcugagccggaagacguucgacaccgaguaccagaagaccaagaacaacgacugggacuacguggucaccacggacaucuccgagaugggcgccaacuuccgcgccgaccgggugaucgacccgcgccggugccugaagcccgugauccucaaggacgggcccgagcgcgucauccuggcgggccccaugccggugaccgucgccagcgccgcccagcggcgcgggcggaucggccgcaaccacaacaaggagggcgaccaguacaucuacauggggcagccccugaacaacgacgaggaccacgcccacuggaccgaggcgaagaugcuccuggacaacaucaacacccccgagggcaucauccccgcccuguucgagccggagcgcgagaaguccgccgccaucgacggggaguaccggcuccgcggcgaggcccggaagacguucguggagcugaugcgccgcggggaccugcccguguggcucagcuacaaggucgcguccgagggcuuccaguacagcgaccgccgguggugcuucgacggcgagcgcaacaaccaggugcuggaggagaacauggacguggagaucuggaccaaggagggggagcggaagaagcugcgcccccgguggcucgacgcccgcaccuacagcgacccccuggcccugcgggaguucaaggaguucgccgccggccgccgguccgucagcggggaccucauccuggagaucggcaagcugccgcagcaccucacccagcgcgcgcagaacgcccuggacaaccuggugaugcuccacaacuccgagcagggcgggcgggccuaccgccacgccauggaggagcugcccgacacgaucgagacccugaugcuccuggcgcugaucgccgugcucaccggcggggucacccuguucuuccugagcggccgggggcucggcaagaccuccaucggccugcugugcgugauggccagcuccgugcuccuguggauggccagcgucgagccccacuggaucgccgcguccaucauccuggaguucuuccucauggugcugcugauccccgagccggaccgccagcggacgccccaggacaaccagcucgccuacguggucaucgggcugcuguucaugauccucaccguggccgccaacgagaugggccugcuggagaccaccaagaaggaccucgggaucggccacguggccgucgagaaccaccaccacgcggccaugcuggacguggaccugcaccccgccagcgccuggacgcucuacgccguggcgaccaccaucaucaccccgaugaugcgccacacgaucgagaacaccaccgccaacaucucccugaccgccaucgccaaccaggccgcgauccugauggggcucgacaagggcuggcccaucagcaagauggacaucggcgucccccugcuggcccucgggugcuacucccaggugaacccccugacgcugaccgccgccgugcucaugcuggucgcgcacuacgccaucaucggcccggggcugcaggccaaggccacccgcgaggcccagaagcggaccgcggccggcaucaugaagaaccccacgguggacgggaucguggccaucgaccucgaccccgucguguacgacgccaaguucgagaagcagcugggccagaucaugcugcucauccugugcaccagccagauccugcucaugcgcaccaccugggcccugugcgaguccaucacgcuggcgaccggcccccucaccacccugugggaggggagcccgggcaaguucuggaacacgaccaucgccguguccauggccaacaucuuccgggggagcuaccuggccggcgccggccucgcguucucccugaugaagucccucgggggcgggcgccgggggaccggggcccagggcgagacccucggcgagaaguggaagcgccagcugaaccagcugagcaaguccgaguucaacacguacaagcggagcgggaucauggaggucgaccgcuccgaggccaaggagggccucaagcgcggggagaccaccaagcacgccgugagccgcggcaccgcgaagcugcggugguucguggagcgcaaccuggucaagcccgaggggaaggugaucgaccugggcugcggccgcggcgggugguccuacuacugcgccgggcucaagaaggugacggaggucaagggguacaccaagggcggccccggccacgaggagcccaucccgauggccaccuacggguggaaccuggugaagcugcacagcggcaaggacguguucuucaucccgcccgagaagugcgacacccuccugugcgacaucggggaguccagccccaacccgacgaucgaggagggccgcacccugcggguccucaagaugguggagcccuggcugcgcgggaaccaguucugcaucaagauccugaaccccuacaugcccuccguggucgagacccucgagcagaugcagcggaagcacggcggcaugcuggugcgcaacccgcugagccggaacuccacccacgagauguacugggugagcugcgggaccggcaacaucgucuccgccgugaacaugacgagccgcaugcuccugaaccgcuucaccauggcccaccggaagcccaccuacgagcgcgacguggaccugggggcgggcacccggcacgucgccguggagcccgagaucgccaaccucgacaucaucggccagcgcaucgagaacaucaagcacgagcacaaguccacguggcacuacgacgaggacaaccccuacaagaccugggccuaccacgggagcuacgaggugaagccguccggcagcgccuccagcauggucaacgggguggucaagcugcugaccaagcccugggacgugauccccauggugacccagaucgcgaugacggacaccacccccuucggccagcagcgggucuucaaggagaagguggacacccgcacgccgaaggccaagcgggggaccgcccagaucauggaggugaccgccaaguggcucuggggcuuccugagccgcaacaagaagccccggaucugcacccgcgaggaguucacgcggaagguccgcuccaacgccgcgaucggcgccguguucguggacgagaaccaguggaacagcgccaaggaggccgucgaggacgagcgguucugggaccuggugcaccgcgagcgggagcuccacaagcaggggaagugcgcgaccugcguguacaacaugaugggcaagcgcgagaagaagcugggggaguucggcaaggccaaggggucccgggccaucugguacauguggcugggcgcccgcuuccucgaguucgaggcccugggcuucaugaacgaggaccacugguucagccgggagaacucccugagcggggucgagggcgaggggcuccacaagcugggcuacauccugcgcgacaucuccaagauccccgggggcaacauguacgcggacgacaccgccggcugggacacccggaucacggaggacgaccuccagaacgaggcccgcaucaccgacaucauggagccggagcacgcccugcuggccaagagcaucuucaagcucaccuaccagaacaagguggugcgcguccagcggcccgcgaagaacgggaccgugauggacgugaucucccgccgggaccagcgcggcagcgggcaggucggcacguacggccugaacaccuucaccaacauggaggcccagcugauccggcagauggaguccgaggggaucuucagccccuccgagcucgagacccccaaccuggccgagcgcgugcuggacuggcucgagaaguacggcguggagcggcugaagcgcauggccaucagcggggacgacugcgucgugaagccgaucgacgaccgguucgccacggcgcugaccgcccucaacgacaugggcaaggugcgcaaggacaucccccagugggagcccuccaagggguggaacgacuggcagcagguccccuucugcagccaccacuuccaccagcugaucaugaaggacggccgggagaucguggugccgugccgcaaccaggacgagcuggucggccgggcccgcgugucccagggggccggcuggagccuccgggagaccgccugccugggcaagagcuacgcgcagauguggcagcugauguacuuccaccgccgggaccuccgccuggccgccaacgccaucugcuccgcggugcccgucgacuggauccccaccagccggacgaccugguccauccacgcccaccaccaguggaugaccaccgaggacaugcugagcguguggaaccgcguguggaucgaggagaaccccuggauggaggacaagacgcacaucuccagcuggggcgacgucccguaccucgggaagcgcgaggaccaguggugcggcucccugaucggccugaccgcccgggccaccugggccaccaacauccagguggcgaucaaccaggugcgccggcucaucgggaacgagaacuaccuggacuacaugaccagcaugaagcgcuucaagaacgagggcgaccccgagggggcccugugguga

SEQ ID NO: 8519 - RNA, 9879 nt, Artificial Sequence
  derived and/or modified CDS sequence (opt1) from DENV-1__GQ199811__SS-prME
agcgugaccaugcugcugaugcugaugcccaccgcccuggccuuccaccucacgacccgcggcggggagccccacaugaucgugagcaagcaggagcggggcaagagccugcuguucaagaccagcgccggggugaacaugugcacccucaucgccauggaccugggcgaguucugcgaggacaccaugaccuacaagugcccccgcaucaccgaggccgagcccgacgacguggacugcuggugcaacgccaccgacacgugggugaccuacgggaccugcagccagaccggcgagcaccggcgcgacaagcgguccguggcccuggcgccccacgugggccucgggcuggagacgcgcaccgagaccuggaugagcuccgagggcgccuggaagcagauccagcgggucgagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugcccgacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaagaucguccaguacgagaaccugaaguacagcgugaucgugaccguccacaccggcgaccagcaccagguggggaacgaguccacggagcacggcaccaccgcgaccaucacgccccaggcccccagcacggagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccagcggggccuccaccagccaggagaccuggaaccggcaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcauguccuacgucaugugcaccgggagcuucaagcuggagaaggagguggcggagacccagcacggcacggugcucguccagaucaaguacgagggcaccgacgcccccugcaagauccccuucuccacccaggacgagaagggggugacccagaacggccggcugaucacggccaacccgaucgugaccgacaaggagaagcccgucaacaucgaggccgagccgcccuucggggagagcuacaucgugaucggcgcgggcgagaaggcccugaagcuguccugguucaagaaggggagcuccaucggcaagauguucgaggccaccgcccgcggggcccggcgcauggcgauccucggcgacaccgccugggacuucgggagcaucggcggcguguucacguccgucgggaagcuggugcaccagaucuucggcaccgccuacggggugcuguucagcggcgucuccuggaccaugaagaucgggaucggcgugcuccugaccuggcugggccucaacagccgcuccacgagccuguccaugaccugcaucgccguggggcuggucacccucuaccugggcgugauggugcaggccgacagcgggugcgucaucaacuggaagggccgggagcugaagugcgggagcggcaucuucgugaccaacgaggugcacacguggaccgagcaguacaaguuccaggcggacuccccgaagcgccucagcgccgccaucggcaaggccugggaggagggggucugcggcauccgguccgccacccgccuggagaacaucauguggaagcagaucagcaacgagcugaacuacauccuccuggagaacgacaugaagcugaccgugguggucggggacguggcgggcauccucgcccaggggaagaagaugauccggccccagcccauggaguacaaguacuccuggaaguccuggggcaaggccaagaucaucggcgccgacgugcagaacaccacguucaucaucgacgggcccaacaccccggagugccccgacgaccagcgcgcguggaacaucugggaggucgaggacuacggcuucgggaucuucaccaccaacaucuggcugaagcugcgggacuccuacacccaggugugcgaccaccgccucaugagcgccgccaucaaggacuccaaggccgugcacgccgacaugggcuacuggaucgagagcgagaagaacgagaccuggaagcuggcgcgggccuccuucaucgaggucaagaccugcaucuggcccaagagccacacccugugguccaacggcgugcucgagagcgagaugaucauccccaagaucuacgggggcccgaucucccagcacaacuaccgccccggguacuucacgcagaccgccggccccuggcaccuggggaagcuggagcucgacuucgaccugugcgagggcaccaccguggucguggacgagcacugcggcaaccgggggccgagccugcgcacgaccaccgugaccggcaagaucauccacgaguggugcugccgguccugcacgcugccgccccuccgcuucaagggggaggacggcugcugguacgggauggagauccggcccgucaaggagaaggaggagaaccuggucaagagcauggugagcgccggcuccggcgaggucgacagcuucucccucgggcugcugugcaucagcaucaugaucgaggaggugaugcgcucccgguggagccgcaagaugcucaugaccggcacccuggccguguucuuccugcucaucauggggcagcugaccuggaacgaccugauccggcucugcaucauggucggcgcgaacgccuccgaccgcauggggaugggcacgaccuaccuggcccugauggccaccuucaagaugcgcccgauguucgccgugggccuccuguuccggcgccugaccagccgggaggugcuccugcugacgaucgggcucucccuggucgcgagcguggagcugcccaacucccucgaggagcugggcgacgggcuggccaugggcaucaugauccucaagcugcugaccgacuuccagagccaccagcucugggccacccugcugucccucaccuucguccgcacgaccuucagccugcacuacgccuggaagaccauggcgauggugcuguccaucgugagccucuucccccugugccuguccaccacgagccagaagaccaccuggcuccccguccugcugggcucccucgggugcaagccgcugaccauguuccugaucgccgagaacaagaucuggggccgcaagagcuggccccucaacgaggggaucauggccgugggcaucgugagcauccugcuguccagccuccugaagaacgacgucccccuggccgggccccucaucgccggcggcaugcugaucgcgugcuacgugaucuccgggagcuccgccgaccugagccucgagaaggccgccguggucuccugggaggaggaggccgagcacagcggcgcgucccacaacauccugguggaggugcaggacgacgggacgaugaagaucaaggacgaggagcgcgacgacacccugaccauccuccugaaggccacccugcucgccgucagcggcguguacccgcuguccauccccgccacccuguucgugugguacuucuggcagaagaagaagcagcggagcgggguccucugggacacgcccagcccgcccgagguggagcgcgccgugcuggacgacggcaucuaccggaucaugcagcgcggccugcuggggcggagccaggucggcguggggguguuccaggagaacgucuuccacaccauguggcacgugacccgcggcgcggugcucauguaccaggggaagcggcuggagcccuccugggccagcgucaagaaggaccugaucuccuacggcggcggguggcgccuccagggcagcuggaacaccggggaggagguccaggugaucgccgucgagcccggcaagaaccccaagaacgugcagacggcccccgggaccuucaagaccuccgagggcgaggugggcgccaucgcgcuggacuucaagcccgggaccagcggcagccccaucgucaaccgggaggggaagaucgugggccuguacggcaacgggguggucacgaccuccggcaccuacgugagcgccaucgcccaggccaaggcgucccaggaggggccccucccggagaucgaggacgagguguuccgcaagcggaaccugaccaucauggaccugcaccccggcagcgggaagacgcgccgguaccuccccgccaucguccgcgaggccaucaagcggaagcugcgcacccugauccucgccccgacccgcgugguggccuccgagauggcggaggcccugaagggcaugcccauccgguaccagaccacggccgucaagagcgagcacaccggcaaggagaucguggaccugaugugccacgccaccuucaccaugcgccuccugucccccgugcggguccccaacuacaacaugaucaucauggacgaggcccacuucacggacccgagcuccaucgcggcccgcggguacaucagcacccgggugggcaugggggaggccgccgccaucuucaugaccgcgacgccgcccggcuccguggaggccuucccccagagcaacgccgucauccaggacgaggagcgcgacaucccggagcgguccuggaacagcggguacgaguggaucacggacuuccccggcaagaccgugugguucgugcccuccaucaagagcggcaacgacaucgccaacugccugcgcaagaacgggaagcgggucauccagcucucccgcaagaccuucgacaccgaguaccagaagacgaagaacaacgacugggacuacguggugaccaccgacaucagcgagaugggcgcgaacuuccgggccgaccgcgucaucgacccccggcgcugccugaagccggugauccugaaggacgggcccgagcgggucauccucgccggccccaugcccgugaccguggccuccgccgcgcagcgccgggggcgcaucggccggaaccacaacaaggagggcgaccaguacaucuacauggggcagccgcugaacaacgacgaggaccacgcccacuggacggaggccaagaugcugcucgacaacaucaacacccccgagggcaucauccccgcccuguucgagcccgagcgcgagaaguccgccgcgaucgacggggaguaccgccugcggggcgaggcccgcaagaccuucgucgagcucaugcggcgcggggaccugccgguguggcugagcuacaagguggccuccgagggcuuccaguacagcgaccggcgcuggugcuucgacggcgagcggaacaaccagguccucgaggagaacauggacguggagaucuggaccaaggagggggagcgcaagaagcugcggccccgcuggcuggacgcccggacguacuccgacccccucgcccugcgcgaguucaaggaguucgcggccggccggcgcagcguguccggggaccugauccucgagaucggcaagcugccccagcaccugacccagcgggcccagaacgcccucgacaaccuggucaugcugcacaacagcgagcagggcgggcgcgcguaccggcacgccauggaggagcucccggacaccaucgagacccugaugcugcucgcccugaucgccgugcugacgggcggggugacccucuucuuccuguccggccgcgggcugggcaagaccagcaucggccuccugugcgucauggccuccagcgugcugcucuggauggcguccguggagccccacuggaucgccgccagcaucauccuggaguucuuccugaugguccuccugauccccgagcccgaccggcagcgcaccccgcaggacaaccagcuggccuacguggugaucgggcuccuguucaugauccugaccgucgccgcgaacgagaugggccuccuggagacgaccaagaaggaccuggggaucggccacguggccguggagaaccaccaccacgccgccaugcucgacgucgaccugcaccccgccuccgcguggacccuguacgccguggccaccacgaucaucacccccaugaugcggcacaccaucgagaacaccacggccaacaucagccucaccgccaucgcgaaccaggccgccauccugauggggcuggacaagggcuggccgaucuccaagauggacaucggcgugccccuccuggcccuggggugcuacagccaggucaacccccucacccugaccgcggccgugcugaugcucguggcccacuacgccaucaucggccccgggcugcaggccaaggcgacgcgcgaggcccagaagcgcaccgccgccggcaucaugaagaacccgaccgucgacgggaucguggccaucgaccuggaccccguggucuacgacgcgaaguucgagaagcagcucggccagaucaugcugcugauccucugcaccucccagauccugcugaugcggacgaccugggcccucugcgagagcaucacccuggccaccggcccccugacgacccucugggaggggucccccggcaaguucuggaacaccaccaucgccgugagcauggccaacaucuuccgcgggagcuaccuggcgggcgccggccuggccuucucccucaugaagucccucgggggcgggcggcgcgggacgggggcccagggcgagacccugggcgagaaguggaagcggcagcucaaccagcuguccaagagcgaguucaacaccuacaagcgcuccgggaucauggagguggaccggagcgaggcgaaggagggccugaagcgcggggagaccacgaagcacgccgucucccggggcaccgccaagcuccgcugguucguggagcggaaccuggugaagccggaggggaaggucaucgaccugggcugcggccgcgggggcuggagcuacuacugcgccgggcugaagaaggugaccgaggugaagggcuacaccaagggcgggcccggccacgaggagcccauccccauggccacguacggguggaaccucgucaagcugcacuccggcaaggacguguucuucaucccgcccgagaagugcgacacccugcucugcgacaucggggagagcucccccaaccccaccaucgaggagggccggacccugcgcgugcugaagauggucgagccguggcuccgggggaaccaguucugcaucaagauccugaaccccuacaugcccagcgugguggagacgcuggagcagaugcagcgcaagcacggcggcaugcucguccggaacccccugucccgcaacagcacccacgagauguacuggguguccugcgggaccggcaacaucgugagcgcggucaacaugaccucccggaugcugcucaaccgcuucaccauggcccaccgcaagccgacguacgagcgggacguggaccugggggccggcacccgccacguggccgucgagcccgagguggccaaccuggacaucaucggccagcggaucgagaacaucaagcacgagcacaagagcaccuggcacuacgacgaggacaaccccuacaagaccugggcguaccacggguccuacgaggucaagcccagcggcagcgccuccagcauggugaacgggguggucaagcuccugacgaagccgugggacgugauccccauggugacccagaucgccaugaccgacaccacgcccuucggccagcagcgcgucuucaaggagaagguggacacccggacccccaaggccaagcgcgggaccgcccagaucauggaggugacggcgaaguggcuguggggcuuccucucccggaacaagaagccgcgcaucugcacccgggaggaguucacccgcaagguccggagcaacgccgccaucggcgccguguucguggacgagaaccaguggaacuccgcgaaggaggccgucgaggacgagcgcuucugggaccuggugcaccgggagcgcgagcugcacaagcaggggaagugcgcgaccugcguguacaacaugaugggcaagcgggagaagaagcucggggaguucggcaaggccaaggggagccgcgccaucugguacauguggcugggcgcgcgguuccuggaguucgaggcccucggcuucaugaacgaggaccacugguucucccgcgagaacagccuguccggggucgagggcgaggggcugcacaagcucggcuacauccugcgggacaucagcaagauccccgggggcaacauguacgccgacgacacggccggcugggacacccgcaucaccgaggacgaccugcagaacgaggccaagaucaccgacaucauggagcccgagcacgcgcuccuggccaaguccaucuucaagcugacguaccagaacaagguggugcggguccagcgcccggccaagaacgggaccgugauggacgugaucagccgccgggaccagcgcggcuccgggcaggucggcaccuacggccucaacaccuucacgaacauggaggcccagcugauccggcagauggagagcgaggggaucuucucccccagcgagcuggagacccccaaccucgccggccgcgugcuggacuggcuggagaagcacgggguggagcggcucaagcgcauggcgaucuccggcgacgacugcgucgugaagcccaucgacgaccgguucgccaccgcccugaccgcccugaacgacauggggaaggugcgcaaggacaucccgcagugggagcccagcaagggcuggaacgacuggcagcagguccccuucugcagccaccacuuccaccagcucaucaugaaggacggccgggagaucguggugcccugccgcaaccaggacgagcuggucgggcgggcccgcgugucccagggcgcgggguggagccugcgggagacggccugccucggcaaguccuacgcccagauguggcagcugauguacuuccaccgccgggaccugcgccucgccgcgaacgccaucugcagcgccgugccggucgacugggugcccaccucccggaccaccuggagcauccacgcccaccaccaguggaugacgaccgaggacaugcuguccguguggaaccgcgucuggaucgaggagaaccccuggauggaggacaagacccacaucagcuccuggggcgacgugcccuaccugggcaagcgggaggaccaguggugcggcagccucaucgggcugaccgcccgcgcgacgugggccaccaacauccagguggccaucaaccagguccgccggcugcucggcaacgagaacuaccuggacuacaugaccuccaugaagcgcuucaagaacgagagcgacccggagggggcccugugguga

SEQ ID NO: 8520 - RNA, 9879 nt, Artificial Sequence
  derived and/or modified CDS sequence (opt1) from DENV-1__FJ882549__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccgcaucaccgagguggagcccgacgacguggacugcuggugcaacaccaccgacaccugggugaccuacgggaccugcagccagacgggcgagcaccggcgcgacaagcggagcguggcccucgcgccccacgucggccuggggcuggagacccgcgccgagaccuggaugagcuccgagggcgcguggaagcagauccagaagguggagaccugggcccuccggcaccccggguucacggugaucgcccuguuccuggcccacgcgaucggcaccagcaucacccagaaggggaucaucuucauccuccugaugcuggucacccccuccauggccaugcgcugcgugggcaucggcagccgggacuucguggaggggcucuccggcgccacgugggucgacguggugcuggagcacgggagcugcgucaccaccauggccaaggacaagcccacccuggacaucgagcuccugaagacggaggugaccaaccccgccgugcugcgcaagcucugcaucgaggcgaagaucuccaacaccaccacggacagccggugcccgacccagggcgaggccacccuggucgaggagcaggacgccaacuucgugugccgccggaccuucguggaccgcggcugggggaacggcugcgggcuguucggcaaggggucccucaucacgugcgccaaguucaagugcgucaccaagcuggagggcaagaucgugcaguacgagaaccugaaguacagcgugaucgucaccgugcacaccggcgaccagcaccaggucgggaacgaguccacggagcacggcaccaccgccaccaucacgccccaggcgcccacgagcgagauccagcucaccgacuacggggcccugacccuggacugcagcccccggaccggccucgacuucaacgagauggugcugcugacgaugaaggagaaguccuggcucgugcacaagcagugguuccuggaccugccccuccccuggaccagcggggccuccaccagccaggagaccuggaaccgccaggaccugcuggucacguucaagaccgcccacgccaagaagcaggagguggugguccucggcucccaggagggcgcgaugcacaccgcccugaccggggccacggagauccagaccagcggcaccaccacgaucuucgccgggcaccugaagugccggcucaagauggacaagcugacccugaagggcauguccuacgugaugugcaccgggagcuucaagcucgagaaggagguggccgagacccagcacggcacgguccuggugcagaucaaguacgagggcaccgacgcgcccugcaagauccccuucuccacccaggacgagaagggggugacccagaacggccgccugaucacggccaacccgaucgucaccgacaaggagaagcccgugaacaucgaggccgagccgcccuucggggagagcuacaucgugaucggcgccggcgagaaggcgcugaagcucuccugguucaagaaggggagcuccaucggcaagauguucgaggccaccgcccgcggggcccgccggauggccauccugggcgacaccgcgugggacuucgggagcaucggcggcgucuucacguccguggggaagcuggugcaccagaucuucggcaccgccuacgggguccucuucagcggcguguccuggaccaugaagaucgggaucggcgugcugcugaccuggcucggccugaacagccgcuccacgagccuguccaugaccugcaucgccgucgggcucgugacccuguaccugggcgugaugguccaggccgacagcgggugcgugaucaacuggaagggccgcgagcucaagugcgggagcggcaucuucgugaccaacgagguccacacguggaccgagcaguacaaguuccaggccgacuccccgaagcggcugagcgcggccaucggcaaggccugggaggagggggugugcggcauccgcuccgccacccggcuggagaacaucauguggcgccagaucagcaacgagcucaaccacauccugcuggagaacgacaugaaguucaccguggucgugggggacguggucggcauccucgcccaggggaagaagaugauccggccccagcccauggagcacaaguacuccuggaaguccuggggcaaggcgaagaucaucggcgccgacgugcagaacaccacguucaucaucgacgggcccaacaccccggagugccccgacgaccagcgcgccuggaacaucugggagguggaggacuacggcuucgggaucuucaccaccaacaucuggcugaagcugcgggacuccuacacgcaggucugcgaccaccgccucaugagcgccgcgaucaaggacuccaaggccgugcacgccgacaugggcuacuggaucgagagcgagaagaacgagaccuggaagcuggcccgggccuccuucaucgaggugaagaccugcaucuggcccaagagccacacccugugguccaacggcguccucgagagcgagaugaucauccccaagaucuacgggggcccgaucucccagcacaacuaccgccccggguacuucacgcagaccgcgggccccuggcaccuggggaagcuggagcucgacuucgaccugugcgagggcaccaccgugguggucgacgagcacugcggcaaccgggggccgagccugcgcacgaccaccgugaccggcaagaucauccacgaguggugcugccgguccugcacgcugccgccccuccgcuucaagggggaggacggcugcugguacgggauggagauccggcccgugaaggagaaggaggagaaccuggucaagagcauggugagcgccggcuccggcgagguggacagcuucucccucgggcugcugugcaucagcaucaugaucgaggaggucaugcgcucccgguggagccgcaagaugcucaugaccggcacccuggccguguucuuccugcucaucauggggcagcugaccuggaacgaccugauccgguccugcaucauggugggcgccaacgccagcgaccgcauggggaugggcacgaccuaccucgcgcugauggccaccuucaagaugcgcccgauguucgccgucgggcugcuguuccggcgccugaccucccgggaggugcugcuccugacgaucgggcugagccucgucgccuccguggagcugcccaacagccuggaggagcucggcgacgggcuggccaugggcaucaugauccugaagcuccugaccgacuuccaguccuaccagcugugggcgacccuccugagccugaccuucaucaagacgaccuucucccuccacuacgccuggaagaccauggccauggugcugagcaucgucucccugcucccccugugccugagcaccacgucccagaagaccaccuggcuccccgugcugcugggcagccucgggugcaagccgcugaccauguuccugaucgccgagaacaagaucuggggccgcaagagcuggccccucaacgaggggaucauggcggugggcaucgucuccauccugcugagcucccuccugaagaacgacgugccccuggccgggccccucaucgccggcggcaugcugaucgccugcuacgugaucagcggguccagcgccgaccugucccucgagaaggcggccgaggucagcugggaggaggaggccgagcacuccggcgccagccacaacauccugguggaggugcaggacgacgggacgaugaagaucaaggacgaggagcgggacgacacccugaccauccuccugaaggccacccugcucgcggucuccggcguguacccgcugagcauccccgccacccuguucgugugguacuucuggcagaagaagaagcagcgcuccgggguccucugggacacgcccagcccgcccgagguggagcgggccgugcuggacgacggcaucuaccgcaucaugcagcggggccugcuggggcgcucccaggucggcguggggguguuccaggagaacgucuuccacaccauguggcacgugacccggggcgccgugcucauguaccaggggaagcgccuggagcccagcugggccuccgucaagaaggaccugaucagcuacggcggcggguggcggcuccagggcuccuggaacaccggggaggagguccaggugaucgcggucgagcccggcaagaaccccaagaacgugcagacggcccccgggaccuucaagacccccgagggcgaggugggcgccaucgcccuggacuucaagcccgggaccagcggcagccccaucgucaaccgcgaggggaagaucgugggccuguacggcaacgggguggucacgaccuccggcaccuacgugagcgccaucgcgcaggccaaggccucccaggaggggccgcuccccgagaucgaggacgagguguuccggaagcgcaaccugaccaucauggaccugcaccccggcagcgggaagacgcggcgcuaccucccggccaucguccgggaggcgaucaagcgcaagcugcggacccugauccucgcccccacccgcgugguggccuccgagauggccgaggcccugaagggcaugcccauccgcuaccagaccacggcggucaagagcgagcacaccggccgggagaucguggaccugaugugccacgccaccuucaccaugcgccuccugucccccgugcgggucccgaacuacaacaugaucaucauggacgaggcccacuucacggaccccagcuccaucgccgcccgcggguacaucagcacccgggugggcaugggggaggcggccgccaucuucaugaccgccacgccgcccggcuccguggaggccuucccgcagagcaacgcggucauccaggacgaggagcgcgacauccccgagcgguccuggaacagcggguacgaguggaucacggacuuccccggcaagaccgugugguucgugcccuccaucaagagcggcaacgacaucgccaacugccugcgcaagaacgggaagcgggucauccagcucucccgcaagaccuucgacaccgaguaccagaagacgaagaacaacgacugggacuacguggugaccaccgacaucagcgagaugggcgccaacuuccgggccgaccgcgucaucgacccgcggcgcugccugaagcccgugauccugaaggacgggcccgagcgggucauccucgcgggccccaugccggugaccguggccuccgccgcccagcgccgggggcgcaucggccggaaccacaacaaggagggcgaccaguacaucuacauggggcagccccugaacaacgacgaggaccacgcccacuggacggaggcgaagaugcugcucgacaacaucaacacccccgagggcaucauccccgcccuguucgagccggagcgcgagaaguccgccgccaucgacggggaguaccgccugcggggcgaggcccgcaagaccuucgucgagcucaugcggcgcggggaccugcccguguggcugagcuacaagguggcguccgagggcuuccaguacagcgaccggcgcuggugcuucgacggcgagcggaacaaccagguccucgaggagaacauggacguggagaucuggaccaaggagggggagcgcaagaagcugcggccccgcuggcuggacgcccggacguacuccgacccccucgcccugcgcgaguucaaggaguucgccgccggccggcgcagcguguccggggaccugauccucgagaucggcaagcugccgcagcaccugacccagcgggcgcagaacgcccucgacaaccuggucaugcugcacaacagcgagcagggcgggcgcgccuaccggcacgccauggaggagcuccccgacaccaucgagacccugaugcugcucgcgcugaucgccgugcugacgggcggggugacccucuucuuccuguccggcaaggggcugggcaagaccagcaucggccuccugugcgucauggccuccagcgcccugcucuggauggccuccguggagccccacuggaucgcggccagcaucauccuggaguucuuccugauggugcuccugauccccgagccggaccgccagcggacgccccaggacaaccagcuggccuacgucgugaucgggcuccuguucaugauccugaccguggccgccaacgagaugggccuccuggagacgaccaagaaggaccuggggaucggccacgucgcgguggagaaccaccaccacgccaccaugcucgacguggaccugcaccccgccuccgccuggacccuguacgccgucgcgacgaccaucaucaccccgaugaugcgccacaccaucgagaacacgaccgccaacaucagccucaccgccaucgccaaccaggccgcgauccugauggggcuggacaagggcuggcccaucuccaagauggacaucggcgugccccuccuggcccuggggugcuacagccaggugaacccccucacccugacggccgccguccugaugcucguggcgcacuacgccaucaucggcccggggcugcaggccaaggccacccgggaggcccagaagcgcaccgcggccggcaucaugaagaaccccaccguggacgggaucgucgccaucgaccuggaccccgugguguacgacgccaaguucgagaagcagcucggccagaucaugcugcugauccucugcacgucccagauccugcugaugcgcaccaccugggcccucugcgagagcaucacccuggcgacgggcccccugaccacccucugggagggguccccgggcaaguucuggaacaccacgaucgccgucagcauggccaacaucuuccgggggagcuaccuggccggcgccggccuggcguucucccucaugaagucccucgggggcgggcgccgggggaccggggcccagggcgagacccugggcgagaaguggaagcgccagcucaaccagcuguccaagagcgaguucaacaccuacaagcgguccgggaucauggagguggaccgcagcgaggccaaggagggccugcggcgcggggagacgaccaagcacgccgugucccggggcaccgcgaagcuccgcugguucgucgagcggaaccuggugaagcccgaggggaaggugaucgaccugggcugcggccgcgggggcuggagcuacuacugcgccgggcugaagaaggucaccgaggugaagggcuacacgaagggcgggcccggccacgaggagcccaucccgauggccaccuacggguggaaccucgugaagcugcacuccggcaaggacgucuucuucaucccgcccgagaagugcgacacccugcucugcgacaucggggagagcucccccaacccgaccaucgaggagggccggacgcugcgcgugcugaagaugguggagcccuggcuccgggggaaccaguucugcaucaagauccugaaccccuacaugcccagcgucguggagacccuggagcagaugcagcgcaagcacggcggcaugcucgugcggaacccgcugucccgcaacagcacccacgagauguacugggucuccugcgggaccggcaacaucgugagcgccgugaacaugaccucccggaugcugcucaaccgcuucacgauggcccaccgcaagcccaccuacgagcgggacgucgaccugggggcgggcacccgccacguggccguggagcccgaggucgccaaccuggacaucaucggccagcggaucgagaacaucaagcacgagcacaagagcaccuggcacuacgacgaggacaaccccuacaagacgugggccuaccacggguccuacgaggugaagccgagcggcagcgccuccagcauggucaacgggguggugaagcuccugaccaagcccugggacgucauccccauggugacccagaucgcgaugaccgacacgacccccuucggccagcagcgcgugcugaaggagaaggucgacacccggaccccgaaggccaagcgcgggacggcccagaucauggaggugaccgccaaguggcucuggggcuuccugucccggaacaagaagccccgcaucugcacccgggaggaguucacccgcaaggugcggagcaacgccgcgaucggcgccgucuucguggacgagaaccaguggaacuccgccaaggaggccguggaggacgagcgcuucugggaccugguccaccgggagcgcgagcuccacaagcaggggaagugcgcgacgugcguguacaacaugaugggcaagcgggagaagaagcugggggaguucggcaaggccaaggggagccgcgccaucugguacauguggcugggcgcccgguuccucgaguucgaggcccugggcuucaugaacgaggaccacugguucucccgcgagaacagccuguccgggguggagggcgaggggcuccacaagcugggcuacauccugcgggacaucagcaagauccccgggggcaacauguacgcggacgacaccgccggcugggacacccgcaucaccgaggacgaccuccagaacgaggccaagaucacggacaucauggagccggagcacgcccugcuggccaccuccaucuucaagcucaccuaccagaacaaggucgugcgggugcagcgccccgcgcgcaacgggaccgucauggacgugaucagccggcgcgaccagcggggcuccggccaggugggcacguacggccugaacaccuucaccaacauggaggcccagcugauccgccagauggagagcgaggggaucuucucccccagcgagcucgagacccccaaccuggccgagcggguccuggacuggcucgagaagcacggcguggagcgccugaagcggauggccaucuccggggacgacugcguggucaagccgaucgacgaccgcuucgccacggcgcugagcgcccucaacgacaugggcaaggugcggaaggacaucccccagugggagcccagcaagggguggaacgacuggcagcagguccccuucugcucccaccacuuccaccagcugaucaugaaggacggccgcgagaucgucgugccgugccggaaccaggacgagcuggugggccgcgcccgggucagccagggggccggcuggucccuccgcgagaccgccugccugggcaagagcuacgcgcagauguggcagcugauguacuuccaccggcgcgaccuccggcuggccgccaacgccaucugcuccgcggugcccguggacuggguccccaccagccgcaccacgugguccauccacgcccaccaccaguggaugaccaccgaggacaugcugagcguguggaaccggguguggaucgaggagaaccccuggauggaggacaagacccacaucuccagcuggggcgacgucccguaccucgggaagcgcgaggaccaguggugcggcucccugaucggccugacggcccgcgccaccugggccaccaacauccagguggcgaucaaccaggugcggcgccucaucgggaacgagaacuaccuggacuacaugaccagcaugaagcgguucaagaacgaguccgaccccgagggcgcccugugguga

SEQ ID NO: 8521 - RNA, 9879 nt, Artificial Sequence
  derived and/or modified CDS sequence (opt1) from DENV-1__GQ199814__SS-prME
agcgugaccaugcugcucaugcugaugcccaccgcccuggccuuccaccucacgacccggggcggggagccccacaugaucgugagcaagcaggagcggggcaagagccugcuguucaagaccagcgcgggggugaacaugugcacccucaucgccauggaccugggcgaguucugcgaggacacgaugaccuacaagugcccccgcaucaccgaggccgagcccgacgacguggacugcuggugcaacgccaccgacacgugggugaccuacgggaccugcagccagaccggcgagcaccggcgggacaagcgguccguggcccuggcgccccacgugggccucgggcuggagacgcgcaccgagaccuggaugagcuccgagggcgccuggaagcagauccagcggguggagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugcccgacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaagaucguccaguacgagaaccugaaguacagcgugaucgugaccguccacaccggcgaccagcaccagguggggaacgaguccacggagcacggcaccaccgcgaccaucacgccccaggcccccagcacggagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccagcggggccuccaccagccaggagaccuggaaccggcaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcauguccuacgucaugugcaccgggagcuucaagcuggagaaggagguggcggagacccagcacggcacggugcucguccagaucaaguacgagggcaccgacgcccccugcaagauccccuucuccacccaggacgagaagggggugacccagaacggccggcugaucacggccaacccgaucgugaccgacaaggacaagcccgucaacaucgaggccgagccgcccuucggggagagcuacaucgugaucggcgcgggcgagaaggcccugaagcuguccugguucaagaaggggagcuccaucggcaagauguucgaggccaccgcccgcggggcccggcgcauggcgauccucggcgacaccgccugggacuucgggagcaucggcggcguguucacguccgucgggaagcuggugcaccagaucuucggcaccgccuacggggugcuguucagcggcgucuccuggaccaugaagaucgggaucggcgugcuccugaccuggcugggccucaacagccgcuccacgagccuguccaugaccugcaucgccguggggcuggucacccucuaccugggcgugauggugcaggccgacagcgggugcgucaucaacuggaagggccgggagcugaagugcgggagcggcaucuucgugaccaacgaggugcacacguggaccgagcaguacaaguuccaggcggacuccccgaagcgccucagcgccgccaucggcaaggccugggaggagggggucugcggcauccgguccgccacccgccuggagaacaucauguggaagcagaucagcaacgagcugaaccacauccuccuggagaacgacaugaaguucaccgugguggucggggacguggcgggcauccuggcccaggggaagaagaugauccggccccagcccauggaguacaaguacuccuggaaguccuggggcaaggccaagaucaucggcgccgacgugcagaacaccacguucaucaucgacgggcccaacaccccggagugccccgacgaccagcgcgcguggaacaucugggaggucgaggacuacggcuucgggaucuucaccaccaacaucuggcucaagcugcgggacuccuacacccaggugugcgaccaccgccugaugagcgccgccaucaaggacuccaaggccgugcacgccgacaugggcuacuggaucgagagcgagaagaacgagaccuggaagcucgcgcgggccuccuucaucgaggucaagaccugcaucuggcccaagagccacacccugugguccaacggcgugcuggagagcgagaugaucauccccaagaucuacgggggcccgaucucccagcacaacuaccgccccggguacuucacgcagaccgccggccccuggcaccucgggaagcuggagcuggacuucgaccucugcgagggcaccaccguggucguggacgagcacugcggcaaccgggggccgagccugcgcacgaccaccgugaccggcaagaucauccacgaguggugcugccgguccugcacgcugccgccccugcgcuucaagggggaggacggcugcugguacgggauggagauccggcccgucaaggagaaggaggagaaccuggucaagagcauggugagcgccggcuccggcgaggucgacagcuucucccuggggcuccugugcaucagcaucaugaccgaggaggugaugcgcucccgguggagccgcaagaugcugaugaccggcacccucgccguguucuuccugcugaucauggggcagcucacguggaacgaccugauccggcugugcaucauggucggcgcgaacgccuccgaccgcauggggaugggcaccaccuaccucgcccugauggccaccuucaagaugcgcccgauguucgccguggggcuccuguuccggcgccugacgagccgggaggugcugcuccugaccaucgggcugucccucgucgcgagcguggagcugcccaacucccuggaggagcucggcgacgggcuggccaugggcaucaugauccugaagcuccugaccgacuuccagagccaccagcugugggccacccuccugucccugacguucaucaagaccaccuucagccuccacuacgccuggaagaccauggcgaugguccuguccaucgugagccuguucccccucugccuguccacgaccagccagaagaccaccuggcugcccgugcuccugggcucccuggggugcaagccgcucacgauguuccugaucgccgagaacaagaucuggggccgcaagagcuggccccugaacgaggggaucauggccgucggcaucgugagcauccuccuguccagccugcucaagaacgacgugccccuggccgggccccugaucgccggcggcaugcucaucgcgugcuacgucaucuccgggagcuccgccgaccugagccuggagaaggccgccgagguguccugggaggaggaggccgagcacagcggcgcgucccacaacauccucguggagguccaggacgacgggaccaugaagaucaaggacgaggagcgggacgacacccugaccauccugcucaaggccacccugcuggccgugagcggcguguacccgcucuccauccccgccacgcuguucgucugguacuucuggcagaagaagaagcagcgcagcggggugcugugggacacccccagcccgcccgagguggagcgggccguccucgacgacggcaucuaccgcaucaugcagcggggccugcuggggcgcagccaggugggcgugggggucuuccaggagaacguguuccacaccauguggcacgugacccggggcgcgguccugauguaccaggggaagcgccucgagcccuccugggccagcgugaagaaggaccugaucuccuacggcggcggguggcggcugcagggcagcuggaacacgggggaggaggugcaggucaucgccguggagcccggcaagaaccccaagaacgugcagaccgcccccgggaccuucaagaccuccgagggcgaggucggcgccaucgcgcucgacuucaagcccgggacgagcggcagccccaucgugaaccgcgaggggaagaucgugggccuguacggcaacggggucgugaccaccuccggcaccuacgugagcgccaucgcccaggccaaggcgucccaggaggggccccugccggagaucgaggacgaggucuuccggaagcgcaaccucacgaucauggaccugcaccccggcagcgggaagacccggcgcuaccugcccgccaucgugcgggaggccaucaagcgcaagcuccggacccugauccuggccccgacccgcguggucgccuccgagauggcggaggcccucaagggcaugcccauccgcuaccagacgaccgccgucaagagcgagcacaccggcaaggagaucguggaccugaugugccacgccaccuucacgaugcggcugcucucccccguccgcgugcccaacuacaacaugaucaucauggacgaggcccacuucaccgacccgagcuccaucgcggcccggggguacaucagcacccgcgugggcaugggggaggccgccgccaucuucaugaccgcgacgccgcccggcuccgucgaggccuucccccagagcaacgccgugauccaggacgaggagcgggacaucccggagcgcuccuggaacagcggguacgaguggaucaccgacuuccccggcaagaccgugugguucguccccuccaucaagagcggcaacgacaucgccaacugccugcggaagaacgggaagcgcgugauccagcugucccggaagaccuucgacacggaguaccagaagaccaagaacaacgacugggacuacguggucaccaccgacaucagcgagaugggcgcgaacuuccgcgccgaccgggugaucgacccccgccggugccucaagccggugauccugaaggacgggcccgagcgcgucauccuggccggccccaugcccgugacggucgccuccgccgcgcagcggcgcgggcggaucggccgcaaccacaacaaggagggcgaccaguacguguacauggggcagccgcucaacaacgacgaggaccacgcccacuggaccgaggccaagaugcugcuggacaacaucaacacccccgagggcaucauccccgcccucuucgagcccgagcgggagaaguccgccgcgaucgacggggaguaccgccugcgcggcgaggcccggaagaccuucguggagcugaugcgccgcggggaccucccggucuggcugagcuacaagguggccuccgagggcuuccaguacagcgaccgccgguggugcuucgacggcgagcgcaacaaccaggugcuggaggagaacauggacgucgagaucuggacgaaggagggggagcggaagaagcuccgcccccgguggcuggacgcccgcaccuacuccgacccccuggcccuccgggaguucaaggaguucgcggccggccgccggagcguguccggggaccugauccuggagaucggcaagcucccccagcaccugacccagcgcgcccagaacgcccuggacaaccucgugaugcugcacaacagcgagcagggcgggcgggcguaccgccacgccauggaggagcugccggacaccaucgagacgcucaugcugcuggcccucaucgccguccugaccggcggggugacccuguucuuccucuccggccgggggcugggcaagaccagcaucggccugcucugcgugauggccuccagcguccugcuguggauggcguccguggagccccacuggaucgccgccagcaucauccucgaguucuuccugauggugcugcucauccccgagcccgaccgccagcggaccccgcaggacaaccagcuggccuacgucgugaucgggcuccucuucaugauccugacgguggccgcgaacgagaugggccugcucgagaccaccaagaaggaccuggggaucggccacgucgccguggagaaccaccaccacgccgccaugcuggacguggaccuccaccccgccuccgcguggacccuguacgccgucgccacgaccaucaucacccccaugaugcgccacaccaucgagaacacgaccgccaacaucagccugaccgccaucgcgaaccaggccgccauccucauggggcuggacaagggcuggccgaucuccaagauggacaucggcgugccccugcucgcccuggggugcuacagccaggugaacccccugacccucacggcggccguccugaugcugguggcccacuacgccaucaucggccccgggcuccaggccaaggcgacccgggaggcccagaagcgcaccgccgccggcaucaugaagaacccgaccguggacgggaucgucgccaucgaccuggaccccgugguguacgacgcgaaguucgagaagcagcugggccagaucaugcuccugauccugugcacgucccagauccuccugaugcgcaccaccugggcccugugcgagagcaucacccucgccacgggcccccugaccacccugugggaggggucccccggcaaguucuggaacaccacgaucgccgucagcauggccaacaucuuccgggggagcuaccucgcgggcgccggccuggccuucucccugaugaagucccucgggggcgggcgccggggcaccggggcccagggcgagacccugggcgagaaguggaagcgccagcugaaccagcucuccaagagcgaguucaacaccuacaagcgguccgggaucauggagguggaccgcagcgaggcgaaggagggccugaagcgcggggagacgaccaagcacgccgugucccgcggcaccgccaagcugcggugguucgucgagcgcaaccucgugaagccggaggggaaggugaucgaccugggcugcggccgcggcggguggagcuacuacugcgccgggcugaagaaggucaccgaggugaagggguacacgaagggcgggcccggccacgaggagcccauccccauggccaccuacggguggaaccuggugaagcuccacuccggcaaggacgucuucuucaucccgcccgagaagugcgacacccugcugugcgacaucggggagagcucccccaaccccaccaucgaggagggccgcacgcuccgggugcugaagaugguggagccguggcugcgcgggaaccaguucugcaucaagauccucaaccccuacaugcccagcgucguggagacccuggagcagaugcagcggaagcacggcggcaugcuggugcgcaacccccucucccggaacagcacccacgagauguacugggucuccugcgggaccggcaacaucgugagcgcggugaacaugaccucccgcaugcugcugaaccgguucacgauggcccaccgcaagccgaccuacgagcgcgacgucgaccucggggccggcacccggcacguggccguggagcccgaggucgccaaccuggacaucaucggccagcgcaucgagaacaucaagcacgagcacaagagcaccuggcacuacgacgaggacaaccccuacaagacgugggcguaccacggguccuacgaggugaagcccagcggcagcgccuccagcauggucaacgggguggugaagcugcucaccaagccgugggacgucauccccauggugacccagaucgccaugaccgacacgacccccuucggccagcagcggguguucaaggagaaggucgacacccgcacccccaaggccaagcgggggacggcccagaucauggaggugaccgcgaaguggcuguggggcuuccugucccgcaacaagaagccgcggaucugcacccgcgaggaguucacccggaaggugcgcagcaacgccgccaucggcgccgucuucguggacgagaaccaguggaacuccgcgaaggaggccguggaggacgagcgguucugggaccucguccaccgcgagcgggagcugcacaagcaggggaagugcgccacgugcguguacaacaugaugggcaagcgcgagaagaagcugggggaguucggcaaggccaaggggagccgggccaucugguacauguggcucggcgcgcgcuuccuggaguucgaggcccugggcuucaugaacgaggaccacugguucucccgggagaacagccucuccgggguggagggcgaggggcugcacaagcugggcuacauccuccgcgacaucagcaagauccccgggggcaacauguacgccgacgacaccgccggcugggacacccggaucaccgaggacgaccugcagaacgaggccaagaucacggacaucauggagcccgagcacgcgcugcucgccaaguccaucuucaagcugaccuaccagaacaaggucgugcgcgugcagcggccggccaagaacgggaccgucauggacgugaucagccgccgcgaccagcggggcuccggccaggugggcaccuacggccugaacacguucaccaacauggaggcccagcucauccgccagauggagagcgaggggaucuucucccccagcgagcuggagacccccaaccuggccggccggguccucgacuggcuggagaagcacgggguggagcgccugaagcggauggcgaucuccggcgacgacugcguggucaagcccaucgacgaccgcuucgccaccgcccucacggcccugaacgacauggggaaggugcggaaggacaucccgcagugggagcccagcaagggcuggaacgacuggcagcagguccccuucugcagccaccacuuccaccagcugaucaugaaggacggccgcgagaucgucgugcccugccggaaccaggacgagcucguggggcgcgcccgggucucccagggcgcgggguggagccugcgcgagaccgccugccugggcaaguccuacgcccagauguggcagcucauguacuuccaccggcgcgaccugcggcuggccgcgaacgccaucugcagcgccgugccgguggacuggguccccaccucccgcaccacguggagcauccacgcccaccaccaguggaugaccaccgaggacaugcucuccguguggaaccggguguggaucgaggagaaccccuggauggaggacaagacccacaucagcuccuggggcgacguccccuaccugggcaagcgcgaggaccaguggugcggcagccugaucgggcucacggcccgggcgaccugggccaccaacauccagguggccaucaaccaggugcgccgccugaucggcaacgagaacuaccuggacuacaugaccuccaugaagcgguucaagaacgagagcgacccggagggggcccucugguga

SEQ ID NO: 8522 - RNA, 9879 nt, Artificial Sequence
  derived and/or modified CDS sequence (opt1) from DENV-1__GQ199816__SS-prME
agcgugaccaugcugcucaugcugaugcccaccgcccuggccuuccaccucaccacccggggcggggagccccacaugaucguguccaagcaggagcggggcaagagccugcuguucaagaccuccgcgggggugaacaugugcacccucaucgccauggaccugggggaguucugcgaggacacgaugaccuacaagugcccccgcaucaccgaggccgagcccgacgacguggacugcuggugcaacgccaccgacacgugggucaccuacgggaccugcagccagaccggggagcaccggcgcgacaagcgguccguggcccuggcgccccacgugggccucgggcuggagacgcgcaccgagaccuggaugagcuccgagggcgccuggaagcagauccagaaggucgagaccugggcccugcggcaccccggguucacggugaucgcccucuuccuggcgcacgccaucggcaccagcaucacccagaaggggaucaucuucauccugcucaugcuggugacccccuccauggccaugcgcugcgucggcaucggcagccgggacuucguggaggggcuguccggcgccacguggguggacgucgugcucgagcacgggagcugcgugaccaccauggccaaggacaagcccacccuggacaucgagcugcucaagacggaggucaccaaccccgcggugcugcgcaagcugugcaucgaggccaagaucuccaacaccaccacggacagccggugcccgacccagggcgaggccacccucguggaggagcaggacgccaacuucgucugccgccggaccuucguggaccgcggcugggggaacggcugcgggcuguucggcaaggggucccugaucacgugcgccaaguucaagugcgugaccaagcucgagggcaagaccguccaguacgagaaccugaaguacagcgugaucgugaccguccacacgggcgaccagcaccagguggggaacgaguccaccgagcacggcaccaccgcgaccaucacgccccaggcccccagcaccgagauccagcugaccgacuacggggcccucacccuggacugcagcccccggacgggccuggacuucaacgagaugguccuccugaccaugaaggagaaggccuggcuggugcacaagcagugguuccucgaccugccgcugcccuggaccagcggggccagcaccucccaggagacguggaaccgcaaggaccuccuggugaccuucaagaccgcgcacgccaagaagcaggaggucguggugcugggcagccaggagggcgccaugcacaccgcccucacgggggccaccgagauccagaccuccggcaccacgaccaucuucgcggggcaccugaagugccggcugaagauggacaagcucacccugaagggcaugagcuacgucaugugcaccggguccuucaagcuggagaaggagguggccgagacgcagcacggcaccgugcucguccagaucaaguacgagggcaccgacgcccccugcaagauccccuucagcacccaggacgagaagggggugacgcagaacggccgccugaucaccgccaacccgaucgugaccgacaaggagaagcccgucaacaucgaggcggagccgcccuucggggaguccuacaucgugaucggcgccggcgagaaggcccugaagcugagcugguucaagaagggguccagcaucggcaagauguucgaggccaccgcccgcggggcgcgccggauggccauccucggcgacacggccugggacuucggguccaucggcggcguguucaccagcgucgggaagcuggugcaccagaucuucggcaccgccuacggggugcuguucuccggcgucagcuggaccaugaagaucgggaucggcgugcuccugacguggcugggccucaacucccgcagcaccucccugagcaugaccugcaucgccguggggcuggucacccucuaccugggcgugauggugcaggcggacuccgggugcgucaucaacuggaagggccgcgagcugaagugcgggagcggcaucuucgugacgaacgaggugcacaccuggaccgagcaguacaaguuccaggccgacagcccgaagcggcucuccgccgccaucggcaaggccugggaggagggggucugcggcauccgcagcgcgacccggcuggagaacaucauguggaagcagaucuccaacgagcugaaccacauccuccuggagaacgacaugaaguucaccgugguggucggggacguggccggcauccuggcccaggggaagaagaugauccgcccccagcccauggaguacaaguacagcuggaaguccuggggcaaggccaagaucaucggcgcggacgugcagaacgccacguucaucaucgacgggcccaacaccccggagugccccgacgaccagcgggccuggaacaucugggaggucgaggacuacggcuucgggaucuucaccaccaacaucuggcucaagcugcgcgacagcuacacccaggugugcgaccaccggcugauguccgccgccaucaaggacagcaaggcggugcacgccgacaugggcuacuggaucgaguccgagaagaacgagacguggaagcucgcccgcgccagcuucaucgaggucaagaccugcaucuggcccaagucccacacccuguggagcaacggcgugcuggaguccgagaugaucauccccaagaucuacgggggcccgaucagccagcacaacuaccggcccggguacuucacgcagaccgccggccccuggcaccucgggaagcuggagcuggacuucgaccucugcgagggcaccaccguggucguggacgagcacugcggcaaccgcgggccgucccugcggacgaccaccgugaccggcaagaucauccacgaguggugcugccgcagcugcacgcugccgccccugcgguucaagggggaggacggcugcugguacgggauggagauccgccccgucaaggagaaggaggagaaccuggugaaguccauggugagcgcgggcagcggcgaggucgacuccuucagccuggggcuccugugcaucuccaucaugaucgaggaggugaugcggagccgcuggucccggaagaugcugaugaccggcauccucgccguguucuuccugcugaucauggggcagcucaccuggaacgaccugauccgccugugcaucauggucggcgccaacgccagcgaccggauggggaugggcaccacguaccucgcccugauggcgaccuucaagaugcgcccgauguucgccgugggccuccuguuccgccggcugaccucccgcgaggugcugcuccugaccaucgggcugagccucgucgccuccguggagcugcccaacagccuggaggagcucggcgacgggcuggccaugggcaucaugauccugaagcuccugacggacuuccagucccaccagcugugggcgacccuccugagccugaccuucaucaagaccacguucucccuccacuacgccuggaagaccauggccaugguccugagcaucgugucccuguucccccucugccugagcaccaccucccagaagacgaccuggcugcccgugcuccugggcagccuggggugcaagccgcucaccauguuccugaucgccgagaacaagaucuggggccggaaguccuggccccugaacgaggggaucauggccgucggcaucgugagcauccuccugagcucccugcucaagaacgacgugccccuggcggggccccugaucgccggcggcaugcucaucgccugcuacgucaucagcggguccagcgccgaccugucccuggagaaggccgcggaggugagcugggaggaggaggccgagcacuccggcgccagccacaacauccucguggagguccaggacgacgggaccaugaagaucaaggacgaggagcgcgacgacacgcugaccauccugcucaaggccacccugcuggccguguccggcguguacccgcucagcauccccgcgacccuguucgucugguacuucuggcagaagaagaagcagcgguccggggugcugugggacacccccuccccgcccgagguggagcgcgccguccucgacgacggcaucuaccggaucaugcagcgcggccugcuggggcggucccaggugggcgugggggucuuccaggagaacguguuccacacgauguggcacgugacccgcggcgccguccugauguaccaggggaagcggcucgagcccagcugggccuccgugaagaaggaccugaucagcuacggcggcggguggcgccugcagggcuccuggaacaccggggaggaggugcaggucaucgccguggagcccggcaagaaccccaagaacgugcagaccgcgcccgggacguucaagaccagcgagggcgaggucggcgccaucgcccucgacuucaagcccgggaccuccggcagccccaucgugaaccgggaggggaagaucgugggccuguacggcaacggggucgugaccacgagcggcaccuacguguccgccaucgcgcaggccaaggccagccaggaggggccccugccggagaucgaggacgaggucuuccgcaagcggaaccucaccaucauggaccugcaccccggcuccgggaagacccgccgguaccugcccgccaucgugcgcgaggccaucaagcggaagcuccgcacgcugauccuggcgccgacccggguggucgccagcgagauggccgaggcccucaagggcaugcccauccgcuaccagaccaccgccgugaaguccgagcacacgggcaaggagaucguggaccugaugugccacgcgaccuucaccaugcgccugcucagccccguccgggugcccaacuacaacaugaucaucauggacgaggcccacuucaccgacccguccagcaucgccgcccgcggguacaucuccacgcgggugggcaugggggaggccgcggccaucuucaugaccgccacgccgcccggcagcgucgaggccuucccccaguccaacgcggugauccaggacgaggagcgcgacaucccggagcggagcuggaacuccggguacgaguggaucaccgacuuccccggcaagacggugugguucguccccagcaucaaguccggcaacgacaucgccaacugccugcgcaagaacgggaagcgggugauccagcugagccgcaagaccuucgacaccgaguaccagaagaccaagaacaacgacugggacuacguggucacgaccgacaucuccgagaugggcgccaacuuccgggccgaccgcgugaucgacccccggcgcugccucaagccggugauccugaaggacgggcccgagcgggucauccuggccggccccaugcccgugaccgucgcgagcgccgcccagcgccgggggcgcaucggccggaaccacaacaaggagggcgaccaguacaucuacauggggcagccgcucaacaacgacgaggaccacgcccacuggaccgaggccaagaugcugcuggacaacaucaacacgcccgagggcaucauccccgcccucuucgagcccgagcgcgagaaguccgccgccaucgacggggaguaccggcugcgcggcgaggcccgcaagaccuucguggagcugaugcggcgcggggaccucccgguguggcugagcuacaaggucgccagcgagggcuuccaguacuccgaccggcgcuggugcuucgacggcgagcggaacaaccaggugcuggaggagaacauggacguggagaucuggaccaaggagggggagcgcaagaagcuccggccccgcuggcuggacgcgcggaccuacagcgacccccuggcccuccgcgaguucaaggaguucgccgccggccggcgcuccgucagcggggaccugauccuggagaucggcaagcucccccagcaccugacgcagcgggcgcagaacgcccuggacaaccucgugaugcugcacaacuccgagcagggcgggcgcgccuaccggcacgccauggaggagcugccggacaccaucgagacccucaugcugcuggcccucaucgcggugcugaccggcggggucacgcuguucuuccucagcggccgcgggcugggcaagaccuccaucggccugcucugcgugauggccagcuccgugcugcuguggauggccagcgucgagccccacuggaucgccgccuccaucauccucgaguucuuccugauggugcugcucauccccgagcccgaccggcagcgcaccccgcaggacaaccagcuggcguacguggucaucgggcuccucuucaugauccugaccguggccgccaacgagaugggccugcucgagaccacgaagaaggaccuggggaucggccacguggccgucgagaaccaccaccacgccgcgaugcuggacguggaccuccaccccgccagcgccuggacccuguacgccguggccaccaccaucaucacgcccaugaugcggcacaccaucgagaacaccaccgcgaacaucucccugacggccaucgccaaccaggccgcgauccucauggggcuggacaagggcuggccgaucagcaagauggacaucggcgucccccugcucgcccuggggugcuacucccaggugaacccccugacccucaccgccgccgugcugaugcuggucgcccacuacgcgaucaucggccccgggcuccaggccaaggccacccgcgaggcccagaagcggacggccgcgggcaucaugaagaacccgaccguggacgggaucguggccaucgaccuggaccccgucguguacgacaccaaguucgagaagcagcugggccagaucaugcuccugauccugugcaccagccagauccuccugaugcgcacgaccugggcccugugcgaguccaucacccucgccaccggcccccugacgacccugugggaggggagccccggcaaguucuggaacaccaccaucgccguguccauggcgaacaucuuccgcgggagcuaccucgccggcgccggccuggccuucagccugaugaagucccucgggggcgggcggcgcggcacgggggcgcagggcgagacccugggcgagaaguggaagcggcagcugaaccagcucagcaaguccgaguucaacaccuacaagcgcagcgggaucauggaggucgaccgguccgaggccaaggagggccugaagcgcggggagaccacgaagcacgccgugagccggggcaccgccaagcugcgcugguucguggagcggaaccucgucaagccggaggggaaggugaucgaccugggcugcggccgcgggggcugguccuacuacugcgccgggcugaagaaggugaccgaggucaagggcuacaccaagggcgggcccggccacgaggagcccauccccauggcgacguacggguggaaccuggugaagcuccacagcggcaaggacguguucuucaucccgcccgagaagugcgacacccugcugugcgacaucggggaguccagccccaaccccaccaucgaggagggccggacccuccgcguccugaagaugguggagccguggcugcgggggaaccaguucugcaucaagauccucaaccccuacaugcccuccguggucgagacgcuggagcagaugcagcgcaagcacggcggcaugcuggugcggaacccccucagccgcaacuccacccacgagauguacugggugagcugcgggaccggcaacaucgucuccgccgugaacaugaccagccggaugcugcugaaccgcuucaccauggcccaccggaagccgacguacgagcgcgacguggaccucggggccggcacccgccacgucgccguggagcccgagguggcgaaccuggacaucaucggccagcggaucgagaacaucaagcacgagcacaaguccaccuggcacuacgacgaggacaaccccuacaagaccugggccuaccacgggagcuacgaggucaagcccuccggcagcgccagcuccauggugaacggggucgugaagcugcucacgaagccgugggacgugauccccauggucacccagaucgccaugaccgacaccacgcccuucggccagcagcgcguguucaaggagaagguggacacccggacccccaaggccaagcgcgggaccgcgcagaucauggaggucacggccaaguggcuguggggcuuccugagccggaacaagaagccgcgcaucugcacccgggaggaguucacccgcaaggugcgguccaacgccgccaucggcgcgguguucgucgacgagaaccaguggaacagcgccaaggaggccguggaggacgagcgcuucugggaccucgugcaccgggagcgcgagcugcacaagcaggggaagugcgcgaccugcgucuacaacaugaugggcaagcgggagaagaagcugggggaguucggcaaggccaaggggucccgcgcgaucugguacauguggcucggcgcccgguuccuggaguucgaggcccugggcuucaugaacgaggaccacugguucagccgcgagaacucccucagcgggguggagggcgaggggcugcacaagcugggcuacauccuccgggacaucuccaagauccccgggggcaacauguacgccgacgacacggccggcugggacacccgcaucaccgaggacgaccugcagaacgaggcgaagaucaccgacaucauggagcccgagcacgcccugcucgccaagagcaucuucaagcugacguaccagaacaaggugguccgggugcagcgcccggccaagaacgggaccgugauggacgucaucucccggcgcgaccagcgcggcagcggccaggugggcaccuacggccugaacaccuucacgaacauggaggcccagcucauccggcagauggaguccgaggggaucuucagccccuccgagcuggagacccccaaccuggcgggccgcgugcucgacuggcuggagaagcacggggucgagcggcugaagcgcauggccaucagcggcgacgacugcguggugaagcccaucgacgaccgguucgccaccgcccucaccgcccugaacgacauggggaagguccgcaaggacaucccgcagugggagcccuccaagggcuggaacgacuggcagcagguccccuucugcagccaccacuuccaccagcugaucaugaaggacggccgggagaucgugguccccugccgcaaccaggacgagcucguggggcgggcgcgcgugagccagggcgccggguggucccugcgggagacggccugccugggcaagagcuacgcccagauguggcagcucauguacuuccaccgccgggaccugcgccuggcggccaacgccaucugcuccgccgucccgguggacugggugcccaccagccggaccaccugguccauccacgcccaccaccaguggaugacgaccgaggacaugcucagcgucuggaaccgcguguggaucgaggagaaccccuggauggaggacaagacccacaucuccagcuggggcgacgugcccuaccugggcaagcgggaggaccaguggugcggcucccugaucgggcucaccgcgcgcgccacgugggccaccaacauccaggucgccaucaaccaggugcggcgccugaucggcaacgagaacuaccuggacuacaugaccagcaugaagcgcuucaagaacgagaucgacccggagggggcccucugguga

SEQ ID NO: 8523 - RNA, 9879 nt, Artificial Sequence
  derived and/or modified CDS sequence (opt1) from DENV-1__GQ199817__SS-prME
agcgugaccaugcugcugaugcugaugcccaccgcccuggccuuccaccucacgacccggggcggggagccccacaugaucgugagcaagcaggagcggggcaagagccugcuguucaagaccagcgccggggugaacaugugcacccucaucgccauggaccugggcgaguucugcgaggacaccaugaccuacaagugcccccggaucaccgaggccgagcccgacgacguggacugcuggugcaacgccaccgacacgugggugaccuacgggaccugcagccagaccggcgagcaccggcgggacaagcgguccguggcccuggcgccccacgugggccucgggcuggagacgcgcaccgagaccuggaugagcuccgagggcgccuggaagcagauccagcggguggagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugcccgacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaagaucguccaguacgagaaccugaaguacagcgugaucgugaccguccacaccggcgaccagcaccagguggggaacgaguccacggagcacggcaccaccgcgaccaucacgccccaggcccccagcacggagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccagcggggccuccaccagccaggagaccuggaaccggcaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcauguccuacgucaugugcaccgggagcuucaagcuggagaaggagguggcggagacccagcacggcacggugcucguccagaucaaguacgagggcaccgacgcccccugcaagauccccuucuccacccaggacgagaagggggugacccagaacggccggcugaucacggccaacccgaucgugaccgacaaggagaagcccgucaacaucgaggccgagccgcccuucggggagagcuacaucgugaucggcgcgggcgagaaggcccugaagcuguccugguucaagaaggggagcuccaucggcaagauguucgaggccaccgcccgcggggcccggcgcauggcgauccucggcgacaccgccugggacuucgggagcaucggcggcguguucacguccgucgggaagcuggugcaccagaucuucggcaccgccuacggggugcuguucagcggcgucuccuggaccaugaagaucgggaucggcgugcuccugaccuggcugggccucaacagccgcuccacgagccuguccaugaccugcaucgccguggggcuggucacccucuaccugggcgugauggugcaggccgacagcgggugcgucaucaacuggaagggccgggagcugaagugcgggagcggcaucuucgugaccaacgaggugcacacguggaccgagcaguacaaguuccaggcggacuccccgaagcgccucagcgccgccaucggcaaggccugggaggagggggucugcggcauccgguccgccacccgccuggagaacaucauguggaagcagaucagcaacgagcugaaccacauccuccuggagaacgacaugaagcugaccgugguggucggggacguggcgggcauccucgcccaggggaagaagaugauccggccccagcccauggaguacaaguacuccuggaaguccuggggcaaggccaagaucaucggcgccgacgugcagaacaccacguucaucaucgacgggcccaacaccccggagugccccgacgaccagcgcgcguggaacaucugggaggucgaggacuacggcuucgggaucuucaccaccaacaucuggcugaagcugcgggacuccuacacccaggugugcgaccaccgccucaugagcgccgccaucaaggacuccaaggccgugcacgccgacaugggcuacuggaucgagagcgagaagaacgagaccuggaagcuggcgcgggccuccuucaucgaggucaagaccugcaucuggcccaagagccacacccugugguccaacggcgugcucgagagcgagaugaucauccccaagaucuacgggggcccgaucucccagcacaacuaccgccccggguacuucacgcagaccgccggccccuggcaccuggggaagcuggagcucgacuucgaccugugcgagggcaccaccguggucguggacgagcacugcggcaaccgggggccgagccugcgcacgaccaccgugaccggcaagaucauccacgaguggugcugccgguccugcacgcugccgccccuccgcuucaagggggaggacggcugcugguacgggauggagauccggcccgucaaggagaaggaggagaaccuggucaagagcauggugagcgccggcuccggcgaggucgacagcuucucccucgggcugcugugcaucagcaucaugaucgaggaggugaugcgcucccgguggagccgcaagaugcucaugaccggcacccuggccguguucuuccugcucaucauggggcagcugaccuggaacgaccugauccggcucugcaucauggucggcgcgaacgccuccgaccgcauggggaugggcacgaccuaccuggcccugauggccaccuucaagaugcgcccgauguucgccgugggccuccuguuccggcgccugaccagccgggaggugcuccugcugacgaucgggcucucccuggucgcgagcguggagcugcccaacucccucgaggagcugggcgacgggcuggccaugggcaucaugauccucaagcugcugaccgacuuccagagccaccagcucugggccacccugcugucccucaccuucauccgcacgaccuucagccugcacuacgccuggaagaccauggcgaugguccuguccaucgugagccucaucccccugugccuguccaccacgagccagaagaccaccuggcuccccgugcugcugggcucccucgggugcaagccgcugaccauguuccugaucgccgagaacaagaucuggggccgcaagagcuggccccucaacgaggggaucauggccgucggcaucgugagcauccugcuguccagccuccugaagaacgacgugccccuggccgggccccucaucgccggcggcaugcugaucgcgugcuacgucaucuccgggagcuccgccgaccugagccucgagaaggccgccgagguguccugggaggaggaggccgagcacagcggcgcgucccacaacauccugguggagguccaggacgacgggacgaugaagaucaaggacgaggagcgcgacgacacccugaccauccuccugaaggccacccugcucgccgugagcggcguguacccgcuguccauccccgccacccuguucgucuggugcuucuggcagaagaagaagcagcggagcggggugcucugggacacgcccagcccgcccgagguggagcgcgccguccuggacgacggcaucuaccggaucaugcagcgcggccugcuggggcggagccaggugggcgugggggucuuccaggagaacguguuccacaccauguggcacgugacccgcggcgcgguccucauguaccaggggaagcggcuggagcccuccugggccagcgugaagaaggaccugaucuccuacggcggcggguggcgccuccagggcagcuggaacaccggggaggaggugcaggucaucgccguggagcccggcaagaaccccaagaacgugcagacggcccccgggaccuucaagaccuccgagggcgaggucggcgccaucgcgcuggacuucaagcccgggaccagcggcagccccaucgugaaccgggaggggaagaucgugggccuguacggcaacggggucgugacgaccuccggcaccuacgugagcgccaucgcccaggccaaggcgucccaggaggggccccucccggagaucgaggacgaggucuuccgcaagcggaaccugaccaucauggaccugcaccccggcagcgggaagacgcgccgguaccuccccgccaucgugcgcgaggccaucaagcggcgccugcgcacccugauccucgccccgacccggguggucgccuccgagauggcggaggcccugaagggcaugcccauccgcuaccagaccacggccgucaagagcgagcacaccggcaaggagaucguggaccugaugugccacgccaccuucaccaugcggcuccugucccccguccgcgugcccaacuacaacaugaucaucauggacgaggcccacuucacggacccgagcuccaucgcggcccggggguacaucagcacccgcgugggcaugggggaggccgccgccaucuucaugaccgcgacgccgcccggcuccgucgaggccuucccccagagcaacgccgugauccaggacgaggagcgggacaucccggagcgcuccuggaacagcggguacgaguggaucacggacuuccccggcaagaccgugugguucguccccuccaucaagagcggcaacgacaucgccaacugccugcggaagaacgggaagcgcgugauccagcucucccggaagaccuucgacaccgaguaccagaagacgaagaacaacgacugggacuacguggucaccaccgacaucagcgagaugggcgcgaacuuccgcgccgaccgggugaucgacccccgccggugccugaagccggugauccugaaggacgggcccgagcgcgucauccucgccggccccaugcccgugaccgucgccuccgccgcgcagcggcgcgggcggaucggccgcaaccacaacaaggagggcgaccaguacaucuacauggggcagccgcugaacaacgacgaggaccacgcccacuggacggaggccaagaugcugcucgacaacaucaacacccccgagggcaucauccccgcccuguucgagcccgagcgcgagaaguccgccgcgaucgacggggaguaccggcugcgcggcgaggcccggaagaccuucguggagcucaugcgccgcggggaccugccgguguggcugagcuacaaggucgccuccgagggcuuccaguacagcgaccgccgguggugcuucgacggcgagcgcaacaaccaggugcucgaggagaacauggacguggagaucuggaccaaggagggggagcggaagaagcugcgcccccgguggcuggacgcccgcacguacuccgacccccucgcccugcgggaguucaaggaguucgcggccggccgccggagcgucuccggggaccugauccucgagaucggcaagcugccccagcaccugacccagcgcgcccagaacgcccucgacaaccuggugaugcugcacaacagcgagcagggcgggcgggcguaccgccacgccauggaggagcucccggacaccaucgagacccugaugcugcucgcccugaucgccgugcugacgggcggggucacccucuuccugcuguccggccgggggcucggcaagaccagcaucggccugcugugcgugauggccuccagcgugcuccuguggauggcguccgucgagccccacuggaucgccgccagcaucauccuggaguucuuccucauggugcugcugauccccgagcccgaccgccagcggaccccgcaggacaaccagcucgccuacguggucaucgggcugcuguucaugauccucaccguggccgcgaacgagaugggccugcuggagacgaccaagaaggaccucgggaucggccacguggccgucgagaaccaccaccacgccgccaugcuggacguggaccugcaccccgccuccgcguggacccucuacgccguggccaccacgaucaucacccccaugaugcgccacaccaucgagaacaccacggccaacaucagccugaccgccaucgcgaaccaggccgccauccugauggggcucgacaagggcuggccgaucuccaagauggacaucggcgucccccugcuggcccucgggugcuacagccaggugaacccccugacccugaccgcggccgugcucaugcuggucgcccacuacgccaucaucggccccgggcugcaggccaaggcgacgcgcgaggcccagaagcggaccgccgccggcaucaugaagaacccgaccguggacgggaucguggccaucgaccucgaccccgucguguacgacgcgaaguucgagaagcagcugggccagaucaugcugcucauccugugcaccucccagauccugcucaugcgcacgaccugggcccugugcgagagcaucacccuggccaccggcccccucacgacccugugggaggggucccccggcaaguucuggaacaccaccaucgccgugagcauggccaacaucuuccgggggagcuaccuggcgggcgccggccucgccuucucccugaugaagucccucgggggcgggcgccgggggacgggggcccagggcgagacccucggcgagaaguggaagcgccagcugaaccagcuguccaagagcgaguucaacaccuacaagcgguccgggaucauggaggucgaccgcagcgaggcgaaggagggccucaagcgcggggagaccacgaagcacgccgugucccgcggcaccgccaagcugcggugguucguggagcgcaaccuggucaagccggaggggaaggugaucgaccugggcugcggccgcggcggguggagcuacuacugcgccgggcucaagaaggugaccgaggucaagggguacaccaagggcgggcccggccacgaggagcccauccccauggccacguacggguggaaccuggugaagcugcacuccggcaaggacguguucuucaucccgcccgagaagugcgacacccuccugugcgacaucggggagagcucccccaaccccaccaucgaggagggccgcacccugcggguccucaagaugguggagccguggcugcgcgggaaccaguucugcaucaagauccugaaccccuacaugcccagcguggucgagacgcucgagcagaugcagcggaagcacggcggcaugcuggugcgcaacccccugucccggaacagcacccacgagauguacuggguguccugcgggaccggcaacaucgucagcgcggugaacaugaccucccgcaugcuccugaaccgcuucaccauggcccaccggaagccgacguacgagcgcgacguggaccugggggccggcacccggcacgucgccguggagcccgagguggccaaccucgacaucaucggccagcgcaucgagaacaucaagcacgagcacaagagcaccuggcacuacgacgaggacaaccccuacaagaccugggcguaccacggguccuacgaggucaagcccagcggcagcgccuccagcauggugaacggggucgugaagcugcugacgaagccgugggacgugauccccauggucacccagaucgccaugaccgacaccacgcccuucggccagcagcggguguucaaggagaagguggacacccgcacccccaaggccaagcgggggaccgcccagaucauggaggucacggcgaaguggcucuggggcuuccugucccgcaacaagaagccgcggaucugcacccgcgaggaguucacccggaaggugcgcagcaacgccgccaucggcgccguguucgucgacgagaaccaguggaacuccgcgaaggaggccguggaggacgagcgguucugggaccuggugcaccgcgagcgggagcuccacaagcaggggaagugcgcgaccugcgucuacaacaugaugggcaagcgcgagaagaagcugggggaguucggcaaggccaaggggagccgggccaucugguacauguggcugggcgcgcgcuuccucgaguucgaggcccugggcuucaugaacgaggaccacugguucucccgggagaacagccuguccgggguggagggcgaggggcuccacaagcugggcuacauccugcgcgacaucagcaagauccccgggggcaacauguacgccgacgacacggccggcugggacacccggaucaccgaggacgaccuccagaacgaggccaagaucaccgacaucauggagcccgagcacgcgcugcuggccaaguccaucuucaagcucacguaccagaacaaggugguccgcgugcagcgcccggccaagaacgggaccgugauggacgucaucagccggcgcgaccagcggggcuccggccaggugggcaccuacggccugaacaccuucacgaacauggaggcccagcugauccgccagauggagagcgaggggaucuucucccccagcgagcucgagacccccaaccuggccggccgggugcuggacuggcucgagaagcacggggucgagcgccugaagcggauggcgaucuccggcgacgacugcguggugaagcccaucgacgaccgcuucgccaccgcccugaccgcccucaacgacauggggaagguccggaaggacaucccgcagugggagcccagcaagggcuggaacgacuggcagcagguccccuucugcagccaccacuuccaccagcugaucaugaaggacggccgcgagaucgugguccccugccggaaccaggacgagcugguggggcgcgcccgggugucccagggcgcgggguggagccuccgcgagacggccugccugggcaaguccuacgcccagauguggcagcugauguacuuccaccggcgcgaccuccggcuggccgcgaacgccaucugcagcgccgucccgguggacugggugcccaccucccgcaccaccuggagcauccacgcccaccaccaguggaugacgaccgaggacaugcuguccgucuggaaccggguguggaucgaggagaaccccuggauggaggacaagacccacgugagcuccuggggcgacguccccuaccucggcaagcgcgaggaccaguggugcggcagccugaucgggcugaccgcccgcgcgacgugggccaccaacauccagguggccaucaaccaggugcggcgccuccugggcaacgagaacuaccuggacuacaugaccuccaugaagcgguucaagaacgagagcgacccggagggggcccucugguga

SEQ ID NO: 8524 - RNA, 9879 nt, Artificial Sequence
  derived and/or modified CDS sequence (opt1) from DENV-1__FJ882550__SS-prME
agcgugaccaugcugcucaugcugaugcccaccgcccuggccuuccaccucaccacccggggcggggagccccacaugaucgugaccaagcaggagcggggcaagagccugcuguucaagaccagcgccggggugaacaugugcacccucaucgccauggaccugggcgagcugugcgaggacaccaugaccuacaagugcccccggaucaccgaggccgagcccgacgacguggacugcuggugcaacgccacggacaccugggugaccuacgggaccugcagccagacgggcgagcaccggcgcgacaagcggagcguggcccucgcgccccacgugggccuggggcuggagacccgcaccgagaccuggauguccagcgagggcgccuggaagcagauccagcgggucgagacgugggcccuccgccaccccggguucaccgugaucgcccuguuccuggcgcacgccaucggcaccuccaucacccagaaggggaucaucuucauccuccugaugcuggugacgcccagcauggccaugcggugcgucggcaucggcucccgcgacuucguggaggggcucagcggcgccaccuggguggacgucgugcuggagcacggguccugcgugaccaccauggccaaggacaagcccacgcuggacaucgagcuccugaagaccgaggucaccaaccccgcggugcugcggaagcucugcaucgaggccaagaucagcaacaccacgaccgacucccgcugccccacccagggcgaggccacccugauggaggagcaggacgccaacuucgugugccggcgcacguucgucgaccggggcugggggaacggcugcgggcuguucggcaaggggagccucaucacgugcgccaaguucaagugcgugaccaagcuggagggcaagaucgugcaguacgagaaccugaaguacuccgucaucgugaccgugcacacgggcgaccagcaccaggucgggaacgagagcaccgagcacggcaccaccgcgaccaucacgccccaggcccccaccuccgagauccagcucaccgacuacggggcccugacccuggacugcagcccccgcacgggccucgacuucaacgagauggugcugcugaccaugaaggagaaguccuggcucguccacaagcagugguuccuggaccugccgcuccccuggaccagcggggccagcaccucccaggagacguggaaccggcaggaccugcuggugaccuucaagaccgcccacgcgaagaagcaggagguggucgugcucggcagccaggagggcgccaugcacaccgcccugacgggggccaccgagauccagaccuccggcaugaccacgaucuucgccgggcaccugaagugccgccucaagauggacaagcugacccugaagggcaugagcuacgugaugugcaccggguccuucaagcucgagaaggaggucgcggagacccagcacggcacggugcuggugcagaucaaguacgagggcaccgacgcccccugcaagauccccuucagcacccaggacgagaagggggucacccagaacggccggcugaucacggccaacccgaucgugaccgacaaggagaagcccgugaacaucgaggccgagccgcccuucggggaguccuacaucgucaucggcgcgggcgagaaggcccugaagcucagcugguucaagaagggguccagcaucggcaagauguucgaggccaccgcccgcggggcccggcgcauggcgauccugggcgacaccgccugggacuucggguccgugggcggcguguucacgagcgucgggaagcuggugcaccagaucuucggcaccgccuacgggguccuguucuccggcgucagcuggaccaugaagaucgggaucggcgugcugcugaccuggcucggccugaacucccgcagcacgucccugagcaugaccugcaucgccguggggcucgucacccuguaccugggcgugauggugcaggccgacuccgggugcgucaucaacuggaagggccgggagcucaagugcgggagcggcaucuucgugaccaacgaggugcacacguggaccgagcaguacaaguuccaggcggacagcccgaagcgccuguccgccgccaucggcaaggccugggaggagggggucugcggcauccggagcgccacccgccuggagaacaucauguggaagcagaucuccaacgagcucaaccacauccugcuggagaacgacaugaaguucaccgugguggucggggacguggugggcauccucgcgcaggggaagaagaugauccggccccagcccauggagcacaaguacagcuggaaguccuggggcaaggccaagaucaucggcgccgacguccagaacaccacguucaucaucgacgggcccaacaccccggagugccccgacgaccagcgcgccuggaacaucugggagguggaggacuacggcuucgggaucuucaccaccaacaucuggcugaagcugcgggacagcuacacccaggugugcgaccaccgccucauguccgcggccaucaaggacagcaaggccguccacgccgacaugggcuacuggaucgaguccgagaagaacgagaccuggaagcuggcccgggcgagcuucaucgaggugaagaccugcaucuggcccaagucccacacccuguggagcaacggcgugcucgaguccgagaugaucauccccaagaucuacgggggcccgaucagccagcacaacuaccgccccggguacuucacgcagaccgccggccccuggcaccuggggaagcuggagcucgacuucgaccugugcgagggcaccaccgucgugguggacgagcacugcggcaaccgggggccgucccugcgcacgaccaccgucaccggcaagaucauccacgaguggugcugccggagcugcacgcugccgccccuccgcuucaagggggaggacggcugcugguacgggauggagauccggcccgugaaggagaaggaggagaaccuggugaaguccauggucagcgccggcagcggcgagguggacuccuucagccucgggcugcugugcaucuccaucaugaucgaggaggugaugcgcagccgguggucccgcaagaugcucaugaccggcacccuggccgucuuccugcuccugaucauggggcagcugaccuggaacgaccucauccggcugugcaucauggugggcgccaacgcgagcgaccgcauggggaugggcacgaccuaccuggcccucauggccaccuucaagaugcgcccgauguucgccguggggcugcuguuccggcgccucaccucccgggagguccugcugcucacgaucgggcugagccugguggccuccgucgagcuccccaacagccuggaggagcugggcgacgggcucgcgaugggcaucaugauccugaagcugcucaccgacuuccagucccaccagcugugggccacccugcucagccugaccuucaucaagacgacccugucccuccacuacgccuggaagaccauggccauggugcugagcaucgugucccuguucccccucugccugagcaccacgucccagaagaccaccuggcugcccguccuccugggcagccuggggugcaagccgcucaccauguuccugaucacggagaacaagaucuggggccgcaaguccuggccccugaacgaggggaucauggcggugggcguggucagcauccuccugagcucccugcucaagaacgacgugccccuggccgggccccugaucgccggcggcaugcucaucgccugcuacgugaucagcggguccagcgccgaccugucccuggagaaggcggccgaggucagcugggaggaggaggccgagcacuccggcgccagccacaacauccucguggaggugcaggacgacgggaccaugaagaucaaggacgaggagcgggacgacacccugaccauccugcucaaggccacccugcuggcggucuccggcguguacccgcucagcauccccgccacgcuguucgugugguacuucuggcagaagaagaagcagcgcuccgggguccugugggacacccccagcccgcccgagguggagcgggccgugcuggacgacggcaucuaccgcaucaugcagcggggccuccuggggcgcucccaggucggcguggggguguuccaggagaacgucuuccacaccauguggcacgugacccggggcgccgugcugauguaccaggggaagcgccucgagcccagcugggccuccgucaagaaggaccugaucagcuacggcggcggguggcggcugcagggcuccuggaacacgggggaggagguccaggugaucgcggucgagcccggcaagaaccccaagaacgugcagaccgcccccgggaccuucaagacccccgagggcgaggugggcgccaucgcccucgacuucaagcccgggacgagcggcucccccaucgucaaccgcgaggggaagaucgugggccuguacggcaacgggguggucaccaccagcggcaccuacgugagcgccaucgcgcaggccaaggccucccaggaggggccgcugcccgagaucgaggacgagguguuccggaagcgcaaccucacgaucauggaccugcaccccggcagcgggaagacccggcgcuaccugccggccaucguccgggaggcgaucaagcgcaagcuccggacccugauccuggcccccacccgcgugguggccuccgagauggccgaggcccucaagggcaugcccauccgcuaccagacgaccgcggucaagagcgagcacaccggcaaggagaucguggaccugaugugccacgccaccuucacgaugcggcugcucucccccgugcgcgucccgaacuacaacaugaucaucauggacgaggcccacuucaccgaccccagcuccaucgccgcccggggguacaucagcacccgcgugggcaugggggaggcggccgccaucuucaugaccgccacgccgcccggcuccguggaggccuucccgcagagcaacgcggucauccaggacgaggagcgggacauccccgagcgcuccuggaacagcggguacgaguggaucaccgacuuccccggcaagaccgugugguucgugcccuccaucaagagcggcaacgacaucgccaacugccugcggaagaacgggaagcgcgucauccagcugucccggaagaccuucgacacggaguaccagaagaccaagaacaacgacugggacuacguggugaccaccgacaucagcgagaugggcgccaacuuccgcgccgaccgggucaucgacccgcgccggugccucaagcccgugauccugaaggacgggcccgagcgcgucauccuggcgggccccaugccggugacgguggccuccgccgcccagcggcgcgggcggaucggccgcaaccacaacaaggagggcgaccaguacaucuacauggggcagccccucaacaacgacgaggaccacgcccacuggaccgaggcgaagaugcugcuggacaacaucaacacccccgagggcaucauccccgcccucuucgagccggagcgggagaaguccgccgccaucgacggggaguaccgccugcgcggcgaggcccggaagaccuucgucgagcugaugcgccgcggggaccuccccguguggcuguccuacaagguggcgagcgagggcuuccaguacagcgaccgccgguggugcuucgacggcgagcgcaacaaccagguccuggaggagaacauggacguggagaucuggacgaaggagggggagcggaagaagcuccgcccccgguggcuggacgcccgcaccuacuccgacccccuggcccuccgggaguucaaggaguucgccgccggccgccggagcguguccggggaccugauccuggagaucggcaagcucccgcagcaccugacccagcgcgcgcagaacgcccuggacaaccucgucaugcugcacaacagcgagcagggcgggcgggccuaccgccacgccauggaggagcugcccgacaccaucgagacgcucaugcugcuggcgcucaucgccgugcugaccggcggggugacccuguucuuccucuccggccgggggcugggcaagaccagcaucggccugcucugcgucauggccuccagcgugcugcuguggauggccuccguggagccccacuggaucgccgcgagcaucauccucgaguucuuccugaugguccugcucauccccgagccggaccgccagcggacgccccaggacaaccagcuggccuacguggugaucgggcuccucuucaugauccugacggucgccgccaacgagaugggccugcucgagaccaccaagaaggaccuggggaucggccacguggccguggagaaccaccaccacgcgaccaugcuggacgucgaccuccaccccgccuccgccuggacgcuguacgccguggccaccaccaucaucaccccgaugaugcgccacacgaucgagaacaccaccgcgaacaucagccugaccgccaucgccaaccaggccgccauccucauggggcuggacaagggcuggcccaucuccaagauggacaucggcgugccccugcucgcgcuggggugcuacagccaggucaacccccugacgcucaccgccgccgugcugaugcugguggcccacuacgcgaucaucggcccggggcuccaggccaaggccacccgggaggcccagaagcgcaccgccgcgggcaucaugaagaaccccacggucgacgggaucguggccaucgaccuggaccccguggucuacgacgccaaguucgagaagcagcugggccagaucaugcuccugauccugugcaccucccagauccuccugaugcgcaccaccugggcccugugcgagagcaucacgcucgccaccggcccccugaccacccugugggagggguccccgggcaaguucuggaacacgaccaucgcggugagcauggccaacaucuuccggggguccuaccucgccggcgccggccuggccuucagccugaugaagucccucgggggcgggcgccggggcaccggggcgcagggcgagacccugggcgagaaguggaagcgccagcugaaccagcucuccaagagcgaguucaacaucuacaagcgguccgggaucauggagguggaccgcagcgaggccaaggagggccugaagcgcggggagacgacccgccacgccgucucccggggcaccgccaagcugcgcugguucguggagcggaaccuggugaagcccgaggggaaggucaucgaccucggcugcggccgcgggggcuggagcuacuacugcgcggggcugaagaaggugaccgaggugaagggcuacacgaagggcgggcccggccacgaggagcccaucccgauggccaccuacggguggaaccuggucaagcuccacuccggcaaggacguguucuucacgccgcccgagaagugcgacacccugcugugcgacaucggggagagcucccccaacccgacgaucgaggagggccggacccuccgcgugcugaagauggucgagcccuggcugcgggggaaccaguucugcaucaagauccucaaccccuacaugcccagcgugguggagacccuggagcagaugcagcgcaagcacggcggcaugcugguccggaacccgcucucccgcaacagcacccacgagauguacuggguguccugcgggaccggcaacaucgugagcgccgucaacaugacgucccggaugcugcugaaccgcuucaccauggcccaccgcaagcccaccuacgagcgggacguggaccucggggccggcacccgccacguggcggucgagcccgagguggccaaccuggacaucaucggccagcggaucgagaacaucaagcacgagcacaagagcacguggcacuacgacgaggacaaccccuacaagaccugggccuaccacggguccuacgaggucaagccgagcggcuccgccagcagcauggugaacgggguggucaagcugcucaccaagcccugggacgugauccccauggugacccagaucgccaugacggacaccacccccuucggccagcagcgcgucuucaaggagaagguggacacccggacgccgaaggcgaagcgcgggaccgcccagaucauggaggugaccgcccgguggcuguggggcuuccugucccgcaacaagaagccccggaucugcacccgcgaggaguucacgcggaagguccgcagcaacgccgccaucggcgcgguguucguggacgagaaccaguggaacuccgccaaggaggccgucgaggacgagcgguucugggaccucgugcagaaggagcgcgagcugcacaagcaggggaagugcgcgaccugcguguacaacaugaugggcaagcgggagaagaagcugggggaguucggcaaggcgaaggggagccgcgccaucugguacauguggcucggcgcccgguuccuggaguucgaggcccugggcuucaugaacgaggaccacugguucucccgcgagaacagccucuccggggucgagggcgaggggcugcacaagcugggcuacauccuccgggacaucagcaagauccccgggggcaacauguacgccgacgacaccgcgggcugggacacccgcaucacggaggacgaccugcagaacgaggccaagaucaccgacaucauggagccggagcacgcccugcucgccaccuccaucuucaagcugaccuaccagaacaagguggugcggguccagcgccccgccaagaacgggacggugauggacgugaucagccgccgggaccagcgcggcuccgggcaggucggcaccuacggccugaacaccuucaccaacauggaggcgcagcucauccggcagauggagagcgaggggaucuuccugcccuccgagcuggagacgcccaaccucgccgagcgcgugcuggacuggcuggagaaguacggcguggagcggcucaagcgcauggccaucagcggggacgacugcgucgugaagccgaucgacgaccgguucgccaccgcccugaccgcgcugaacgacaugggcaaggugcgcaaggacaucccccagugggagcccuccaagggguggaacgacuggcagcagguccccuucugcagccaccacuuccaccagcucaucaugaaggacggccgggagaucguggugccgugccgcaaccaggacgagcuggucggccgggcccgcgugucccagggggccggcuggagccugcgggagaccgccugccucggcaagagcuacgcccagauguggcagcugauguacuuccaccgccgggaccugcgccucgcggccaacgccaucugcuccgccgugcccgucgacugggugcccacgagccggaccaccugguccauccacgcgcaccaccaguggaugaccacggaggacaugcugagcguguggaaccgcgucuggaucgaggagaaccccuggauggaggacaagacccacguguccagcuggggcgacgugccguaccuggggaagcgggaggaccaguggugcggcucccucaucggccugaccgcccgcgccaccugggccagcaacauccaggucgccaucaaccaggugcgccggcugaucgggaacgagaacuaccucgacuacaugaccuccaugaagcgcuucaagaacgagggcgaccccgagggggcgcugugguga

SEQ ID NO: 8525 - RNA, 9879 nt, Artificial Sequence
  derived and/or modified CDS sequence (opt1) from DENV-1__FJ882551__SS-prME
agcgugaccaugcugcugaugcugaugcccaccgcccuggccuuccaccucacgacccgcggcggggagccccacaugaucgugagcaagcaggagcggggcaagagccugcuguucaagaccagcgcgggggugaacaugugcacccucaucgccauggaccugggcgaguucugcgaggacacgaugaccuacaagugcccccgcaucaccgaggccgagcccgacgacguggacugcuggugcaacgccaccgacacgugggugaccuacgggaccugcagccagaccggcgagcaccggcgcgacaagcgguccguggcccuggcgccccacgugggccucgggcuggagacgcgcaccgagaccuggaugagcuccgagggcgccuggaagcagauccagcggguggagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugcccgacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaagaucguccaguacgagaaccugaaguacagcgugaucgugaccguccacaccggcgaccagcaccagguggggaacgaguccacggagcacggcaccaccgcgaccaucacgccccaggcccccagcacggagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccagcggggccuccaccagccaggagaccuggaaccggcaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcauguccuacgucaugugcaccgggagcuucaagcuggagaaggagguggcggagacccagcacggcacggugcucguccagaucaaguacgagggcaccgacgcccccugcaagauccccuucuccacccaggacgagaagggggugacccagaacggccggcugaucacggccaacccgaucgugaccgacaaggagaagcccgucaacaucgaggccgagccgcccuucggggagagcuacaucgugaucggcgcgggcgagaaggcccugaagcuguccugguucaagaaggggagcuccaucggcaagauguucgaggccaccgcccgcggggcccggcgcauggcgauccucggcgacaccgccugggacuucgggagcaucggcggcguguucacguccgucgggaagcuggugcaccagaucuucggcaccgccuacggggugcuguucagcggcgucuccuggaccaugaagaucgggaucggcgugcuccugaccuggcugggccucaacagccgcuccacgagccuguccaugaccugcaucgccguggggcuggucacccucuaccugggcgugauggugcaggccgacagcgggugcgucaucaacuggaagggccgggagcugaagugcgggagcggcaucuucgugaccaacgaggugcacacguggaccgagcaguacaaguuccaggcggacuccccgaagcgccucagcgccgccaucggcaaggccugggaggagggggucugcggcauccgguccgccacccgccuggagaacaucauguggaagcagaucagcaacgagcugaaccacauccuccuggagaacgacaugaagcugaccgugguggucggggacguggcgggcauccucgcccaggggaagaagaugauccggccccagcccauggaguacaaguacuccuggaaguccuggggcaaggccaagaucaucggcgccgacgugcagaacaccacguucaucaucgacgggcccaacaccccggagugccccgacgaccagcgcgcguggaacaucugggaggucgaggacuacggcuucgggaucuucaccaccaacaucuggcugaagcugcgggacuccuacacccaggugugcgaccaccgccucaugagcgccgccaucaaggacuccaaggccgugcacgccgacaugggcuacuggaucgagagcgagaagaacgagaccuggaagcuggcgcgggccuccuucaucgaggucaagaccugcaucuggcccaagagccacacccugugguccaacggcgugcucgagagcgagaugaucauccccaagaucuacgggggcccgacgucccagcacaacuaccgccccggguacuucacccagaccgccggccccuggcaccuggggaagcuggagcucgacuucgaccugugcgagggcaccacgguggucguggacgagcacugcggcaaccgggggccgagccugcgcaccaccaccgugacgggcaagaucauccacgaguggugcugccgguccugcacccugccgccccuccgcuucaagggggaggacggcugcugguacgggauggagauccggcccgucaaggagaaggaggagaaccuggucaagagcauggugagcgccggcuccggcgaggucgacagcuucucccucgggcugcugugcaucagcaucaugaucgaggaggugaugcgcucccgguggagccgcaagaugcucaugaccggcacccuggccguguucuuccugcucaucaucgggcagcugacguggaacgaccugauccggcucugcaucauggucggcgcgaacgccuccgaccgcauggggaugggcaccaccuaccuggcccugauggccaccuucaagaugcgcccgauguucgccguggggcuccuguuccggcgccugacgagccgggaggugcuccugcugaccaucgggcucucccuggucgcgagcguggagcugcccaacucccucgaggagcugggcgacgggcuggccaugggcaucaugauccucaagcugcugaccgacuuccagagccaccagcucugggccacccugcugucccucacguucauccgcaccaccuucagccugcacuacgccuggaagaccauggcgaugguccuguccaucgugagccucuucccccugugccuguccacgaccagccagaagaccaccuggcuccccgugcugcugggcucccucgggugcaagccgcugacgauguuccugaucgccgagaacaagaucuggggccgcaagagcuggccccucaacgaggggaucauggccgucggcaucgugagcauccugcuguccagccuccugaagaacgacgugccccuggccgggccccucaucgccggcggcaugcugaucgcgugcuacgucaucuccgggagcuccgccgaccugagccucgagaaggccgccgugguguccugggaggaggaggccgagcacagcggcgcgucccacaacauccuggucgaggugcaggacgacgggaccaugaagaucaaggacgaggagcgcgacgacacccugaccauccuccugaaggccacccugcucgccgugagcggcgucuacccgcuguccauccccgccacgcuguucgugugguacuucuggcagaagaagaagcagcggagcggggugcucugggacacccccagcccgcccgaggucgagcgcgccgugcuggacgacggcaucuaccggaucaugcagcgcggccugcuggggcggagccaggugggcgucgggguguuccaggagaacguguuccacaccauguggcacgucacccgcggcgcggugcucauguaccaggggaagcggcuggagcccuccugggccagcgugaagaaggaccugaucuccuacggcggcggguggcgccuccagggcagcuggaacacgggggaggagguccaggugaucgccguggagcccggcaagaaccccaagaacguccagaccgcccccgggaccuucaagaccuccgagggcgaggugggcgccaucgcgcuggacuucaagcccgggacgagcggcagccccaucgugaaccgggaggggaagaucgucggccuguacggcaacgggguggugaccaccuccggcaccuacgucagcgccaucgcccaggccaaggcgucccaggaggggccccucccggagaucgaggacgagguguuccgcaagcggaaccugacgaucauggaccugcaccccggcagcgggaagacccgccgguaccuccccgccaucgugcgcgaggccaucaagcggaagcugcgcacccugauccucgccccgacccgcgucguggccuccgagauggcggaggcccugaagggcaugcccauccgguaccagacgaccgccgucaagagcgagcacaccggcaaggagaucgucgaccugaugugccacgccaccuucacgaugcgccuccugucccccgugcgggugcccaacuacaacaugaucaucauggacgaggcccacuucaccgacccgagcuccaucgcggcccgcggguacaucagcacccgggucggcaugggggaggccgccgccaucuucaugaccgcgacgccgcccggcuccguggaggccuucccccagagcaacgccgugauccaggacgaggagcgcgacaucccggagcgguccuggaacagcggguacgaguggaucaccgacuuccccggcaagaccgucugguucgugcccuccaucaagagcggcaacgacaucgccaacugccugcgcaagaacgggaagcgggugauccagcucucccgcaagaccuucgacacggaguaccagaagaccaagaacaacgacugggacuacgucgugaccaccgacaucagcgagaugggcgcgaacuuccgggccgaccgcgugaucgacccccggcgcugccugaagccggucauccugaaggacgggcccgagcgggugauccucgccggccccaugcccgucacgguggccuccgccgcgcagcgccgggggcgcaucggccggaaccacaacaaggagggcgaccaguacaucuacauggggcagccgcugaacaacgacgaggaccacgcccacuggaccgaggccaagaugcugcucgacaacaucaacacccccgagggcaucauccccgcccuguucgagcccgagcgcgagaaguccgccgcgaucgacggggaguaccgccugcggggcgaggcccgcaagaccuucguggagcucaugcggcgcggggaccugccggucuggcugagccacaagguggccuccgagggcuuccaguacagcgaccggcgcuggugcuucgacggcgagcggaacaaccaggugcucgaggagaacauggacgucgagaucuggacgaaggagggggagcgcaagaagcugcggccccgcuggcuggacgcccggaccuacuccgacccccucgcccugcgcgaguucaaggaguucgcggccggccggcgcagcguguccggggaccugauccucgagaucggcaagcugccccagcaccugacccagcgggcccagaacgcccucgacaaccuggugaugcugcacaacagcgagcagggcgggcgcgcguaccggcacgccauggaggagcucccggacaccaucgagacgcugaugcugcucgcccugaucgccguccugaccggcggggugacccucuucuuccuguccggccgcgggcugggcaagaccagcaucggccuccugugcgugauggccuccagcguccugcucuggauggcguccguggagccccacuggaucgccgccagcaucauccuggaguucuuccugauggugcuccugauccccgagcccgaccggcagcgcaccccgcaggacaaccagcuggccuacgucgugaucgggcuccuguucaugauccugacgguggccgcgaacgagaugggccuccuggagaccaccaagaaggaccuggggaucggccacgucgccguggagaaccaccaccacgccgccaugcucgacguggaccugcaccccgccuccgcguggacccuguacgccgucgccacgaccaucaucacccccaugaugcggcacaccaucgagaacacgaccgccaacaucagccucaccgccaucgcgaaccaggccgccauccugauggggcuggacaagggcuggccgaucuccaagauggacaucggcgugccccuccuggcccuggggugcuacagccaggugaacccccucacccugacggcggccguccugaugcucguggcccacuacgccaucaucggccccgggcugcaggccaaggcgacccgcgaggcccagaagcgcaccgccgccggcaucaugaagaacccgaccguggacgggaucgucgccaucgaccuggaccccgugguguacgacgcgaaguucgagaagcagcucggccagaucaugcugcugauccucugcacgucccagauccugcugaugcggaccaccugggcccucugcgagagcaucacccuggccacgggcccccugaccacccucugggaggggucccccggcaaguucuggaacaccacgaucgccgucagcauggccaacaucuuccgcgggagcuaccuggcgggcgccggccuggccuucucccucaugaagucccucgggggcgggcggcgcgggaccggggcccagggcgagacccugggcgagaaguggaagcggcagcucaaccagcuguccaagagcgaguucaacaccuacaagcgcuccgggaucauggagguggaccggagcgaggcgaaggagggccugaagcgcggggagacgaccaagcacgccgugucccggggcaccgccaagcuccgcugguucgucgagcggaaccuggugaagccggaggggaaggugaucgaccugggcugcggccgcgggggcuggagcuacuacugcgccgggcugaagaaggucaccgaggugaagggcuacacgaagggcgggcccggccacgaggagcccauccccauggccaccuacggguggaaccucgugaagcugcacuccggcaaggacgucuucuucaucccgcccgagaagugcgacacccugcucugcgacaucggggagagcucccccaaccccaccaucgaggagggccggacgcugcgcgugcugaagaugguggagccguggcuccgggggaaccaguucugcaucaagauccugaaccccuacaugcccagcgucguggagacccuggagcagaugcagcgcaagcacggcggcaugcucgugcggaacccccugucccgcaacagcacccacgagauguacugggucuccugcgggaccggcaacaucgugagcgcggugaacaugaccucccggaugcugcucaaccgcuucacgauggcccaccgcaagccgaccuacgagcgggacgucgaccugggggccggcacccgccacguggccguggagcccgaggucgccaaccuggacaucaucggccagcggaucgagaacaucaagcaggagcacaagagcaccuggcacuacgacgaggacaaccccuacaagacgugggcguaccacggguccuacgaggugaagcccagcggcagcgccuccagcauggucaacgggguggugaagcuccugaccaagccgugggacgucauccccauggugacccagaucgccaugaccgacacgacccccuucggccagcagcgcguguucaaggagaaggucgacacccggacccccaaggccaagcgcgggacggcccagaucauggaggugaccgcgaaguggcuguggggcuuccucucccggaacaagaagccgcgcaucugcacccgggaggaguucacccgcaaggugcggagcaacgccgccaucggcgccgucuucguggacgagaaccaguggaacuccgcgaaggaggccguggaggacgagcgcuucugggaccugguccaccgggagcgcgagcugcacaagcaggggaagugcgccacgugcguguacaacaugaugggcaagcgggagaagaagcucggggaguucggcaaggccaaggggagccgcgccaucugguacauguggcugggcgcgcgguuccuggaguucgaggcccucggcuucaugaacgaggaccacugguucucccgcgagaacagccuguccgggguggagggcgaggggcugcacaagcucggcuacauccugcgggacaucagcaagauccccgggggcaacauguacgccgacgacaccgccggcugggacacccgcaucaccgaggacgaccugcagaacgaggccaagaucacggacaucauggagcccgagcacgcgcuccuggccaaguccaucuucaagcugaccuaccagaacaaggucgugcgggugcagcgcccggccaagaacgggaccgucauggacgugaucagccgccgggaccagcgcggcuccggccaggugggcaccuacggccucaacacguucaccaacauggaggcccagcugauccggcagauggagagcgaggggaucuucucccccagcgagcuggagacccccaaccucgccggccgcguccuggacuggcugaagaagcacgggguggagcggcucaagcgcauggcgaucuccggcgacgacugcguggucaagcccaucgacgaccgguucgccaccgcccugacggcccugaacgacauggggaaggugcgcaaggacaucccgcagugggagcccagcaagggcuggaacgacuggcagcagguccccuucugcagccaccacuuccaccagcucaucaugaaggacggccgggagcuggucgugcccugccgcaaccaggacgagcugguggggcgggcccgcgucucccagggcgcgggguggagccuccgggagaccgccugccugggcaaguccuacgcccagauguggcagcugauguacuuccaccgccgggaccuccgccuggccgcgaacgccaucugcagcgccgugccgguggacuggguccccaccucccggaccacguggagcauccacgcccaccaccaguggaugaccaccgaggacaugcuguccguguggaaccgcguguggaucgaggagaaccccuggauggaggacaagacccacaucagcuccuggggcgacguccccuaccucggcaagcgggaggaccaguggugcggcagccugaucgggcugacggcccgcgcgaccugggccaccaacauccagguggccaucaaccaggugcgccggcuccugggcaacgagaacuaccuggacuacaugaccuccaugaagcgcuucaagaacgagagcgacccggagggggcccucugguga

SEQ ID NO: 8526 - RNA, 9879 nt, Artificial Sequence
  derived and/or modified CDS sequence (opt1) from DENV-1__FJ882552__SS-prME
agcgugaccaugcugcucaugcugaugcccaccgcccuggccuuccaccucacgacccggggcggggagccccacaugaucgugagcaagcaggagcggggcaagagccugcuguucaagaccagcgcgggggugaacaugugcacccucaucgccauggaccugggcgaguucugcgaggacacgaugaccuacaagugcccccgcaucaccgaggccgagcccgacgacguggacugcuggugcaacgccaccgacacgugggugaccuacgggaccugcagccagaccggcgagcaccggcgggacaagcgguccguggcccuggcgccccacgugggccucgggcuggagacgcgcaccgagaccuggaugagcuccgagggcgccuggaagcagauccagcgggucgagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugcccgacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaagaccguccaguacgagaaccugaaguacagcgugaucgugaccguccacacgggcgaccagcaccagguggggaacgaguccaccgagcacggcaccaccgcgaccaucacgccccaggcccccagcaccgagauccagcugaccgacuacggggcccucacccuggacugcagcccccggacgggccuggacuucaacgagaugguccuccugaccaugaaggagaaguccuggcuggugcacaagcagugguuccucgaccugccgcugcccuggaccagcggggccuccaccagccaggagacguggaaccggaaggaccuccuggugaccuucaagaccgcccacgcgaagaagcaggaggucguggugcugggcucccaggagggcgccaugcacaccgcccucacgggggccaccgagauccagaccagcggcaccacgaccaucuucgccgggcaccugaagugccgccugaagauggacaagcucacccugaagggcauguccuacgucaugugcaccgggagcuucaagcuggagaaggagguggcggagacgcagcacggcaccgugcucguccagaucaaguacgagggcaccgacgcccccugcaagauccccuucuccacccaggacgagaagggggugacgcagaacggccggcugaucaccgccaacccgaucgugaccgacaaggagaagcccgucaacaucgaggccgagccgcccuucggggagagcuacaucgugaucggcgcgggcgagaaggcccugaagcuguccugguucaagaaggggagcuccaucggcaagauguucgaggccaccgcccgcggggcccggcgcauggcgauccucggcgacacggccugggacuucgggagcaucggcggcguguucaccuccgucgggaagcuggugcaccagaucuucggcaccgccuacggggugcuguucagcggcgucuccuggaccaugaagaucgggaucggcgugcuccugacguggcugggccucaacagccgcuccaccagccuguccaugaccugcaucgccguggggcuggucacccucuaccugggcgugauggugcaggccgacagcgggugcgucaucaacuggaagggccgggagcugaagugcgggagcggcaucuucgugacgaacgaggugcacaccuggaccgagcaguacaaguuccaggcggacuccccgaagcgccucagcgccgccaucggcaaggccugggaggagggggucugcggcauccgguccgccacccgccuggagaacaucauguggaagcagaucagcaacgagcugaaccacauccuccuggagaacgacaugaaguucaccgugguggucggggacguggcgggcauccuggcccaggggaagaagaugauccggccccagcccauggaguacaaguacuccuggaaguccuggggcaaggccaagaucaucggcgccgacgugcagaacacgaccuucaucaucgacgggcccaacaccccggagugccccgacgaccagcgcgcguggaacaucugggaggucgaggacuacggcuucgggaucuucaccacgaacaucuggcucaagcugcgggacuccuacacccaggugugcgaccaccgccugaugagcgccgccaucaaggacuccaaggccgugcacgccgacaugggcuacuggaucgagagcgagaagaacgagaccuggaagcucgcgcgggccuccuucaucgaggucaagaccugcaucuggcccaagagccacacgcugugguccaacggcgugcuggagagcgagaugaucauccccaagaucuacgggggcccgaucucccagcacaacuaccgccccggguacuucacccagaccgccggccccuggcaccucgggaagcuggagcuggacuucgaccucugcgagggcaccacgguggucguggacgagcacugcggcaaccgggggccgagccugcgcaccaccaccgugacgggcaagaucauccacgaguggugcugccgguccugcacccugccgccccugcgcuucaagggggaggacggcugcugguacgggauggagauccggcccgucaaggagaaggaggagaaccuggucaagagcauggugagcgccggcuccggcgaggucgacagcuucucccuggggcuccugugcaucagcaucaugaucgaggaggugaugcgcucccgguggagccgcaagaugcugaugaccggcacccucgccguguucuuccugcugaucauggggcagcucacguggaacgaccugauccggcugugcaucauggucggcgcgaacgccuccgaccgcauggggaugggcaccaccuaccucgcccugauggccaccuucaagaugcgcccgauguucgccguggggcuccuguuccggcgccugacgagccgggaggugcugcuccugaccaucgggcugucccucgucgcgagcguggagcugcccaacucccuggaggagcucggcgacgggcuggccaugggcaucaugauccugaagcuccugaccgacuuccagagccaccagcugugggccacccuccugucccugacguucaucaagaccaccagcucccuccacuacgccuggaagaccauggcgaugguccugagcaucgugucccuguucccccucugccugagcacgaccucccagaagaccaccuggcugcccgugcuccugggcagccuggggugcaagccgcucacgauguuccugaucgccgagaacaagaucuggggccgcaagagcuggccccugaacgaggggaucauggccgucggcaucguguccauccuccugagcucccugcucaagaacgacgugccccuggccgggccccugaucgccggcggcaugcucaucgcgugcuacgucaucagcggguccagcgccgaccugucccuggagaaggccgccgaggugagcugggaggaggaggccgagcacuccggcgcgagccacaacauccucguggagguccaggacgacgggaccaugaagaucaaggacgaggagcgggacgacacccugaccauccugcucaaggccacccugcuggccguguccggcguguacccgcucagcauccccgccacgcuguucgucugguacuucuggcagaagaagaagcagcgcuccggggugcugugggacacccccagcccgcccgagguggagcgggccguccucgacgacggcaucuaccgcaucaugcagcggggccugcuggggcgcucccaggugggcgugggggucuuccaggagaacguguuccacaccauguggcacgugacccggggcgcgguccugauguaccaggggaagcgccucgagcccagcugggccuccgugaagaaggaccugaucagcuacggcggcggguggcggcugcagggcuccuggaacacgggggaggaggugcaggucaucgccguggagcccggcaagaaccccaagaacgugcagaccgcccccgggaccuucaagaccagcgagggcgaggucggcgccaucgcgcucgacuucaagcccgggacgagcggcucccccaucgugaaccgcgaggggaagaucgugggccuguacggcaacggggucgugaccaccagcggcaccuacguguccgccaucgcccaggccaaggcgagccaggaggggccccugccggagaucgaggacgaggucuuccggaagcgcaaccucacgaucauggaccugcaccccggcuccgggaagacccggcgcuaccugcccgccaucgugcgggaggccaucaagcgcaagcuccggacccugauccuggccccgacccgcguggucgccagcgagauggcggaggcccucaagggcaugcccauccgcuaccagacgaccgccgugaaguccgagcacaccggcaaggagaucguggaccugaugugccacgccaccuucacgaugcggcugcucagccccguccgcgugcccaacuacaacaugaucaucauggacgaggcccacuucaccgacccguccagcaucgcggcccggggguacaucuccacccgcgugggcaugggggaggccgccgccaucuucaugaccgcgacgccgcccggcagcgucgaggccuucccccaguccaacgccgugauccaggacgaggagcgggacaucccggagcgcagcuggaacuccggguacgaguggaucaccgacuuccccggcaagaccgugugguucguccccagcaucaaguccggcaacgacaucgccaacugccugcggaagaacgggaagcgcgugauccagcugagccggaagaccuucgacacggaguaccagaagaccaagaacaacgacugggacuacguggucaccaccgacaucuccgagaugggcgcgaacuuccgcgccgaccgggugaucgacccccgccggugccucaagccggugauccugaaggacgggcccgagcgcgucauccuggccggccccaugcccgugacggucgccagcgccgcgcagcggcgcgggcggaucggccgcaaccacaacaaggagggcgaccaguacaucuacauggggcagccgcucaacaacgacgaggaccacgcccacuggaccgaggccaagaugcugcuggacaacaucaacacccccgagggcaucauccccgcccucuucgagcccgagcgggagaaguccgccgcgaucgacggggaguaccgccugcgcggcgaggcccggaagaccuucguggagcugaugcgccgcggggaccucccgguguggcuguccuacaaggucgccagcgagggcuuccaguacuccgaccgccgguggugcuucgacggcgagcgcaacaaccaggugcuggaggagaacauggacguggagaucuggacgaaggagggggagcggaagaagcuccgcccccgguggcuggacgcccgcaccuacagcgacccccuggcccuccgggaguucaaggaguucgcggccggccgccgguccgucagcggggaccugauccuggagaucggcaagcucccccagcaccugacccagcgcgcccagaacgcccuggacaaccucgugaugcugcacaacuccgagcagggcgggcgggcguaccgccacgccauggaggagcugccggacaccaucgagacgcucaugcugcuggcccucaucgccgugcugaccggcggggucacccuguucuuccucagcggccgggggcugggcaagaccuccaucggccugcucugcgugauggccagcuccgugcugcuguggauggcgagcgucgagccccacuggaucgccgccuccaucauccucgaguucuuccugauggugcugcucauccccgagcccgaccgccagcggaccccgcaggacaaccagcuggccuacguggucaucgggcuccucuucaugauccugacgguggccgcgaacgagaugggccugcucgagaccaccaagaaggaccuggggaucggccacguggccgucgagaaccaccaccacgccgccaugcuggacguggaccuccaccccgccagcgcguggacccuguacgccguggccacgaccaucaucacccccaugaugcgccacaccaucgagaacacgaccgccaacaucucccugaccgccaucgcgaaccaggccgccauccucauggggcuggacaagggcuggccgaucagcaagauggacaucggcgucccccugcucgcccuggggugcuacucccaggugaacccccugacccucacggcggccgugcugaugcuggucgcccacuacgccaucaucggccccgggcuccaggccaaggcgacccgggaggcccagaagcgcaccgccgccggcaucaugaagaacccgaccguggacgggaucguggccaucgaccuggaccccgucguguacgacgcgaaguucgagaagcagcugggccagaucaugcuccugauccugugcacgagccagauccuccugaugcgcaccaccugggcccugugcgaguccaucacccucgccacgggcccccugaccacccugugggaggggagccccggcaaguucuggaacaccacgaucgccgugagcauggccaacaucuuccggggguccuaccucgcgggcgccggccuggccuucagccugaugaagucccucgggggcgggcgccggggcaccggggcccagggcgagacccugggcgagaaguggaagcgccagcugaaccagcucagcaaguccgaguucaacaccuacaagcggagcgggaucauggaggucgaccgcuccgaggcgaaggagggccugaagcgcggggagacgaccaaccacgccgugagccgcggcaccgccaagcugcggugguucguggagcgcaaccucgucaagccggaggggaaggugaucgaccugggcugcggccgcggcgggugguccuacuacugcgccgggcugaagaaggugaccgaggucaagggguacacgaagggcgggcccggccacgaggagcccauccccauggccaccuacggguggaaccuggugaagcuccacagcggcaaggacguguucuucaucccgcccgagaagugcgacacccugcugugcgacaucggggaguccagccccaaccccaccaucgaggagggccgcacgcuccggguccugaagaugguggagccguggcugcgcgggaaccaguucugcaucaagauccucaaccccuacaugcccuccguggucgagacccuggagcagaugcagcggaagcacggcggcaugcuggugcgcaacccccucagccggaacuccacccacgagauguacugggugagcugcgggaccggcaacaucgucuccgcggugaacaugaccagccgcaugcugcugaaccgguucacgauggcccaccgcaagccgaccuacgagcgcgacguggaccucggggccggcacccggcacgucgccguggagcccgagguggccaaccuggacaucaucggccagcgcaucgagaacaucaagcacgagcacaaguccaccuggcacuacgacgaggacaaccccuacaagacgugggcguaccacgggagcuacgaggucaagcccagcggcuccgccagcuccauggugaacggggucgugaagcugcucaccaagccgugggacgugauccccauggucacccagaucgccaugaccgacacgacccccuucggccagcagcggguguucaaggagaagguggacacccgcacccccaaggccaagcgggggacggcccagaucauggaggucaccgcgaaguggcuguggggcuuccugagccgcaacaagaagccgcggaucugcacccgcgaggaguucacccggaaggugcgcuccaacgccgccaucggcgccguguucgucgacgagaaccaguggaacagcgcgaaggaggccguggaggacgagcgguucugggaccucgugcaccgcgagcgggagcugcacaagcaggggaagugcgccacgugcgucuacaacaugaugggcaagcgcgagaagaagcugggggaguucggcaaggccaaggggucccgggccaucugguacauguggcucggcgcgcgcuuccuggaguucgaggcccugggcuucaugaacgaggaccacugguucagccgggagaacucccucagcgggguggagggcgaggggcugcacaagcugggcuacauccuccgcgacaucuccaagauccccgggggcaacauguacgccgacgacaccgccggcugggacacccggaucaccgaggacgaccugcagaacgaggccaagaucacggacaucauggagcccgagcacgcgcugcucgccaagagcaucuucaagcugaccuaccagaacaaggugguccgcgugcagcggccggccaagaacgggaccgugauggacgucaucucccgccgcgaccagcggggcagcggccaggugggcaccuacggccugaacacguucaccaacauggaggcccagcucauccgccagauggaguccgaggggaucuucagccccuccgagcuggagacccccaaccuggcccggcgcgugcucgacuggcuggagaagcacggcgucgagcggcugaagcgcauggcgaucagcggggacgacugcguggugaagcccaucgacgaccgguucgccaccgcccucacggcccugaacgacaugggcaagguccgcaaggacaucccgcagugggagcccagcaagggguggaacgacuggcagcagguccccuucugcucccaccacuuccaccagcugaucaugaaggacggccgggagaucgugguccccugccgcaaccaggacgagcucgugggccgggcccgcgugagccagggggcgggcuggucccugcgggagaccgccugccugggcaagagcuacgcccagauguggcagcucauguacuuccaccgccgggaccugcgccuggccgcgaacgccaucugcuccgccgucccgguggacugggugcccaccagccggaccacgugguccauccacgcccaccaccaguggaugaccaccgaggacaugcucagcgucuggaaccgcguguggaucgaggagaaccccuggauggaggacaagacccacaucuccagcuggggcgacgugcccuaccuggggaagcgggaggaccaguggugcggcucccugaucggccucacggcccgcgcgaccugggccaccaacauccaggucgccaucaaccaggugcgccggcugaucgggaacgagaacuaccuggacuacaugaccagcaugaagcgcuucaagaacgaguccgacccggagggcgcccucugguga

SEQ ID NO: 8527 - RNA, 9879 nt, Artificial Sequence
  derived and/or modified CDS sequence (opt1) from DENV-1__FJ882553__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccgcaucaccgagaccgagcccgacgacguggacugcuggugcaacgccacggacaccugggugaccuacgggaccugcagccagacgggcgagcaccggcgcgacaagcgguccguggcccucgcgccccacgugggccuggggcuggagacccgcaccgagaccuggaugagcuccgagggcgccuggaagcagauccagcgggucgagacgugggcccuccgccaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagguggccgagacccagcacggcaccgugcugguccagaucaaguacgagggcaccgacgcgcccugcaagauccccuucagcacgcaggacgagaagggggugacccagaacggccggcugaucaccgccaacccgaucgugaccgacaaggagaagcccgucaacaucgaggccgagccgcccuucggggaguccuacaucgugaucggcgccggcgagaaggcgcugaagcucagcugguuccgcaagggguccagcaucggcaagauguucgaggccacggcccgcggggcccgccgcauggccauccugggcgacaccgcgugggacuucggguccaucggcggcguguucaccagcgucgggaagcuggugcaccagaucuucggcaccgccuacggggugcuguucuccggcgucagcuggacgaugaagaucgggaucggcgugcugcugaccuggcucggccugaacucccggagcaccucccugagcaugaccugcaucgccguggggcucgucacgcuguaccugggcgugauggugcaggccgacuccgggugcgucaucaacuggaagggccgcgagcucaagugcgggagcggcaucuucgugaccaacgaggugcacaccuggaccgagcaguacaaguuccaggccgacagcccgaagcggcuguccgcggccaucggcaaggccugggaggagggggucugcggcauccgcagcgccacccggcuggagaacaucauguggaagcagaucuccaacgagcucaaccacauccugcuggagaacgacaugaaguucacggugguggucggggacguggccggcauccucgcgcaggggaagaagaugauccgcccccagcccauggaguacaaguacagcuggaaguccuggggcaaggccaagaucaucggcgccgacgugcagaacaccaccuucaucaucgacgggcccaacaccccggagugccccgacgaccagcgggccuggaacaucugggaggucgaggacuacggcuucgggaucuucacgaccaacaucuggcugaagcugcgcgacagcuacacccaggugugcgaccaccggcucauguccgcggccaucaaggacagcaaggccgugcacgccgacaugggcuacuggaucgaguccgagaagaacgagaccuggaagcuggcccgcgcgagcuucaucgaggucaagacgugcaucuggcccaagucccacacccuguggagcaacggcgugcucgaguccgagaugaucauccccaagaucuacgggggcccgaucagccagcacaacuaccggcccggguacuucacccagaccgccggccccuggcaccuggggaagcuggagcucgacuucgaccugugcgagggcacgaccguggucguggacgagcacugcggcaaccgcgggccgucccugcggaccaccacggugaccggcaagaucauccacgaguggugcugccgcagcugcacccugccgccccuccgguuccgcggggaggacggcugcugguacgggauggagauccggcccgucaaggagaaggaggagaaccuggugaaguccauggugagcgccggcagcggcgaggucgacuccuucagccucgggcugcugugcaucuccaucaugaucgaggaggugaugcgcagccgguggucccgcaagaugcucaugaccggcacgcuggccguguucuuccugcucaucauggggcagcugaccuggaacgaccugauccgccucugcaucauggucggcgccaacgcgagcgaccggauggggaugggcaccaccuaccuggcccugauggccacguucaagaugcgcccgauguucgccgugggccuccuguuccggcgccugaccucccgggaggugcuccugcugaccaucgggcucagccuggucgccuccguggagcugcccaacagccucgaggagcugggcgacgggcuggcgaugggcaucaugauccucaagcugcugaccgacuuccagucccaccagcucugggccacgcugcugagccucaccuucaucaagaccaccuucucccugcacuacgccuggaagacgauggccaugguccugagcaucgugucccucuucccccugugccugagcaccaccucccagaagaccacguggcuccccgugcugcugggcagccucgggugcaagccgcugaccauguuccugaucgcggagaacaagaucuggggccgccgguccuggccccucaacgaggggaucauggccgucggcaucgugagcauccugcugagcucccuccugaagaacgacgugccccuggccgggccccucaucgccggcggcaugcugaucgccugcuacgucaucagcggguccagcgcggaccugucccucgagaaggccgccgaggugagcugggaggaggaggccgagcacuccggcgccagccacaacauccugguggagguccaggacgacgggaccaugaagaucaaggacgaggagcgcgacgacacccugaccauccuccugaaggcgacgcugcucgccguguccggcguguacccgcugagcauccccgccacccuguucgucugguacuucuggcagaagaagaagcagcgguccggggugcucugggacacccccagcccgcccgagguggagcgcgccguccuggacgacggcaucuaccggaucaugcagcgcggccugcuggggcggucccaggugggcgugggggucuuccaggagaacguguuccacaccauguggcacgugacgcgcggcgccguccucauguaccaggggaagcggcuggagcccagcugggcguccgugaagaaggaccugaucagcuacggcggcggguggcgccuccagggcuccuggaacaccggggaggaggugcaggucaucgccguggagcccggcaagaaccccaagaacgugcagaccgcccccgggaccuucaagacgcccgagggcgaggucggcgccaucgcccuggacuucaagcccgggaccagcggcucccccaucgugaaccgggaggggaagaucgugggccuguacggcaacggggucgugaccaccagcggcacguacgugagcgcgaucgcccaggccaaggccucccaggaggggccgcuccccgagaucgaggacgaggucuuccgcaagcggaaccugaccaucauggaccugcaccccggcagcgggaagacccgccgguaccucccggcgaucgugcgcgaggccaucaagcgcaagcugcggacccugauccucgcccccacgcgcguggucgccuccgagauggccgaggcgcugaagggcaugcccauccgguaccagaccaccgccgucaagagcgagcacaccggcaaggagaucguggaccugaugugccacgccacguucaccaugcgccuccugucccccguccgggugccgaacuacaacaugaucaucauggacgaggcccacuucaccgaccccagcuccaucgccgcgcgcggguacaucagcacccgggugggcaugggggaggccgccgccaucuucaugacggccacgccgcccggcuccgucgaggcguucccgcagagcaacgccgugauccaggacgaggagcgcgacauccccgagcgguccuggaacagcggguacgaguggaucaccgacuuccccggcaagaccgugugguucguccccuccaucaagagcggcaacgacaucgccaacugccugcgcaagaacgggaagcgggugauccagcucucccgcaagacguucgacaccgaguaccagaagaccaagaacaacgacugggacuacguggucaccacggacaucagcgagaugggcgccaacuuccgggcggaccgcgugaucgacccgcggcgcugccugaagcccgugauccugaaggacgggcccgagcgggucauccucgccggccccaugccggugaccgucgccuccgccgcccagcgccgggggcgcaucggccgcaaccacaacaaggagggcgaccaguacaucuacauggggcagccccugaacaacgacgaggaccacgcgcacuggaccgaggccaagaugcugcucgacaacaucaacacccccgagggcaucauccccgcccuguucgagccggagcgggagaaguccgccgccaucgacggggaguaccgccugcggggcgaggcgcgcaagacguucguggagcucaugcggcgcggggaccugcccguguggcuguccuacaaggucgccagcgagggcuuccaguacagcgaccggcgcuggugcuucgacggcgagcggaacaaccaggugcucgaggagaacauggacguggagaucuggaccaaggagggggagcgcaagaagcugcggccccgcuggcuggacgcccggaccuacuccgacccccucgcccugcgcgaguucaaggaguucgccgcgggccggcgcagcgucuccggggaccugauccucgagaucggcaagcugccgcagcaccugacccagcgggcccagaacgcccucgacaaccuggugaugcugcacaacagcgagcagggcgggcgcgccuaccggcacgcgauggaggagcuccccgacacgaucgagacccugaugcugcucgcccugaucgccgugcugaccggcggggucacccucuucuuccuguccggccgcgggcugggcaagaccagcaucggccuccugugcgugauggccuccagcgugcugcucuggauggccuccgucgagccccacuggaucgcggccagcaucauccuggaguucuuccugauggugcuccugauccccgagccggaccggcagcgcacgccccaggacaaccagcuggccuacguggucaucgggcuccuguucaugauccugaccguggccgccaacgagaugggccuccuggagaccaccaagaaggaccuggggaucggccacguggcggucgagaaccaccaccacgccgccaugcucgacguggaccugcaccccgccuccgccuggacgcuguacgcgguggccaccaccaucaucaccccgaugaugcgccacacgaucgagaacaccaccgccaacaucagccucaccgccaucgccaaccaggcggccauccugauggggcuggacaagggcuggcccaucuccaagauggacaucggcgucccccuccuggcccuggggugcuacagccaggugaacccccucacgcugaccgccgcggugcugaugcucgucgcccacuacgccaucaucggcccggggcugcaggccaaggccacccgggaggcgcagaagcgcaccgccgccggcaucaugaagaaccccacgguggacgggaucguggccaucgaccuggaccccgucguguacgacgccaaguucgagaagcagcucggccagaucaugcugcugauccucugcaccucccagauccugcugaugcggaccaccugggcgcucugcgagagcaucacgcuggccaccggcccccugaccacccucugggagggguccccgggcaaguucuggaacacgaccaucgccgugagcauggccaacaucuuccgcggguccuaccuggccggcgcgggccuggccuucagccucaugaagucccucgggggcgggcggcgcgggaccggggcccagggcgagacccugggcgagaaguggaagcggcagcucaaccagcuguccaagagcgaguucaacacguacaagcgcuccgggaucauggaggucgaccggagcgaggccaaggagggccugaagcgcggggagaccaccaagcacgcggugucccggggcaccgccaagcuccgcugguucguggagcggaaccuggucaagcccgaggggaaggugaucgaccugggcugcggccgcgggggcuggagcuacuacugcgccgggcugaagaaggugacggaggucaagggcuacaccaagggcgggcccggccacgaggagcccaucccgauggccaccuacggguggaaccucgugaagcugcacuccggcaaggacguguucuucaucccgcccgagaagugcgacacccugcucugcgacaucggggagagcucccccaacccgacgaucgaggagggccggacccugcgcguccugaagaugguggagcccuggcuccgggggaaccaguucugcaucaagauccugaaccccuacaugcccagcguggucgagacccuggagcagaugcagcgcaagcacggcggcaugcucgugcggaacccgcugucccgcaacagcacccacgagauguacuggguguccugcgggaccggcaacaucgucagcgccgugaacaugacgucccgcaugcugcucaaccgguucaccauggcgcaccgcaagcccaccuacgagcgggacguggaccugggggccggcacccgccacgucgccguggagcccgagguggccaaccuggacaucaucggccagcggaucgagaacaucaagcacgagcacaagagcacguggcacuacgacgaggacaaccccuacaagaccugggccuaccacggguccuacgaggucaagccgagcggcuccgcgagcagcauggugaacggggucgugaagcuccugaccaagcccugggacgugauccccauggucacccagaucgccaugacggacaccacccccuucggccagcagcgcguguucaaggagaagguggacacccggacgccgaaggccaagcgcgggaccgcccagaucauggaggucaccgccaaguggcuguggggcuuccucucccggaacaagaagccccgcaucugcacccgggaggaguucacgcgcaaggugcggagcaacgcggccaucggcgccguguucgucgacgagaaccaguggaacuccgccaaggaggcgguggaggacgagcgcuucugggaccuggugcaccgggagcgcgagcugcacaagcaggggaagugcgcgaccugcgucuacaacaugaugggcaagcgggagaagaagcucggggaguucggcaaggccaaggggagccgcgccaucugguacauguggcugggcgcccgguuccuggaguucgaggcgcucggcuucaugaacgaggaccacugguucucccgcgagaacagccuguccgggguggagggcgaggggcugcacaagcucggcuacauccugcgggacaucagcaagauccccgggggcaacauguacgccgacgacaccgccggcugggacacccgcaucacggaggacgaccugcagaacgaggcccgcaucaccgacaucauggagccggagcacgcccuccuggcgaaguccaucuucaagcugaccuaccagaacaaggugguccgggugcagcgccccgccaagaacgggaccgugauggacgucaucagccggcgcgaccagcggggcuccggccaggugggcacguacggccucaacaccuucaccaacauggaggcccagcugauccgccagauggagagcgaggggaucuucucccccagcgagcuggagacccccaaccucgccgagcgggugcuggacuggcuggagaaguacggcgucgagcgccucaagcggauggccaucuccggggacgacugcguggugaagccgaucgacgaccgcuucgcgacggcccugaccgcccugaacgacaugggcaagguccggaaggacaucccccagugggagcccagcaagggguggaacgacuggcagcagguccccuucugcucccaccacuuccaccagcucaucaugaaggacggccgcgagaucguggucccgugccggaaccaggacgagcuggugggccgcgcccgggugagccagggggccggcuggagccugcgcgagaccgcgugccucgggaaguccuacgcccagauguggcagcugauguacuuccaccggcgcgaccugcggcucgccgccaacgcgaucugcagcgccguccccguggacuggauccccaccucccgcacgaccuggagcauccacgcccaccaccaguggaugaccaccgaggacaugcuguccguguggaaccgcgucuggaucgaggagaaccccuggauggaggacaagacgcacaucagcuccuggggcgacgugccguaccuggggaagcgggaggaccaguggugcggcagccucaucggccugaccgcccgcgccaccugggcgaccaacauccagguggccaucaaccagguccggcgccugaucgggaacgagaacuaccucgacuacaugaccuccaugaagcgguucaagaacgagagcgagcccgagggcgcccugugguga

SEQ ID NO: 8528 - RNA, 9879 nt, Artificial Sequence
  derived and/or modified CDS sequence (opt1) from DENV-1__FJ882554__SS-prME
agcgugaccaugcugcucaugcugaugcccaccgcccuggccuuccaccucaccacccggggcggggagccccacaugaucgugagcaagcaggagcggggcaagagccugcuguucaagaccuccgccggggugaacaugugcacccucaucgccauggaccugggcgagcugugcgaggacacgaugaccuacaagugcccccgcaucaccgagaccgagcccgacgacguggacugcuggugcaacgccacggacaccugggugaccuacgggaccugcagccagacgggcgagcaccggcgcgacaagcgguccguggcccucgcgccccacgugggccuggggcuggagacccgcaccgagaccuggaugagcuccgagggcgcguggaagcagauccagcgggucgagacgugggcccuccgccaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagguggccgagacccagcacggcaccgugcugguccagaucaaguacgagggcaccgacgcgcccugcaagauccccuuccugacgcaggacgagaagggggugacccagaacggccggcugaucaccgccaacccgaucgugaccgacaaggagaagcccgucaacaucgaggccgagccgcccuucggggagagcuacaucgugaucggcgccggcgagaaggcgcucaagcuguccugguucaagaaggggagcuccaucggcaagauguucgaggccacggcccgcggggcccggcgcauggccauccugggcgacaccgcgugggacuucgggagcaucggcggcguguucaccuccgucgggaagcucgugcaccagaucuucggcaccgccuacggggugcuguucagcggcgucuccuggacgaugaagaucgggaucggcgugcugcucaccuggcugggccugaacagccgcuccaccagccucuccaugaccugcaucgccguggggcuggucacgcuguaccucggcgugauggugcaggccgacagcgggugcgucaucaacuggaagggccgggagcugaagugcggguccggcaucuucgugaccaacgaggugcacaccuggaccgagcaguacaaguuccaggccgacagcccgaagcgccugagcgcggccaucggcaaggccugggaggagggggucugcggcauccgguccgccacccgccucgagaacaucauguggaagcagaucagcaacgagcugaaccacauccugcucgagaacgacaugaaguucacggugguggucggggacguggccggcauccuggcgcaggggaagaagaugauccggccccagcccauggaguacaaguacuccuggaaguccuggggcaaggccaagaucaucggcgccgacgugcagaacaccaccuucaucaucgacgggcccaacaccccggagugccccgacgaccagcgcgccuggaacaucugggaggucgaggacuacggcuucgggaucuucacgaccaacaucuggcugaagcuccgggacuccuacacccaggugugcgaccaccgccugaugagcgcggccaucaaggacuccaaggccgugcacgccgacaugggcuacuggaucgagagcgagaagaacgagaccuggaagcuggcccgggcguccuucaucgaggucaagacgugcaucuggcccaagagccacacccucugguccaacggcgugcuggagagcgagaugaucauccccaagaucuacgggggcccgaucucccagcacaacuaccgccccggguacuucacccaggccgccggccccuggcaccuggggaagcucgagcuggacuucgaccugugcgagggcaccacgguggucguggacgagcacugcggcaaccgggggccgagccuccgcaccaccaccgugacgggcaagaucauccacgaguggugcugccgguccugcacccugccgccccugcgcuuccgcggggaggacggcugcugguacgggauggagauccgccccgucaaggagaaggaggagaaccucgucaagagcaugguguccgccggcagcggcgaggucgacagcuucucccuggggcugcucugcaucagcaucaugaucgaggaggugaugcggucccgcuggagccggcgcaugcugaugaccggcacccuggccguguucuuccuccugaucauggggcagcugacguggaacgaccucauccgccugugcaucauggucggcgcgaacgccuccgaccggauggggaugggcaccaccuaccuggcccucauggccaccuucaagaugcgcccgauguucgccgugggccugcuguuccggcgccucacgagccgggaggugcugcugcucaccaucgggcugucccuggucgcgagcguggagcuccccaacucccuggaggagcugggcgacgggcucgccaugggcaucaugauccugaagcugcucaccgacuuccagagccaccagcugugggccacccugcucucccugacguucaucaagaccaccuucagccugcacuacgccuggaagaccauggcgaugguccucuccaucgugagccuguucccccugugccucuccacgaccagccagaagaccaccuggcugcccgugcugcucggcucccuggggugcaagccgcugacgauguuccucaucgccgagaacaagaucuggggccgccggagcuggccccugaacgaggggaucauggccgucggcaucguguccauccugcucagcagccugcugaagaacgacgugccccucgccgggccccugaucgccggcggcaugcugaucgcgugcuacgucaucuccgggagcuccgccgaccucagccuggagaaggccgccgagguguccugggaggaggaggccgagcacagcggcgcgucccacaacauccugguggagguccaggacgacgggaccaugaagaucaaggacgaggagcgcgacgacacccucaccauccugcugaaggccacccuccuggccgugagcggcguguacccgcuguccauccccgccacccuguucgucugguacuucuggcagaagaagaagcagcggagcggggugcugugggacacccccagcccgcccgagguggagcgcgccguccuggacgacggcaucuaccggaucaugcagcgcggccugcucgggcggagccaggugggcgugggggucuuccaggagaacguguuccacaccauguggcacgugacccgcggcgcgguccugauguaccaggggaagcggcuggagcccuccugggccagcgugaagaaggaccucaucuccuacggcggcggguggcgccugcagggcagcuggaacacgggggaggaggugcaggucaucgccguggagcccggcaagaaccccaagaacgugcagaccgcccccgggaccuucaagacccccgagggcgaggucggcgccaucgcgcuggacuucaagcccgggacguccggcagccccaucgugaaccgggaggggaagaucgugggccucuacggcaacggggucgugaccaccuccggcaccuacgugagcgccaucgcccaggccaaggcgagccaggaggggccgcugcccgagaucgaggacgaggucuuccgcaagcggaaccugacgaucauggaccuccaccccggcuccgggaagacccgccgguaccugccggccaucgugcgcgaggccaucaagcgcaagcugcggacccucauccuggcccccacccgcguggucgccagcgagauggcggaggcccugaagggcaugcccauccgguaccagacgaccgccgugaaguccgagcacaccggcaaggagaucguggaccucaugugccacgccaccuucacgaugcgccugcugagccccguccgggugccgaacuacaacaugaucaucauggacgaggcccacuucaccgaccccuacuccaucgcggcccgcggguacaucagcacccgggugggcaugggggaggccgccgccaucuucaugaccgcgacgccgcccggcuccgucgaggccuucccgcagagcaacgccgugaucaaggacgaggagcgcgacauccccgagcgguccuggaacagcggguacgaguggaucaccgacuuccccggcaagaccgugugguucguccccuccaucaagagcggcaacgacaucgccaacugccuccgcaagaacgggaagcgggugauccagcugucccgcaagaccuucgacacggaguaccagaagaccaagaacaacgacugggacuacguggucaccaccgacaucagcgagaugggcgcgaacuuccgggccgaccgcgugaucgacccgcggcgcugccugaagcccgugauccucaaggacgggcccgagcgggucauccuggccggccccaugccggugacggucgccuccgccgcgcagcgccgggggcgcaucggccgcaaccacaacaaggagggcgaccaguacaucuacauggggcagccccugaacaacgacgaggaccacgcccacuggaccgaggccaagaugcuccuggacaacaucaacacccccgagggcaucauccccgcccuguucgagccggagcgggagaaguccgccgcgaucgacggggaguaccgccuccggggcgaggcccgcaagaccuucguggagcugaugcggcgcggggaccugcccguguggcucuccuacaaggucgccagcgagggcuuccaguacuccgaccggcgcuggugcuucgacggcgagcggaacaaccaggugcuggaggagaacauggacguggagaucuggacgaaggagggggagcgcaagaagcugcggccccgcuggcucgacgcccggaccuacagcgacccccuggcccugcgcgaguucaaggaguucgcggccggccggcgcagcgucuccggggaccucauccuggagaucggcaagcugccgcagcaccucacccagcgggcccagaacgcccuggacaaccuggugaugcuccacaacagcgagcagggcgggcgcgcguaccggcacgccauggaggagcugcccgacaccaucgagacgcugaugcuccuggcccugaucgccgugcucaccggcggggucacccuguucuuccuguccggccgcgggcucggcaagaccagcaucggccugcugugcgugauggccuccagcgugcuccuguggauggcguccgucgagccccacuggaucgccgccagcaucauccuggaguucuuccucauggugcugcugauccccgagccggaccggcagcgcacgccccaggacaaccagcucgccuacguggucaucgggcugcuguucaugauccucacgguggccgcgaacgagaugggccugcuggagaccaccaagaaggaccucgggaucggccacguggccgucgagaaccaccaccacgccgccaugcuggacguggaccugcaccccgccuccgcguggacccucuacgccguggccacgaccaucaucaccccgaugaugcgccacaccaucgagaacacgaccgccaacaucagccugaccgccaucgcgaaccaggccgccauccugauggggcucgacaagggcuggcccaucuccaagauggacaucggcgucccccugcuggcccucgggugcuacagccaggugaacccccugacccugacggcggccgugcucaugcuggucgcccacuacgccaucaucggcccggggcugcaggccaaggcgacccgggaggcccagaagcgcaccgccgccggcaucaugaagaaccccaccguggacgggaucguggccaucgaccucgaccccgucguguacgacgcgaaguucgagaagcagcugggccagaucaugcugcucauccugugcacgucccagauccugcucaugcggaccaccugggcccugugcgagagcaucacccuggccacgggcccccucaccacccugugggagggguccccgggcaaguucuggaacaccacgaucgccgugagcauggccaacaucuuccgcggguccuaccuggcgggcgccggccucgccuucagccugaugaagucccucgggggcgggcggcgcgggaccggggcccagggcgagacccucggcgagaaguggaagcggcagcugaaccagcugagcaagagcgaguucaacaccuacaagcgcuccgggaucauggaggucgaccggagcgaggcgaaggagggccucaagcgcggggagacgaccaagcacgccgugucccggggcaccgccaagcugcgcugguucguggagcggaaccuggucaagcccgaggggaaggugaucgaccugggcugcggccgcgggggcuggagcuacuacugcgccgggcucaagaaggugaccgaggucaagggcuacacgaagggcgggcccggccacgaggagcccaucccgauggccaccuacggguggaaccuggugaagcugcacuccggcaaggacguguucuucaucccgcccgagaagugcgacacccuccugugcgacaucggggagagcucccccaacccgaccaucgaggagggccggacgcugcgcguccucaagaugguggagcccuggcugcgggggaaccaguucugcaucaagauccugaaccccuacaugcccagcguggucgagacccucgagcagaugcagcgcaagcacggcggcaugcuggugcggaacccgcugucccgcaacagcacccacgagauguacuggguguccugcgggaccggcaacaucgucagcgcggugaacaugaccucccgcaugcuccugaaccgguucacgauggcccaccgcaagcccaccuacgagcgggacguggaccugggggccggcacccgccacgucgccguggagcccgagguggccaaccucgacaucaucggccagcggaucgagaacaucaagcacgagcacaagagcaccuggcacuacgacgaggacaaccccuacaagacgugggcguaccacggguccuacgaggucaagccgagcggcuccgccagcuccauggugaacggggucgugaagcugcugaccaagcccugggacgugauccccauggucacccagaucgccaugaccgacacgacccccuucggccagcagcgcguguucaaggagaagguggacacccggaccccgaaggccaagcgcgggacggcccagaucauggaggucaccgcgaaguggcucuggggcuuccugagccggaacaagaagccccgcaucugcacccgggaggaguucacccgcaaggugcggagcaacgccgccaucggcgccguguucgucgacgagaaccaguggaacuccgcgaaggaggccguggaggacgagcgcuucugggaccuggugcaccgggagcgcgagcuccacaagcaggggaagugcgccacgugcgucuacaacaugaugggcaagcgggagaagaagcugggggaguucggcaaggccaaggggagccgcgccaucugguacauguggcugggcgcgcgguuccucgaguucgaggcccugggcuucaugaacgaggaccacugguucucccgcgagaacagccuguccgggguggagggcgaggggcuccacaagcugggcuacauccugcgggacaucagcaagauccccgggggcaacauguacgccgacgacaccgccggcugggacacccgcaucaccgaggacgaccuccagaacgaggcccgcaucacggacaucauggagccggagcacgcgcugcuggccaaguccaucuucaagcucaccuaccagaacaaggugguccgggugcagcgccccgccaagaacgggaccgugauggacgucaucagccggcgcgaccagcggggcuccggccagguggggaccuacggccugaacacguucaccaacauggaggcccagcugauccgccagauggagagcgaggggaucuucucccccagcgagcucgagacccccaaccuggccgagcgggugcuggacuggcucgagaaguacggcgucgagcgccugaagcggauggcgaucuccggggacgacugcguggugaagccgaucgacgaccgcuucgccaccgcccugacggcccucaacgacaugggcaagguccggaaggacaucccccagugggagcccagcaagggguggaacgacuggcagcagguccccuucugcucccaccacuuccaccagcugaucaugaaggacggccgcgagaucguggucccgugccggaaccaggacgagcuggugggccgcgcccgggugagccagggggcgggcuggucccuccgcgagaccgccugccugggcaagagcuacgcccagauguggcagcugauguacuuccaccggcgcgaccuccggcuggccgcgaacgccaucugcagcgccguccccguggacuggauccccaccucccgcaccacguggagcauccacgcccaccaccaguggaugaccaccgaggacaugcuguccguguggaaccgcgucuggaucgaggagaaccccuggauggaggacaagacccacaucagcuccuggggcgacgugccguaccucgggaagcgggaggaccaguggugcggcagccugaucggccugacggcccgcgcgaccugggccaccaacauccagguggccaucaaccagguccggcgccucaucgggaacgagaacuaccuggacuacaugaccuccaugaagcgguucaagaacgagagcgaccccgagggcgcccugugguga

SEQ ID NO: 8529 - RNA, 9879 nt, Artificial Sequence
  derived and/or modified CDS sequence (opt1) from DENV-1__GQ868610__SS-prME
agcgugaccaugcugcucaugcugaugcccaccgcccuggccuuccaccucaccacccggggcggggagccccacaugaucgugaccaagcaggagcggggcaagagccugcuguucaagaccagcgcgggggugaacaugugcacccucaucgccauggaccugggcgagcugugcgaggacaccaugaccuacaagugcccccggaucaccgaggccgagcccgacgacguggacugcuggugcaacgccacggacaccugggugaccuacgggaccugcagccagacgggcgagcaccggcgcgacaagcggagcguggcccucgcgccccacgugggccuggggcuggagacccgcaccgagaccuggauguccagcgagggcgccuggaagcagauccagcgggucgagacgugggcccuccgccaccccggguucaccgugaucgcccuguuccuggcgcacgccaucggcaccuccaucacccagaaggggaucaucuucauccuccugaugcuggugacgcccagcauggccaugcggugcgucggcaucggcucccgcgacuucguggaggggcucagcggcgccaccuggguggacgucgugcuggagcacggguccugcgugaccaccauggccaaggacaagcccacgcuggacaucgagcuccugaagaccgaggucaccaaccccgcggugcugcggaagcucugcaucgaggccaagaucagcaacaccacgaccgacucccgcugccccacccagggcgaggccacccugauggaggagcaggacgccaacuucgugugccggcgcacguucgucgaccggggcugggggaacggcugcgggcuguucggcaaggggagccucaucacgugcgccaaguucaagugcgugaccaagcuggagggcaagaucgugcaguacgagaaccugaaguacuccgucaucgugaccgugcacacgggcgaccagcaccaggucgggaacgagagcaccgagcacggcaccaccgcgaccaucacgccccaggcccccaccuccgagauccagcucaccgacuacggggcccugacccuggacugcagcccccgcacgggccucgacuucaacgagauggugcugcugaccaugaaggagaaguccuggcucguccacaagcagugguuccuggaccugccgcuccccuggaccagcggggccagcaccucccaggagacguggaaccggcaggaccugcuggugaccuucaagaccgcccacgcgaagaagcaggagguggucgugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgugaugugcaccggguccuucaagcucgagaaggaggucgcggagacgcagcacggcaccgugcuggugcagaucaaguacgagggcaccgacgcccccugcaagauccccuucagcacccaggacgagaagggggucacgcagaacggccggcugaucaccgccaacccgaucgugaccgacaaggagaagcccgugaacaucgaggccgagccgcccuucggggaguccuacaucgucaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcguggggaagcugguccaccagaucuucggcaccgccuacggggugcuguucuccggcgugagcuggaccaugaagaucgggaucggcguccugcugacguggcucggccugaacucccgcagcaccucccugagcaugaccugcaucgccguggggcucaucacccuguaccugggcgugaugguccaggccgacuccgggugcgugaucaacuggaagggccgggagcucaagugcgggagcggcaucuucgugacgaacgagguccacaccuggaccgagcaguacaaguuccaggcggacagcccgaagcgccuguccgccgccaucggcaaggccugggaggagggggugugcggcauccggagcgccacccgccuggagaacaucauguggaagcagaucuccaacgagcucaaccacauccugcuggagaacgacaugaaguucaccguggucgugggggacguggucggcauccucgcgcaggggaagaagaugauccggccccagcccauggagcacaaguacagcuggaaguccuggggcaaggccaagaucaucggcgccgacgugcagaacacgaccuucaucaucgacgggcccaacaccccggagugccccgacgaccagcgcgccuggaacaucugggagguggaggacuacggcuucgggaucuucaccacgaacaucuggcugaagcugcgggacagcuacacccaggucugcgaccaccgccucauguccgcggccaucaaggacagcaaggccgugcacgccgacaugggcuacuggaucgaguccgagaagaacgagaccuggaagcuggcccgggcgagcuucaucgaggugaagaccugcaucuggcccaagucccacacgcuguggagcaacggcguccucgaguccgagaugaucauccccaagaucuacgggggcccgaucagccagcacaacuaccgccccggguacuucacccagaccgccggccccuggcaccuggggaagcuggagcucgacuucgaccugugcgagggcaccacggugguggucgacgagcacugcggcaaccgggggccgucccugcgcaccaccaccgugacgggcaagaucauccacgaguggugcugccggagcugcacccugccgccccuccgcuucaagggggaggacggcugcugguacgggauggagauccggcccgugaaggagaaggaggagaaccuggucaaguccauggugagcgccggcagcggcgagguggacuccuucagccucgggcugcugugcaucuccaucaugaucgaggaggucaugcgcagccgguggucccgcaagaugcucaugaccggcacccuggccguguuccugcuccugaucauggggcagcugacguggaacgaccucauccggcugugcaucauggugggcgccaacgcgagcgaccgcauggggaugggcaccaccuaccuggcccucaucgccaccuucaagaugcgcccgauguucgccgucgggcugcuguuccggcgccucacgucccgggaggugcugcugcucaccaucgggcugagccugguggccuccgucgagcuccccaacagccuggaggagcugggcgacgggcucgcgaugggcaucaugauccugaagcugcucaccgacuuccagucccaccagcugugggccacccugcucagcuucacguucaucaagaccacccugucccugcacuacgccuggaagaccauggccauggugcucagcaucgucucccuguucccccugugccucagcacgaccucccagaagaccaccuggcugcccgugcugcucggcagccuggggugcaagccgcugacgauguuccucaucgcggagaacaagaucuggggccgcaaguccuggccccugaacgaggggaucauggccgugggcgucgugagcauccugcucagcucccugcugaagaacgacgugccccucgccgggccccugaucgccggcggcaugcugaucgccugcuacgucaucagcggguccagcgcggaccucucccuggagaaggccgccgaggugagcugggaggaggaggccgagcacuccggcgccagccacaacauccugguggagguccaggacgacgggaccaugaagaucaaggacgaggagcgggacgacacccucaccauccugcugaaggcgacccuccuggccguguccggcguguacccgcugagcauccccgccacccucuucgucugguacuucuggcagaagaagaagcagcgcuccggggugcugugggacacccccagcccgcccgagguggagcgggccguccuggacgacggcaucuaccgcaucaugcagcggggccugcucgggcgcucccaggugggcgugggggucuuccaggagaacguguuccacaccauguggcacgugacccggggcgccguccugauguaccaggggaagcgccuggagcccagcugggcguccgugaagaaggaccucaucagcuacggcggcggguggcggcugcagggcuccuggaacacgggggaggaggugcaggucaucgccguggagcccggcaagaaccccaagaacgugcagaccgcccccgggaccuucaagacccccgagggcgaggucggcgccaucgcccuggacuucaagcccgggacgagcggcucccccaucgugaaccgcgaggggaagaucgugggccucuacggcaacggggucgugaccaccagcggcaccuacgugagcgcgaucgcccaggccaaggccucccaggaggggccgcugcccgagaucgaggacgaggucuuccggaagcgcaaccugacgaucauggaccuccaccccggcagcgggaagacccggcgcuaccugccggcgaucgugcgggaggccaucaagcgcaagcugcggacccucauccuggcccccacccgcguggucgccuccgagauggccgaggcgcugaagggcaugcccauccgcuaccagacgaccgccgucaagagcgagcacaccggcaaggagaucguggaccucaugugccacgccaccuucacgaugcggcugcugucccccguccgcgugccgaacuacaacaugaucaucauggacgaggcccacuucaccgaccccagcuccaucgccgcgcggggguacaucagcacccgcgugggcaugggggaggccgccgccaucuucaugaccgccacgccgcccggcuccgucgaggcguucccgcagagcaacgccgugauccaggacgaggagcgggacauccccgagcgcuccuggaacagcggguacgaguggaucaccgacuuccccggcaagaccgugugguucguccccuccaucaagagcggcaacgacaucgccaacugccuccggaagaacgggaagcgcgugauccagcugucccggaagaccuucgacacggaguaccagaagaccaagaacaacgacugggacuacguggucaccaccgacaucagcgagaugggcgccaacuuccgcgcggaccgggugaucgacccgcgccggugccugaagcccgugauccucaaggacgggcccgagcgcgucauccuggccggccccaugccggugacggucgccuccgccgcccagcggcgcgggcggaucggccgcaaccacaacaaggagggcgaccaguacaucuacauggggcagccccugaacaacgacgaggaccacgcgcacuggaccgaggccaagaugcuccuggacaacaucaacacccccgagggcaucauccccgcccuguucgagccggagcgggagaaguccgccgccaucgacggggaguaccgccuccgcggcgaggcgcggaagaccuucguggagcugaugcgccgcggggaccugcccguguggcucuccuacaaggucgccagcgagggcuuccaguacagcgaccgccgguggugcuucgacggcgagcgcaacaaccaggugcuggaggagaacauggacguggagaucuggacgaaggagggggagcggaagaagcugcgcccccgguggcucgacgcccgcaccuacuccgacccccuggcccugcgggaguucaaggaguucgccgcgggccgccggagcgucuccggggaccucauccuggagaucggcaagcugccgcagcaccucacccagcgcgcccagaacgcccuggacaaccuggugaugcuccacaacagcgagcagggcgggcgggccuaccgccacgcgauggaggagcugcccgacaccaucgagacgcugaugcuccuggcccugaucgccgugcucaccggcggggucacccuguucuuccuguccggccgggggcucggcaagaccagcaucggccugcugugcgugauggccuccagcgugcuccuguggauggccuccgucgagccccacuggaucgcggccagcaucauccuggaguucuuccucauggugcugcugauccccgagccggaccgccagcggacgccccaggacaaccagcucgccuacguggucaucgggcugcuguucaugauccucacgguggccgccaacgagaugggccugcuggagaccaccaagaaggaccucgggaucggccacguggcggucgagaaccaccaccacgccaccaugcuggacguggaccugcaccccgccuccgccuggacgcucuacgccguggcgaccaccaucaucaccccgaugaugcgccacacgaucgagaacaccaccgccaacaucagccugaccgccaucgccaaccaggccgcgauccugauggggcucgacaagggcuggcccaucuccaagauggacaucggcgucccccugcuggcccucgggugcuacagccaggugaacccccugacgcugaccgccgccgugcucaugcuggucgcgcacuacgccaucaucggcccggggcugcaggccaaggccacccgggaggcccagaagcgcaccgcggccggcaucaugaagaaccccacgguggacgggaucguggccaucgaccucgaccccgucguguacgacgccaaguucgagaagcagcugggccagaucaugcugcucauccugugcaccucccagauccugcucaugcgcaccaccugggcccugugcgagagcaucacgcuggcgaccggcccccucaccacccugugggagggguccccgggcaaguucuggaacacgaccaucgccgugagcauggccaacaucuuccggggguccuaccuggccggcgccggccucgcguucagccugaugaagucccucgggggcgggcgccgggggaccggggcccagggcgagacccucggcgagaaguggaagcgccagcugaaccagcuguccaagagcgaguucaacacguacaagcgguccgggaucauggaggucgaccgcagcgaggccaaggagggccucaagcgcggggagaccacccgccacgccgugucccggggcaccgcgaagcugcgcugguucguggagcggaaccuggucaagcccgaggggaaggugaucgaccugggcugcggccgcgggggcuggagcuacuacugcgccgggcucaagaaggugacggaggucaagggcuacaccaagggcgggcccggccacgaggagcccaucccgauggccaccuacggguggaaccuggugaagcugcacuccggcaaggacguguucuucacgccgcccgagaagugcgacacgcuccugugcgacaucggggagagcucccccaacccgaccaucgaggagggccggacccugcgcguccucaagaugguggagcccuggcugcgggggaaccaguucugcaucaagauccugaaccccuacaugcccagcguggucgagacccucgagcagaugcagcgcaagcacggcggcaugcuggugcggaacccgcugucccgcaacagcacccacgagauguacuggguguccugcgggacgggcaacaucgucagcgccgugaacaugaccucccggaugcuccugaaccgcuucaccauggcccaccgcaagcccaccuacgagcgggacguggaccugggggcgggcacgcgccacgucgccguggagcccgagguggccaaccucgacaucaucggccagcggaucgagaacaucaagcacgagcacaagagcaccuggcacuacgacgaggacaaccccuacaagaccugggccuaccacggguccuacgaggucaagccgagcggcuccgccagcagcauggugaacggggucgugaagcugcugaccaagcccugggacgugauccccauggucacgcagaucgcgaugaccgacaccacccccuucggccagcagcgcguguucaaggagaagguggacacgcggaccccgaaggccaagcgcgggaccgcccagaucauggaggucaccgccaaguggcucuggggcuuccugucccggaacaagaagccccgcaucugcacgcgggaggaguucacccgcaaggugcggagcaacgccgcgaucggcgccguguucgucgacgagaaccaguggaacuccgccaaggaggccguggaggacgagcgcuucugggaccuggugcagaaggagcgggagcuccacaagcaggggaagugcgcgaccugcgucuacaacaugaugggcaagcgcgagaagaagcugggggaguucggcaaggccaaggggagccgggccaucugguacauguggcugggcgcccgcuuccucgaguucgaggcccugggcuucaugaacgaggaccacugguucucccgggagaacagccuguccgggguggagggcgaggggcuccacaagcugggcuacauccugcgcgacaucagcaagauccccgggggcaacauguacgcggacgacaccgccggcugggacacgcggaucaccgaggacgaccuccagaacgaggccaagaucaccgacaucauggagccggagcacgcccugcuggccaccuccaucuucaagcucacguaccagaacaaggugguccgcgugcagcggcccgcgaagaacgggaccgugauggacgucaucagccgccgcgaccagcggggcuccggccaggugggcaccuacggccugaacaccuucacgaacauggaggcccagcugauccgccagauggagagcgaggggaucuuccuccccuccgagcuggagacccccaaccuggccgagcgggugcucgacuggcuggagaaguacggcgucgagcgccugaagcggauggccaucagcggggacgacugcguggugaagccgaucgacgaccgcuucgccaccgcgcucaccgcccugaacgacaugggcaagguccggaaggacaucccccagugggagcccuccaagggguggaacgacuggcagcagguccccuucugcagccaccacuuccaccagcugaucaugaaggacggccgcgagaucguggucccgugccggaaccaggacgagcucgugggccgcgcccgggugucccagggggccggcuggagccugcgcgagacggccugccugggcaagagcuacgcgcagauguggcagcucauguacuuccaccggcgcgaccugcggcuggccgccaacgccaucugcuccgcgguccccguggacugggugcccaccagccgcaccaccugguccauccacgcccaccaccaguggaugacgaccgaggacaugcucagcgucuggaaccggguguggaucgaggagaaccccuggauggaggacaagacccacguguccagcuggggcgacgucccguaccuggggaagcgcgaggaccaguggugcggcucccugaucggccucaccgcccgggccaccugggccagcaacauccagguggcgaucaaccaggugcgccgccugaucgggaacgagaacuaccuggacuacaugacguccaugaagcgguucaagaacgagggcgaccccgagggggcccucugguga

SEQ ID NO: 8530 - RNA, 9879 nt, Artificial Sequence
  derived and/or modified CDS sequence (opt1) from DENV-1__GQ868611__SS-prME
agcgugaccauguuccugaugcucaugcccaccgcccuggccuuccaccugaccacccggggcggggagccccacaugaucgugagcaagcaggagcggggcaagagccuccuguucaagaccagcgccggggugaacaugugcacccugaucgccauggaccucggcgagcugugcgaggacaccaugaccuacaagugcccccgcaucaccgagaccgagcccgacgacguggacugcuggugcaacgccacggacaccugggucaccuacgggaccugcagccagacgggcgagcaccggcgcgacaagcgguccguggcccuggcgccccacgugggccucgggcuggagacccgcaccgagaccuggaugagcuccgagggcgccuggaagcagauccagcgggucgagacgugggcccugcgccaccccggguucaccgugaucgcccucuuccuggcccacgcgaucggcaccagcaucacccagaaggggaucaucuucauccugcucaugcuggugacgcccuccauggccaugcggugcgucggcaucggcagccgcgacuucguggaggggcuguccggcgccaccuggguggacgucgugcucgagcacgggagcugcgugaccaccauggccaaggacaagcccacgcuggacaucgagcugcucaagaccgaggucaccaaccccgccgugcugcggaagcugugcaucgaggcgaagaucuccaacaccacgaccgacagccgcugcccgacccagggcgaggccacccucguggaggagcaggacgccaacuucgucugccggcgcacguucguggaccggggcugggggaacggcugcgggcuguucggcaaggggucccugaucacgugcgccaaguucaagugcgugaccaagcucgagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcugaccgacuacggggcccucacgcuggacugcagcccccgcaccggccuggacuucaacgagaugguccuccugaccaugaaggagaaguccuggcuggugcacaagcagugguuccucgaccugccccugcccuggaccagcggggccagcacgucccaggagaccuggaaccggcaggaccuccuggugaccuucaagaccgcccacgccaagaagcaggaggucguggugcugggcagccaggagggcgcgaugcacacggcccucaccggggccaccgagauccagaccuccggcacgaccaccaucuucgccgggcaccugaagugccgccugaagauggacaagcucacccugaagggcaugagcuacgucaugugcacgggguccuucaagcuggagaaggagcucgccgagacccagcacggcaccgugcuggugcagaucaaguacgagggcaccgacgcgcccugcaagauccccuucagcacgcaggacgagaagggggucacccagaacggccggcugaucaccgccaacccgaucgugaccgacaaggagaagcccgugaacaucgaggccgagccgcccuucggggaguccuacaucgucaucggcgccggcgagaaggcgcugaagcucagcugguucaagaagggguccagcaucggcaagauguucgaggccacggcccgcggggcccggcgcauggccauccugggcgacaccgcgugggacuucggguccaucggcggcguguucaccagcguggggaagcugguccaccagaucuucggcaccgccuacggggugcuguucuccggcgugagcuggacgaugaagaucgggaucggcguccugcugaccuggcucggccugaacucccgcagcaccucccugagcaugaccugcaucgccguggggcucgugacgcuguaccugggcgucauggugcaggccgacuccgggugcgugaucaacuggaagggccgggagcucaagugcgggagcggcaucuucgucaccaacgaggugcacaccuggaccgagcaguacaaguuccaggccgacagcccgaagcgccuguccgcggccaucggcaaggccugggaggagggggugugcggcauccggagcgccacccgccuggagaacaucauguggaagcagaucuccaacgagcucaaccacauccugcuggagaacgacaugaaguucacggucguggugggggacgucgccggcauccucgcgcaggggaagaagaugauccggccccagcccauggaguacaaguacagcuggaaguccuggggcaaggccaagaucaucggcgccgacgugcagaacaccaccuucaucaucgacgggcccaacaccccggagugccccgacgaccagcgcgccuggaacaucugggagguggaggacuacggcuucgggaucuucacgaccaacaucuggcugaagcugcgggacagcuacacccaggucugcgaccaccgccucauguccgcggccaucaaggacagcaaggccgugcacgccgacaugggcuacuggaucgaguccgagaagaacgagaccuggaagcuggcccgggcgagcuucaucgaggugaagacgugcaucuggcccaagucccacacccuguggagcaacggcguccucgaguccgagaugaucauccccaagaucuacgggggcccgaucagccagcacaacuaccgccccggguacuucacccagaccgccggccccuggcaccuggggaagcuggagcucgacuucgaccugugcgagggcacgaccgugguggucgacgagcacugcggcaaccgggggccgucccugcgcaccaccacggugaccggcaagaucauccacgaguggugcugccggagcugcacccugccgccccuccgcuuccgcggggaggacggcugcugguacgggauggagauccgccccgugaaggagaaggaggagaaccuggucaaguccauggugagcgccggcagcggcgagguggacuccuucagccucgggcugcugugcaucuccaucaugaucgaggaggucaugcggagccgcuggucccggaagaugcucaugaccggcacgcuggccguguucuuccugcucaucauggggcagcugaccuggaacgaccugauccgccucugcaucauggugggcgccaacgcgagcgaccgcauggggaugggcaccaccuaccuggcccugauggccacguucaagaugcggccgauguucgccgucggccuccuguuccgccggcugaccucccgcgaggugcuccugcugaccaucgggcucagccugguggccuccgucgagcugcccaacagccucgaggagcugggcgacgggcuggcgaugggcaucaugauccucaagcugcugaccgacuuccagucccaccagcucugggccacgcugcugagccucaccuucaucaagaccaccuucucccugcacuacgccuggaagacgauggccauggugcugagcaucgucucccucuucccccugugccugagcaccaccucccagaagaccacguggcuccccgugcugcugggcagccucgggugcaagccgcugaccauguuccugaucgcggagaacaagaucuggggccggcgcuccuggccccucaacgaggggaucauggccgugggcaucgucagcauccugcugagcucccuccugaagaacgacgugccccuggccgggccccucaucgccggcggcaugcugaucgccugcuacgugaucagcggguccagcgcggaccugucccucgagaaggccgccgaggucagcugggaggaggaggccgagcacuccggcgccagccacaacauccugguggaggugcaggacgacgggaccaugaagaucaaggacgaggagcgggacgacacccugaccauccuccugaaggcgacgcugcucgccgucuccggcguguacccgcugagcauccccgccacccuguucgugugguacuucuggcagaagaagaagcagcgcuccgggguccucugggacacccccagcccgcccgagguggagcgggccgugcuggacgacggcaucuaccgcaucaugcagcggggccugcuggggcgcucccaggucggcguggggguguuccaggagaacgucuuccacaccauguggcacgugacgcggggcgccgugcucauguaccaggggaagcgccuggagcccagcugggcguccgucaagaaggaccugaucagcuacggcggcggguggcggcuccagggcuccuggaacaccggggaggagguccaggugaucgccgucgagcccggcaagaaccccaagaacgugcagaccgcccccgggaccuucaagacgcccgagggcgaggugggcgccaucgcccuggacuucaagcccgggaccagcggcucccccaucgucaaccgcgaggggaagaucgugggccuguacggcaacgggguggucaccaccagcggcacguacgugagcgcgaucgcccaggcccgggccucccaggaggggccgcuccccgagaucgaggacgagguguuccgcaagcggaaccugaccaucauggaccugcaccccggcagcgggaagacccgccgguaccucccggcgaucguccgcgaggccaucaagcgcaagcugcggacccugauccucgcccccacgcgcgugguggccuccgagauggccgaggcgcugaagggcaugcccauccgguaccagaccaccgccgucaagagcgagcacaccggcaaggagaucguggaccugaugugccacgccacguucaccaugcgccuccugucccccgugcgggucccgaacuacaacaugaucaucauggacgaggcccacuucaccgaccccagcuccaucgccgcgcgcggguacaucagcacccgggugggcaugggggaggccgccgccaucuucaugacggccacgccgcccggcuccguggaggcguucccgcagagcaacgccgucauccaggacgaggagcgcgacauccccgagcgguccuggaacagcggguacgaguggaucaccgacuuccccggcaagaccgugugguucgugcccuccaucaagagcggcaacgacaucgccaacugccugcgcaagaacgggaagcgggucauccagcucucccgcaagacguucgacaccgaguaccagaagaccaagaacaacgacugggacuacguggugaccacggacaucagcgagaugggcgccaacuuccgggcggaccgcgucaucgacccgcggcgcugccugaagcccgugauccugaaggacgggcccgagcgggugauccucgccggccccaugccggucaccguggccuccgccgcccagcgccgggggcgcaucggccgcaaccacaacaaggagggcgaccaguacaucuacauggggcagccccugaacaacgacgaggaccacgcgcacuggaccgaggccaagaugcugcucgacaacaucaacacccccgagggcaucauccccgcccuguucgagccggagcgggagaaguccgccgccaucgacggggaguaccgccugcggggcgaggcgcgcaagacguucgucgagcucaugcggcgcggggaccugcccguguggcuguccuacaagguggccagcgagggcuuccaguacagcgaccggcgcuggugcuucgacggcgagcggaacaaccagguccucgaggagaacauggacguggagaucuggaccaaggagggggagcgcaagaagcugcggccccgcuggcuggacgcccggaccuacuccgacccccucgcccugcgcgaguucaaggaguucgccgcgggccggcgcagcguguccggggaccugauccucgagaucggcaagcugccgcagcaccugacccagcgggcccagaacgcccucgacaaccuggucaugcugcacaacagcgagcagggcgggcgcgccuaccggcacgcgauggaggagcuccccgacacgaucgagacccugaugcugcucgcccugaucgccgugcugaccggcggggugacccucuucuuccuguccggccgcgggcugggcaagaccagcaucggccuccugugcgucauggccuccagcgugcugcucuggauggccuccguggagccccacuggaucgcggccagcaucauccuggaguucuuccugaugguccuccugauccccgagccggaccggcagcgcacgccccaggacaaccagcuggccuacguggugaucgggcuccuguucaugauccugaccgucgccgccaacgagaugggccuccuggagaccaccaagaaggaccuggggaucggccacguggcgguggagaaccaccaccacgccgccaugcucgacgucgaccugcaccccgccuccgccuggacgcuguacgcgguggccaccaccaucaucaccccgaugaugcgccacacgaucgagaacaccaccgccaacaucagccucaccgccaucgccaaccaggcggccauccugauggggcuggacaagggcuggcccaucuccaagauggacaucggcgugccccuccuggcccuggggugcuacagccaggucaacccccucacgcugaccgccgcggugcugaugcucguggcccacuacgccaucaucggcccggggcugcaggccaaggccacccgggaggcgcagaagcgcaccgccgccggcaucaugaagaaccccacggucgacgggaucguggccaucgaccuggaccccguggucuacgacgccaaguucgagaagcagcucggccagaucaugcugcugauccucugcaccucccagauccugcugaugcggaccaccugggcgcucugcgagagcaucacgcuggccaccggcccccugaccacccucugggagggguccccgggcaaguucuggaacacgaccaucgccgugagcauggccaacaucuuccgcggguccuaccuggccggcgcgggccuggccuucagccucaugaagucccucgggggcgggcggcgcgggaccggggcccagggcgagacccugggcgagaaguggaagcggcagcucaaccagcuguccaagagcgaguucaacacguacaagcgcuccgggaucauggagguggaccggagcgaggccaaggagggccugaagcgcggggagaccaccaagcacgcggucucccggggcaccgccaagcuccgcugguucguggagcggaaccuggugaagcccgaggggaaggucaucgaccugggcugcggccgcgggggcuggagcuacuacugcgccgggcugaagaaggugacggaggugaagggcuacaccaagggcggccccggccacgaggagcccaucccgauggccaccuacggguggaaccucgucaagcugcacuccggcaaggacguguucuucaucccgcccgagaagugcgacacccugcucugcgacaucggggagagcucccccaacccgacgaucgaggagggccggacccugcgcgugcugaagauggucgagcccuggcuccgggggaaccaguucugcaucaagauccugaaccccuacaugcccagcgugguggagacccuggagcagaugcagcgcaagcacggcggcaugcucguccggaacccgcugucccgcaacagcacccacgagauguacuggguguccugcgggaccggcaacaucgugagcgccgucaacaugacgucccgcaugcugcucaaccgguucaccauggcgcaccgcaagcccaccuacgagcgggacguggaccugggggccggcacccgccacguggccgucgagcccgagguggccaaccuggacaucaucggccagcggaucgagaacaucaagcacgagcacaagagcacguggcacuacgacgaggacaaccccuacaagaccugggccuaccacggguccuacgaggugaagccgagcggcuccgcgagcagcauggucaacgggguggucaagcuccugaccaagcccugggacgugauccccauggugacccagaucgccaugacggacaccacccccuucggccagcagcgcgucuucaaggagaagguggacacccggacgccgaaggccaagcgcgggaccgcccagaucauggaggugaccgccaaguggcuguggggcuuccucucccggaacaagaagccccgcaucugcacccgggaggaguucacgcgcaagguccggagcaacgcggccaucggcgccguguucguggacgagaaccaguggaacuccgccaaggaggcggucgaggacgagcgcuucugggaccuggugcaccgggagcgcgagcugcacaagcaggggaagugcgcgaccugcguguacaacaugaugggcaagcgggagaagaagcucggggaguucggcaaggccaaggggagccgcgccaucugguacauguggcugggcgcccgguuccuggaguucgaggcgcucggcuucaugaacgaggaccacugguucucccgcgagaacagccuguccggggucgagggcgaggggcugcacaagcucggcuacauccugcgggacaucagcaagauccccgggggcaacauguacgccgacgacaccgccggcugggacacccgcaucacggaggacgaccugcagaacgaggcccgcaucaccgacaucauggagccggagcacgcccuccuggcgaaguccaucuucaagcugaccuaccagaacaagguggugcggguccagcgccccgccaagaacgggaccgugauggacgugaucagccggcgcgaccagcggggcuccgggcaggucggcacguacggccucaacaccuucaccaacauggaggcccagcugauccgccagauggagagcgaggggaucuucucccccagcgagcuggagacccccaaccucgccgagcgggugcuggacuggcuggagaaguacggcguggagcgccucaagcggauggccaucuccggggacgacugcgucgugaagccgaucgacgaccgcuucgcgacggcccugaccgcccugaacgacaugggcaaggugcggaaggacaucccccagugggagcccagcaagggguggaacgacuggcagcagguccccuucugcucccaccacuuccaccagcucaucaugaaggacggccgcgagaucguggugccgugccggaaccaggacgagcuggucggccgcgcccgggugagccagggggccggcuggagccugcgcgagaccgcgugccucgggaaguccuacgcccagauguggcagcugauguacuuccaccggcgcgaccugcggcucgccgccaacgcgaucugcagcgccgugcccgucgacuggauccccaccucccgcacgaccuggagcauccacgcccaccaccaguggaugaccaccgaggacaugcuguccguguggaaccgcguguggaucgaggagaaccccuggauggaggacaagacgcacaucagcuccuggggcgacgucccguaccuggggaagcgggaggaccaguggugcggcagccucaucggccugaccgcccgcgccaccugggcgaccaacauccagguggccaucaaccaggugcggcgccugaucgggaacgagaacuaccucgacuacaugaccuccaugaagcgguucaagaacgagagcgaccccgagggcgcccugugguga

SEQ ID NO: 8531 - RNA, 9879 nt, Artificial Sequence
  derived and/or modified CDS sequence (opt1) from DENV-1__FJ882555__SS-prME
agcgugaccaugcugcucaugcugaugcccaccgcccuggccuuccaccucaccacccgcggcggggagccgcacaugaucgugagcaagcaggagcggggcaagagccugcuguucaagaccagcgccggggugaacaugugcacccucaucgccauggaccugggcgaguucugcgaggacaccaugaccuacaagugcccccgcaucaccgaggccgagcccgacgacguggacugcuggugcaacgccaccgacacgugggucaccuacgggaccugcagccagaccggcgagcaccggcgcgacaagcgguccguggcccuggcgccccacgugggccucgggcuggagacgcgcaccgagaccuggaugagcuccgagggcgccuggaagcagauccagcgggucgagaccugggcccugcgccacccgggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugcccgacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaagaucguccaguacgagaaccugaaguacagcgugaucgugaccguccacaccggcgaccagcaccagguggggaacgaguccacggagcacggcaccaccgcgaccaucacgccccaggcccccagcacggagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccagcggggccuccgccagccaggagaccuggaaccggcaggaccuccuggugaccuucaagacggcgcacgccaagaagcaggaggucguggugcugggcucccaggagggcgccaugcacaccgcccucaccggggccaccgagauccagacgagcggcaccaccaccaucuucgcggggcaccugaagugccgccugaagauggacaagcucacgcugaagggcauguccuacgucaugugcaccgggagcuucaagcuggagaaggagguggccgagacccagcacggcaccgugcucguccagaucaaguacgagggcacggacgcccccugcaagauccccuucuccacccaggacgagaagggggugacccagaacggccggcugaucaccgccaacccgaucgugacggacaaggagaagcccgucaacaucgaggcggagccgcccuucggggagagcuacaucgugaucggcgccggcgagaaggcccugaagcuguccugguucaagaaggggagcuccaucggcaagauguucgaggccaccgcccgcggggcgcggcgcauggccauccucggcgacaccgccugggacuucgggagcaucggcggcguguucaccuccgucgggaagcuggugcaccagaucuucggcacggccuacggggugcuguucagcggcgucuccuggaccaugaagaucgggaucggcgugcuccugaccuggcugggccucaacagccgcuccaccagccuguccaugacgugcaucgccguggggcuggucacccucuaccugggcgugauggugcaggcggacagcgggugcgucaucaacuggaagggccgggagcugaagugcgggagcggcaucuucgugaccaacgaggugcacaccuggacggagcaguacaaguuccaggccgacuccccgaagcgccucagcgccgccaucggcaaggccugggaggagggggucugcggcauccgguccgcgacccgccuggagaacaucauguggaagcagaucagcaacgagcugaaccacauccuccuggagaacgacaugaagcugaccgugguggucggggacguggccggcauccucgcccaggggaagaagaugauccggccccagcccauggaguacaaguacuccuggaaguccuggggcaaggccaagaucaucggcgcggacgugcagaacaccaccuucaucaucgacgggcagaacacgcccgagugcccggacgaccagcgcgccuggaacaucugggaggucgaggacuacggcuucgggaucuucaccaccaacaucuggcugaagcugcgggacagcuacacccaggugugcgaccaccgccucaugagcgccgccaucaaggacuccaaggccgugcacgcggacaugggcuacuggaucgagagcgagaagaacgagacguggaagcuggcccgggccuccuucaucgaggucaagaccugcaucuggcccaagagccacacccugugguccaacggcgugcucgagagcgagaugaucauccccaagaucuacgggggccccaucucccagcacaacuaccgcccgggguacuucacccagacggccggccccuggcaccuggggaagcuggagcucgacuucgaccugugcgagggcaccaccguggucguggacgagcacugcggcaaccgggggcccagccugcgcaccacgaccgugaccggcaagaucauccacgaguggugcugccgguccugcacccucccgccccugcgcuucaagggggaggacggcugcugguacgggauggagauccggcccgucaaggagaaggaggagaaccuggugaaguccauggugagcgccggcuccggcgaggucgacagcuucucccucgggcugcugugcaucagcaucaugaucgaggaggugaugcgcucccgguggagccgcaagaugcucaugacgggcacccuggcgguguucuuccugcucaucauggggcagcugaccuggaacgaccugauccggcucugcaucauggucggcgccaacgccuccgaccgcauggggaugggcaccacguaccuggcccugauggccaccuucaagaugcgccccauguucgcggugggccuccuguuccggcgccugaccagccgggaggugcuccugcugaccaucgggcucucccuggucgccagcguggagcugccgaacucccucgaggagcugggcgacgggcuggccaugggcaucaugauccucaagcugcugacggacuuccagagccaccagcucugggccacccugcuguccaugaccuucauccgcaccacguucagccuccacuacgcguggaagaccauggccaugguccuguccaucgugagccuguucccccucugccuguccaccaccagccagaagacgaccuggcugcccgugcuccugggcucccuggggugcaagccccucaccauguuccugaucgccgagaacaagaucuggggccgcaagagcuggccgcugaacgaggggaucauggccgucggcaucgugagcauccuccuguccagccugcucaagaacgacgugccccuggccgggccccugaucgcgggcggcaugcucaucgccugcuacgucaucuccgggagcuccgccgaccugagccuggagaaggccgccgugguguccugggaggaggaggcggagcacagcggcgccucccacaacauccucgucgaggugcaggacgacgggaccaugaagaucaaggacgaggagcgcgacgacacgcugaccauccugcucaaggccacccugcuggccgugagcggcgucuacccccucuccaucccggccacccuguucgugugguacuucuggcagaagaagaagcagcggagcggggugcugugggacacccccagcccgcccgaggucgagcgcgcggugcucgacgacggcaucuaccggaucaugcagcgcggccugcuggggcggagccaggugggcgucgggguguuccaggagaacguguuccacacgauguggcacgucacccgcggcgccgugcugauguaccaggggaagcggcucgagccguccugggccagcgugaagaaggaccugaucuccuacggcggcggguggcgccugcagggcagcuggaacaccggggaggagguccaggugaucgccguggagcccggcaagaaccccaagaacguccagaccgcccccgggacguucaagaccuccgagggcgaggugggcgcgaucgcccucgacuucaagccggggaccagcggcagccccaucgugaaccgggaggggaaggucgugggccuguacggcaacgggguggucaccacguccggcaccuacgugagcgccaucgcccaggcgaaggccucccaggaggggccccugcccgagaucgaggacgagguguuccgcaagcggaaccucaccaucauggaccugcacccgggcagcgggaagacccgccgguaccugcccgccaucguccgcgaggccaucaagcggaagcuccgcacgcugauccuggcccccacccgcgugguggcguccgagauggccgaggcccucaagggcaugccgauccgguaccagaccaccgccgucaagagcgagcacacgggcaaggagaucguggaccugaugugccacgccaccuucaccaugcgccugcucucccccgugcggguccccaacuacaacaugaucaucauggacgaggcgcacuucaccgaccccagcuccaucgccgcccgcggguacaucagcacgcgggugggcaugggggaggccgccgcgaucuucaugaccgccaccccgcccggcuccguggaggccuucccccagagcaacgccgucauccaggacgaggagcgcgacauccccgagcgguccuggaacagcggguacgaguggaucaccgacuucccgggcaagacggugugguucgugcccuccaucaagagcggcaacgacaucgcgaacugccugcgcaagaacgggaagcgggucauccagcugucccgcaagaccuucgacaccgaguaccagaagaccaagaacaacgacugggacuacguggugacgaccgacaucagcgagaugggcgccaacuuccgggccgaccgcgucaucgacccccggcgcugccucaagcccgugauccugaaggacgggccggagcgggucauccuggccggccccaugcccgugaccguggccuccgcggcccagcgccgggggcgcaucggccggaaccacaacaaggagggcgaccaguacaucuacauggggcagccccucaacaacgacgaggaccacgcccacuggaccgaggccaagaugcugcuggacaacaucaacacgccggagggcaucauccccgcccucuucgagcccgagcgcgagaaguccgcggccaucgacggggaguaccgccugcggggcgaggcccgcaagaccuucgucgagcugaugcggcgcggggaccuccccguguggcugagcuacaagguggccuccgagggcuuccaguacagcgaccggcgcuggugcuucgacggcgagcggaacaaccagguccuggaggagaacauggacguggagaucuggaccaaggagggggagcgcaagaagcuccggccgcgcuggcuggacgcccggaccuacuccgacccccuggcgcuccgcgaguucaaggaguucgccgccggccggcgcagcguguccggggaccugauccuggagaucggcaagcucccccagcaccugacgcagcgggcccagaacgcgcuggacaaccucgucaugcugcacaacagcgagcagggcgggcgcgccuaccggcacgccauggaggagcugcccgacaccaucgagacccucaugcugcuggcccucaucgccgugcugaccggcggggugacgcuguucuuccucuccggccgcgggcugggcaagaccagcaucggccugcucugcgucauggcguccagcgugcugcuguggauggccuccguggagccgcacuggaucgccgccagcaucauccucgaguucuuccugaugguccugcucauccccgagcccgaccggcagcgcacgccccaggacaaccagcuggccuacguggugaucgggcuccuguucaugauccugaccgucgcggccaacgagaugggccugcucgagaccacgaagaaggaccuggggaucggccacguggccguggagaaccaccaccacgccgccaugcuggacgucgaccuccacccggcguccgccuggacccuguacgccguggccaccaccaucaucacgcccaugaugcggcacaccaucgagaacaccaccgccaacaucagccugacggcgaucgccaaccaggccgccauccucauggggcuggacaagggcuggcccaucuccaagauggacaucggcgugccgcugcucgcgcuggggugcuacagccaggucaacccccugacccucaccgccgccgugcugaugcugguggcccacuacgccaucaucggccccgggcuccaggcgaaggccacccgcgaggcccagaagcgcacggccgccggcaucaugaagaaccccaccgucgacgggaucguggcgaucgaccuggacccgguggucuacgacgccaaguucgagaagcagcugggccagaucaugcuccugauccugugcaccucccagauccuccugaugcggaccacgugggcccugugcgagagcaucacccucgccaccggcccccugaccacgcugugggaggggucccccggcaaguucuggaacaccaccaucgccgugagcauggcgaacaucuuccgcgggagcuaccucgccggcgccggccuggccuucucccugaugaagucccucgggggcgggcggcgcggcaccggggcgcagggcgagacgcugggcgagaaguggaagcggcagcugaaccagcucuccaagagcgaguucaacaccuacaagcgcuccgggaucauggagguggaccggagcgaggccaaggagggccugaagcgcggggagaccaccaagcacgccgucucccggggcacggccaagcugcgcugguucguggagcggaaccucgugaagcccgaggggaaggucaucgaccugggcugcggccgcgggggcuggagcuacuacugcgccgggcugaagaaggugaccgaggugaagggcuacaccaagggcgggccgggccacgaggagcccauccccauggcgaccuacggguggaaccuggucaagcuccacuccggcaaggacguguucuucaucccgcccgagaagugcgacacgcugcugugcgacaucggggagagcucccccaaccccaccaucgaggagggccggacccuccgcgugcugaagauggucgagcccuggcugcgggggaaccaguucugcaucaagauccucaaccccuacaugcccagcgugguggagacccuggagcagaugcagcgcaagcacggcggcaugcugguccggaacccccucucccgcaacagcacgcacgagauguacuggguguccugcgggaccggcaacaucgugagcgccgucaacaugaccucccggaugcugcugaaccgcuucaccauggcccaccgcaagcccaccuacgagcgggacguggaccucggggccggcacgcgccacguggccgucgagccggagguggcgaaccuggacaucaucggccagcggaucgagaacaucaagcacgagcacaagagcaccuggcacuacgacgaggacaaccccuacaagaccugggccuaccacggguccuacgaggucaagcccagcggcagcgccuccagcauggugaacgggguggucaagcugcucaccaagcccugggacgugaucccgauggugacgcagaucgccaugaccgacaccacccccuucggccagcagcgcgucuucaaggagaagguggacacgcggacccccaaggccaagcgcgggaccgcgcagaucauggaggugaccgccaaguggcuguggggcuuccugucccggaacaagaagccccgcaucugcacgcgggaggaguucacccgcaagguccggagcaacgccgccaucggcgcgguguucguggacgagaaccaguggaacuccgccaaggaggccgucgaggacgagcgcuucugggaccucgugcaccgggagcgcgagcugcacaagcaggggaagugcgcgaccugcguguacaacaugaugggcaagcgggagaagaagcugggggaguucggcaaggccaaggggagccgcgcgaucugguacauguggcucggcgcccgguuccuggaguucgaggcccugggcuucaugaacgaggaccacugguucucccgcgagaacagccucuccggggucgagggcgaggggcugcacaagcugggcuacauccuccgggacaucagcaagauccccggcgggaacauguacgccgacgacaccgccgggugggacacgcgcaucaccgaggacgaccugcagaacgaggcgaagaucaccgacaucauggagcccgagcacgcccugcucgccaaguccaucuucaagcugaccuaccagaacaagguggugcggguccagcgccccgccaagaacgggacggugauggacgugaucagccgccgggaccagcgcggcuccgggcaggucggcaccuacggccugaacaccuucaccaacauggaggcccagcucauccggcagauggagagcgaggggaucuucuccccgagcgagcuggagacgcccaaccuggcgggccgcgcccucgacuggcuggagaagcacgggguggagcggcugaagcgcauggccaucuccggcgacgacugcguggucaagcccaucgacgaccgguucgccaccgcccucaccgcgcugaacgacauggggaaggugcgcaaggacaucccccagugggagccgagcaagggcuggaacgacuggcagcagguccccuucugcagccaccacuuccaccagcugaucaugaaggacggccgggagaucgucgugcccugccgcaaccaggacgagcucguggggcgggcccgcgucucccagggcgccggguggagccugcgggagaccgccugccugggcaaguccuacgcgcagauguggcagcucauguacuuccaccgccgggaccugcgccuggccgccaacgccaucugcagcgccgugcccguggacugggucccgacgucccggaccaccuggagcauccacgcgcaccaccaguggaugaccacggaggacaugcucuccguguggaaccgcguguggaucgaggagaaccccuggauggaggacaagacccacaucagcuccuggggcgacguccccuaccugggcaagcgggaggaccaguggugcggcagccugaucgggcucaccgcccgcgccaccugggccacgaacauccagguggccaucaaccaggugcgccggcugcugggcaacgagaacuaccucgacuacaugaccuccaugaagcgcuucaagaacgagagcgaccccgagggggcgcugugguga

SEQ ID NO: 8532 - RNA, 9879 nt, Artificial Sequence
  derived and/or modified CDS sequence (opt1) from DENV-1__GQ199821__SS-prME
agcgugaccaugcugcucaugcugaugcccaccgcccuggccuuccaccucacgacccggggcggggagccccacaugaucgugagcaagcaggagcggggcaagagccugcuguucaagaccagcgcgggggugaacaugugcacccucaucgccauggaccugggcgaguucugcgaggacacgaugaccuacaagugcccccgcaucaccgaggccgagcccgacgacguggacugcuggugcaacgccaccgacacgugggugaccuacgggaccugcagccagaccggcgagcaccggcgggacaagcgguccguggcccuggcgccccacgugggccucgggcuggagacgcgcaccgagaccuggaugagcuccgagggcgccuggaagcagauccagcggguggagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugcccgacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaagaccguccaguacgagaaccugaaguacagcgugaucgugaccguccacacgggcgaccagcaccagguggggaacgaguccaccgagcacggcaccaccgcgaccaucacgccccaggcccccagcaccgagauccagcugaccgacuacggggcccucacccuggacugcagcccccggacgggccuggacuucaacgagaugguccuccugaccaugaaggagaaguccuggcuggugcacaagcagugguuccucgaccugccgcugcccuggaccagcggggccuccaccagccaggagacguggaaccggaaggaccuccuggugaccuucaagaccgcccacgcgaagaagcaggaggucguggugcugggcucccaggagggcgccaugcacaccgcccucacgggggccaccgagauccagaccagcggcaccacgaccaucuucgccgggcaccugaagugccgccugaagauggacaagcucacccugaagggcauguccuacgucaugugcaccgggagcuucaagcuggagaaggagguggcggagacgcagcacggcaccgugcucguccagaucaaguacgagggcaccgacgcccccugcaagauccccuucuccacccaggacgagaagggggugacgcagaacggccggcugaucaccgccaacccgaucgugaccgacaaggagaagcccgucaacaucgaggccgagccgcccuucggggagagcuacaucgugaucggcgcgggcgagaaggcccugaagcuguccugguucaagaaggggagcuccaucggcaagauguucgaggccaccgcccgcggggcccggcgcauggcgauccucggcgacacggccugggacuucgggagcaucggcggcguguucaccuccgucgggaagcuggugcaccagaucuucggcaccgccuacggggugcuguucagcggcgucuccuggaccaugaagaucgggaucggcgugcuccugacguggcugggccucaacagccgcuccaccagccuguccaugaccugcaucguggucgggcuggugacccucuaccugggcgugaugguccaggccgacagcgggugcgugaucaacuggaagggccgggagcugaagugcgggagcggcaucuucgugacgaacgagguccacaccuggaccgagcaguacaaguuccaggccgacuccccgaagcgccucagcgcggccaucggcaaggccugggaggagggggugugcggcauccgguccgccacccgccuggagaacaucauguggaagcagaucagcaacgagcugaaccacauccuccuggagaacgacaugaaguucaccguggucgugggggacguggccggcauccuggcgcaggggaagaagaugauccggccccagcccauggaguacaaguacuccuggaaguccuggggcaaggccaagaucaucggcgccgacguccagaacacgaccuucaucaucgacgggcccaacaccccggagugccccgacgaccagcgcgccuggaacaucugggagguggaggacuacggcuucgggaucuucaccacgaacaucuggcucaagcugcgggacuccuacacccaggugugcgaccaccgccugaugagcgcggccaucaaggacuccaaggccguccacgccgacaugggcuacuggaucgagagcgagaagaacgagaccuggaagcucgcccgggcguccuucaucgaggugaagaccugcaucuggcccaagagccacacgcugugguccaacggcgugcuggagagcgagaugaucauccccaagaucuacgggggcccgaucucccagcacaacuaccgccccggguacuucacccagaccgccggccccuggcaccucgggaagcuggagcuggacuucgaccucugcgagggcaccacggucgugguggacgagcacugcggcaaccgggggccgagccugcgcaccaccaccgucacgggcaagaucauccacgaguggugcugccgguccugcacccugccgccccugcgcuucaagggggaggacggcugcugguacgggauggagauccggcccgugaaggagaaggaggagaaccuggucaagagcauggucagcgccggcuccggcgagguggacagcuucucccuggggcuccugugcaucagcaucaugaucgaggaggugaugcgcucccgguggagccgcaagaugcugaugaccggcacccucgccgucuucuuccugcugaucauggggcagcucacguggaacgaccugauccggcugugcaucauggugggcgccaacgcguccgaccgcauggggaugggcaccaccuaccucgcccugauggccaccuucaagaugcgcccgauguucgccguggggcuccuguuccggcgccugacgagccgggagguccugcuccugaccaucgggcugucccucguggccagcgucgagcugcccaacucccuggaggagcucggcgacgggcuggcgaugggcaucaugauccugaagcuccugaccgacuuccagagccaccagcugugggccacccuccugucccugacguucaucaagaccaccuucagccuccacuacgccuggaagaccauggccauggugcuguccaucgugagccuguucccccucugccuguccacgaccagccagaagaccaccuggcugcccguccuccugggcucccuggggugcaagccgcucacgauguuccugaucgcggagaacaagaucuggggccgcaagagcuggccccugaacgaggggaucauggccgugggcaucgugagcauccuccuguccagccugcucaagaacgacgucccccuggccgggccccugaucgccggcggcaugcucaucgccugcuacgugaucuccgggagcuccgcggaccugagccuggagaaggccgccgagguguccugggaggaggaggccgagcacagcggcgccucccacaacauccucgucgaggugcaggacgacgggaccaugaagaucaaggacgaggagcgggacgacacccugaccauccugcucaaggcgacccugcuggccgugagcggcgucuacccgcucuccauccccgccacgcuguucgugugguacuucuggcagaagaagaagcagcgcagcggggugcugugggacacccccagcccgcccgaggucgagcgggccgugcucgacgacggcaucuaccgcaucaugcagcggggccugcuggggcgcagccaggugggcgucgggguguuccaggagaacguguuccacaccauguggcacgucacccggggcgccgugcugauguaccaggggaagcgccucgagcccuccugggcgagcgugaagaaggaccugaucuccuacggcggcggguggcggcugcagggcagcuggaacacgggggaggagguccaggugaucgccguggagcccggcaagaaccccaagaacguccagaccgcccccgggaccuucaagaccuccgagggcgaggugggcgccaucgcccucgacuucaagcccgggacgagcggcagccccaucgugaaccgcgaggggaagaucgucggccuguacggcaacgggguggugaccaccuccggcaccuacgucagcgcgaucgcccaggccaaggccucccaggaggggccccugccggagaucgaggacgagguguuccggaagcgcaaccucacgaucauggaccugcaccccggcagcgggaagacccggcgcuaccugcccgcgaucgugcgggaggccaucaagcgcaagcuccggacccugauccuggccccgacccgcgucguggccuccgagauggccgaggcgcucaagggcaugcccauccgcuaccagacgaccgccgucaagagcgagcacaccggcaaggagaucgucgaccugaugugccacgccaccuucacgaugcggcugcucucccccgugcgcgugcccaacuacaacaugaucaucauggacgaggcccacuucaccgacccgagcuccaucgccgcgcggggguacaucagcacccgcgucggcaugggggaggccgccgccaucuucaugaccgccacgccgcccggcuccguggaggcguucccccagagcaacgccgugauccaggacgaggagcgggacaucccggagcgcuccuggaacagcggguacgaguggaucaccgacuuccccggcaagaccgucugguucgugcccuccaucaagagcggcaacgacaucgccaacugccugcggaagaacgggaagcgcgugauccagcugucccggaagaccuucgacacggaguaccagaagaccaagaacaacgacugggacuacgucgugaccaccgacaucagcgagaugggcgccaacuuccgcgcggaccgggugaucgacccccgccggugccucaagccggucauccugaaggacgggcccgagcgcgugauccuggccggccccaugcccgucacgguggccuccgccgcccagcggcgcgggcggaucggccgcaaccacaacaaggagggcgaccaguacaucuacauggggcagccgcucaacaacgacgaggaccacgcgcacuggaccgaggccaagaugcugcuggacaacaucaacacccccgagggcaucauccccgcccucuucgagcccgagcgggagaaguccgccgccaucgacggggaguaccgccugcgcggcgaggcgcggaagaccuucguggagcugaugcgccgcggggaccucccggucuggcugagcuacaagguggccuccgagggcuuccaguacagcgaccgccgguggugcuucgacggcgagcgcaacaaccaggugcuggaggagaacauggacgucgagaucuggacgaaggagggggagcggaagaagcuccgcccccgguggcuggacgcccgcaccuacuccgacccccuggcccuccgggaguucaaggaguucgccgcgggccgccggagcguguccggggaccugauccuggagaucggcaagcucccccagcaccugacccagcgcgcccagaacgcccuggacaaccucgugaugcugcacaacagcgagcagggcgggcgggccuaccgccacgcgauggaggagcugccggacaccaucgagacgcucaugcugcuggcccucaucgccguccugaccggcggggugacccuguucuuccucuccggccgggggcugggcaagaccagcaucggccugcucugcgugauggccuccagcgcccugcuguggaucgcguccgucgagccccacuggaucgccgccagcaucauccucgaguucuuccugauggugcugcucauccccgagcccgaccgccagcggaccccgcaggacaaccagcuggccuacguggucaucgggcuccucuucaugauccugacgguggccgcgaacgagaugggccugcucgagaccaccaagaaggaccuggggaucggccacguggccgucgagaaccaccaccacgccgccaugcuggacguggaccuccaccccgccuccgcguggacccuguacgccguggccacgaccaucaucacccccaugaugcgccacaccaucgagaacacgaccgccaacaucagccugaccgccaucgcgaaccaggccgccauccucauggggcuggacaagggcuggccgaucuccaagauggacaucggcgucccccugcucgcccuggggugcuacagccaggugaacccccugacccucacggcggccgugcugaugcuggucgcccacuacgccaucaucggccccgggcuccaggccaaggcgacccgggaggcccagaagcgcaccgccgccggcaucaugaagaacccgaccguggacgggaucguggccaucgaccuggaccccgucguguacgacgcgaaguucgagaagcagcugggccagaucaugcuccugauccugugcacgucccagauccuccugaugcgcaccaccugggcccugugcgagagcaucacccucgccacgggcccccugaccacccugugggaggggucccccggcaaguucuggaacaccacgaucgccgugagcauggccaacaucuuccgggggagcuaccucgcgggcgccggccuggccuucucccugaugaagucccucgggggcgggcgccggggcaccggggcccagggcgagacccugggcgagaaguggaagcgccagcugaaccagcucuccaagagcgaguucaacaccuacaagcgguccgggaucauggaggucgaccgcagcgaggcgaaggagggccugaagcgcggggagacgaccaagcacgccgugucccgcggcaccgccaagcugcggugguucguggagcgcaaccucgucaagccggaggggaaggugaucgaccugggcugcggccgcggcggguggagcuacuacugcgccgggcugaagaaggugaccgaggucaagggguacacgaagggcgggcccggccacgaggagcccauccccauggccaccuacggguggaaccuggugaagcuccacuccggcaaggacguguucuucaucccgcccgagaagugcgacacccugcugugcgacaucggggagagcucccccaaccccaccaucgaggagggccgcacgcuccggguccugaagaugguggagccguggcugcgcgggaaccaguucugcaucaagauccucaaccccuacaugcccagcguggucgagacccuggagcagaugcagcggaagcacggcggcaugcuggugcgcaacccccucucccggaacagcacccacgagauguacuggguguccugcgggaccggcaacaucgucagcgcggugaacaugaccucccgcaugcugcugaaccgguucacgauggcccaccgcaagccgaccuacgagcgcgacguggaccucggggccggcacccggcacgucgccguggagcccgagguggccaaccuggacaucaucggccagcgcaucgagaacaucaagcacgagcacaagagcaccuggcacuacgacgaggacaaccccuacaagacgugggcguaccacggguccuacgaggucaagcccagcggcagcgccuccagcauggugaacggggucgugaagcugcucaccaagccgugggacgugauccccauggucacccagaucgccaugaccgacacgacccccuucggccagcagcggguguucaaggagaagguggacacccgcacccccaaggccaagcgggggacggcccagaucauggaggucaccgcgaaguggcuguggggcuuccugucccgcaacaagaagccgcggaucugcacccgcgaggaguucacccggaaggugcgcagcaacgccgccaucggcgccguguucgucgacgagaaccaguggaacuccgcgaaggaggccguggaggacgagcgguucugggaccucgugcaccgcgagcgggagcugcacaagcaggggaagugcgccacgugcgucuacaacaugaugggcaagcgcgagaagaagcugggggaguucggcaaggccaaggggagccgggccaucugguacauguggcucggcgcgcgcuuccuggaguucgaggcccugggcuucaugaacgaggaccacugguucucccgggagaacagccucuccgggguggagggcgaggggcugcacaagcugggcuacauccuccgcgacaucagcaagauccccgggggcaacauguacgccgacgacaccgccggcugggacacccggaucaccgaggacgaccugcagaacgaggccaagaucacggacaucauggagcccgagcacgcgcugcucgccaaguccaucuucaagcugaccuaccagaacaaggugguccgcgugcagcggccggccaagaacgggaccgugauggacgucaucagccgccgcgaccagcggggcuccggccaggugggcaccuacggccugaacacguucaccaacauggaggcccagcucauccgccagauggagagcgaggggaucuucucccccagcgagcuggagacccccaaccuggccggccgggugcucgacuggcuggagaagcacggggucgagcgccugaagcggauggcgaucuccggcgacgacugcguggugaagcccaucgacgaccgcuucgccaccgcccucacggcccugaacgacauggggaagguccggaaggacaucccgcagugggagcccagcaagggcuggaacgacuggcagcagguccccuucugcagccaccacuuccaccagcugaucaugaaggacggccgcgagaucgugguccccugccggaaccaggacgagcucguggggcgcgcccgggugucccagggcgcgggguggagccugcgcgagaccgccugccugggcaaguccuacgcccagauguggcagcucauguacuuccaccggcgcgaccugcggcuggccgcgaacgccaucugcagcgccgucccgguggacugggugcccaccucccgcaccacguggagcauccacgcccaccaccaguggaugaccaccgaggacaugcucuccgucuggaaccggguguggaucgaggagaaccccuggauggaggacaagacccacaucagcuccuggggcgacgugcccuaccugggcaagcgcgaggaccaguggugcggcagccugaucgggcucacggcccgggcgaccugggccaccaacauccaggucgccaucaaccaggugcgccgccugaucggcaacgagaacuaccuggacuacaugaccuccaugaagcgguucaagaacgagagcgacccggagggggcccucugguga

SEQ ID NO: 8533 - RNA, 9879 nt, Artificial Sequence
  derived and/or modified CDS sequence (opt1) from DENV-1__FJ882556__SS-prME
agcgugaccaugcugcucaugcugaugcccaccgcccuggccuuccaccucaccacccggggcggggagccccacaugaucguguccaagcaggagcggggcaagagccugcuguucaagaccuccgccggggugaacaugugcacccucaucgccauggaccugggcgagcugugcgaggacaccaugaccuacaagugcccccgcaucaccgagaccgagcccgacgacguggacugcuggugcaacgccaccgacaccugggugaccuacgggaccugcagccagacgggcgagcaccggcgcgacaagcgguccguggcccucgcgccccacgugggccuggggcuggagacccgcaccgagaccuggaugagcuccgagggcgccuggaagcagauccagcgggucgagacgugggcccuccgccaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagguggccgagacccagcacggcaccgugcugguccagaucaaguacgagggcaccgacgcgcccugcaagauccccuucagcacgcaggacgagaagggggugacccagaacggccggcugaucaccgccaacccgaucguguccgacaaggagaagcccgucaacaucgaggccgagccgcccuucggggagagcuacaucgugaucggcgccggcgagaaggcgcugaagcucuccugguucaagaaggggagcuccaucggcaagauguucgaggccaccgcccgcggggcccggcgcauggccauccugggcgacacggcgugggacuucgggagcaucggcggcguguucaccuccgucgggaagcuggugcaccagaucuucggcaccgccuacggggugcuguucagcggcgucuccuggaccaugaagaucgggaucggcgugcugcugacguggcucggccugaacagccgcuccaccagccuguccaugaccugcaucgccguggggcucgucacccuguaccugggcgugauggugcaggccgacagcgggugcgucaucaacuggaagggccgggagcucaagugcgggagcggcaucuucgugacgaacgaggugcacaccuggaccgagcaguacaaguuccaggccgacuccccgaagcgccugagcgcggccaucggcaaggccugggaggagggggucugcggcauccgguccgccacccgccuggagaacaucauguggaagcagaucagcaacgagcucaaccacauccugcuggagaacgacaugaaguucaccgugguggucggggacguggccggcauccucgcgcaggggaagaagaugauccggccccagcccauggaguacaaguacuccuggaaguccuggggcaaggccaagaucaucggcgccgacgugcagaacacgaccuucaucaucgacgggcccaacaccccggagugccccgacgaccagcgcgccuggaacaucugggaggucgaggacuacggcuucgggaucuucaccacgaacaucuggcugaagcugcgggacuccuacacccaggugugcgaccaccgccucaugagcgcggccaucaaggacuccaaggccgugcacgccgacaugggcuacuggaucgagagcgagaagaacgagaccuggaagcuggcccgggcguccuucaucgaggucaagaccugcaucuggcccaagagccacacgcugugguccaacggcgugcucgagagcgagaugaucauccccaagaucuacgggggcccgaucucccagcacaacuaccgccccggguacuucacccaggccgccggccccuggcaccuggggaagcuggagcucgacuucgaccugugcgagggcaccaccguggucguggacgagcacugcggcaaccgggggccgagccugcgcacgaccaccgugaccggcaagaucauccacgaguggugcugccgguccugcacgcugccgccccuccgcuuccgcggggaggacggcugcugguacgggauggagauccgccccgucaaggagaaggaggagaaccuggucaagagcauggugagcgccggcuccggcgaggucgacagcuucucccucgggcugcugugcaucagcaucaugaucgaggaggugaugcggucccgcuggagccggcgcaugcucaugaccggcacccuggccguguucuuccugcucaucauggggcagcugaccuggaacgaccugauccgccucugcaucauggucggcgcgaacgccuccgaccggauggggaugggcacgaccuaccuggcccugauggccaccuucaagaugcgcccgauguucgccgugggccuccuguuccggcgccugaccagccgggaggugcuccugcugacgaucgggcucucccuggucgcgagcguggagcugcccaacucccucgaggagcugggcgacgggcuggccaugggcaucaugauccucaagcugcugaccgacuuccagagccaccagcucugggccacccugcugucccucaccuucaucaagacgaccuucagccugcacuacgccuggaagaccauggcgaugguccuguccaucgugagccucuucccccugugccuguccaccacgagccagaagaccaccuggcuccccgugcugcugggcucccucgggugcaagccgcugaccauguuccugaucgccgagaacaagaucuggggccgccggagcuggccccucaacgaggggaucauggccgucggcaucgugagcauccugcuguccagccuccugaagaacgacgugccccuggccgggccccucaucgccggcggcaugcugaucgcgugcuacgucaucuccgggagcuccgccgaccugagccucgagaaggccgccgagguguccugggaggaggaggccgagcacagcggcgcgucccacaacauccugguggagguccaggacgacgggacgaugaagaucaaggacgaggagcgcgacgacacccugaccauccuccugaaggccacccugcucgccgugagcggcguguacccgcuguccauccccgccacccuguucgucugguacuucuggcagaagaagaagcagcggagcggggugcucugggacacgcccagcccgcccgagguggagcgcgccguccuggacgacggcaucuaccggaucaugcagcgcggccugcuggggcggagccaggugggcgugggggucuuccaggagaacguguuccacaccauguggcacgugacccgcggcgcgguccucauguaccaggggaagcggcuggagcccuccugggccagcgugaagaaggaccugaucuccuacggcggcggguggcgccuccagggcagcuggaacaccggggaggaggugcaggucaucgccguggagcccggcaagaaccccaagaacgugcagacggcccccgggaccuucaagacccccgagggcgaggucggcgccaucgcgcuggacuucaagcccgggaccuccggcagccccaucgugaaccgggaggggaagaucgugggccuguacggcaacggggucgugacgaccagcggcaccuacguguccgccaucgcccaggccaaggcgagccaggaggggccgcuccccgagaucgaggacgaggucuuccgcaagcggaaccugaccaucauggaccugcaccccggcuccgggaagacgcgccgguaccucccggccaucgugcgcgaggccaucaagcgcaagcugcggacccugauccucgcccccacccgcguggucgccagcgagauggcggaggcccugaagggcaugcccauccgguaccagaccacggccgugaaguccgagcacaccggcaaggagaucguggaccugaugugccacgccaccuucaccaugcgccuccugagccccguccgggugccgaacuacaacaugaucaucauggacgaggcccacuucacggaccccuccagcaucgcggcccgcggguacaucuccacccgggugggcaugggggaggccgccgccaucuucaugaccgcgacgccgcccggcagcgucgaggccuucccgcaguccaacgccgugauccaggacgaggagcgcgacauccccgagcggagcuggaacuccggguacgaguggaucacggacuuccccggcaagaccgugugguucguccccagcaucaaguccggcaacgacaucgccaacugccugcgcaagaacgggaagcgggugauccagcucagccgcaagaccuucgacaccgaguaccagaagacgaagaacaacgacugggacuacguggucaccaccgacaucuccgagaugggcgcgaacuuccgggccgaccgcgugaucgacccgcggcgcugccugaagcccgugauccugaaggacgggcccgagcgggucauccucgccggccccaugccggugaccgucgccagcgccgcgcagcgccgggggcgcaucggccgcaaccacaacaaggagggcgaccaguacaucuacauggggcagccccugaacaacgacgaggaccacgcccacuggacggaggccaagaugcugcucgacaacaucaacacccccgagggcaucauccccgcccuguucgagccggagcgggagaaguccgccgcgaucgacggggaguaccgccugcggggcgaggcccgcaagaccuucguggagcucaugcggcgcggggaccugcccguguggcugagcuacaaggucgccagcgagggcuuccaguacuccgaccggcgcuggugcuucgacggcgagcggaacaaccaggugcucgaggagaacauggacguggagaucuggaccaaggagggggagcgcaagaagcugcggccccgcuggcuggacgcccggacguacagcgacccccucgcccugcgcgaguucaaggaguucgcggccggccggcgcuccgucagcggggaccugauccucgagaucggcaagcugccgcagcaccugacccagcgggcccagaacgcccucgacaaccuggugaugcugcacaacuccgagcagggcgggcgcgcguaccggcacgccauggaggagcuccccgacaccaucgagacccugaugcugcucgcccugaucgccgugcugacgggcggggucacccucuucuuccugagcggccgcgggcugggcaagaccuccaucggccuccugugcgugauggccagcuccgugcugcucuggauggcgagcgucgagccccacuggaucgccgccuccaucauccuggaguucuuccugauggugcuccugauccccgagccggaccggcagcgcacgccccaggacaaccagcuggccuacguggucaucgggcuccuguucaugauccugaccguggccgcgaacgagaugggccuccuggagacgaccaagaaggaccuggggaucggccacguggccgucgagaaccaccaccacgccgccaugcucgacguggaccugcaccccgccagcgcguggacccuguacgccguggccaccacgaucaucaccccgaugaugcgccacaccaucgagaacaccacggccaacaucucccucaccgccaucgcgaaccaggccgccauccugauggggcuggacaagggcuggcccaucagcaagauggacaucggcgucccccuccuggcccuggggugcuacucccaggugaacccccucacccugaccgcggccgugcugaugcucgucgcccacuacgccaucaucggcccggggcugcaggccaaggcgacgcgggaggcccagaagcgcaccgccgccggcaucaugaagaaccccaccguggacgggaucguggccaucgaccuggaccccgucguguacgacgcgaaguucgagaagcagcucggccagaucaugcugcugauccucugcaccagccagauccugcugaugcggacgaccugggcccucugcgaguccaucacccuggccaccggcccccugacgacccucugggaggggagcccgggcaaguucuggaacaccaccaucgccguguccauggccaacaucuuccgcgggagcuaccuggcgggcgccggccuggccuucagccucaugaagucccucgggggcgggcggcgcgggacgggggcccagggcgagacccugggcgagaaguggaagcggcagcucaaccagcugagcaaguccgaguucaacaccuacaagcgcagcgggaucauggaggucgaccgguccgaggcgaaggagggccugaagcgcggggagaccacgaagcacgccgugagccggggcaccgccaagcuccgcugguucguggagcggaaccuggucaagcccgaggggaaggugaucgaccugggcugcggccgcgggggcugguccuacuacugcgccgggcugaagaaggugaccgaggucaagggcuacaccaagggcgggcccggccacgaggagcccaucccgauggccacguacggguggaaccucgugaagcugcacagcggcaaggacguguucuucaucccgcccgagaagugcgacacccugcucugcgacaucggggaguccagccccaacccgaccaucgaggagggccggacccugcgcguccugaagaugguggagcccuggcuccgggggaaccaguucugcaucaagauccugaaccccuacaugcccuccguggucgagacgcuggagcagaugcagcgcaagcacggcggcaugcucgugcggaacccgcugagccgcaacuccacccacgagauguacugggugagcugcgggaccggcaacaucgucuccgcggugaacaugaccagccgcaugcugcucaaccgguucaccauggcccaccgcaagcccacguacgagcgggacguggaccugggggccggcacccgccacgucgccguggagcccgagguggccaaccuggacaucaucggccagcggaucgagaacaucaagcacgagcacaaguccaccuggcacuacgacgaggacaaccccuacaagaccugggcguaccacgggagcuacgaggucaagccguccggcagcgccagcuccauggugaacggggucgugaagcuccugacgaagcccugggacgugauccccauggucacccagaucgccaugaccgacaccacgcccuucggccagcagcgcguguucaaggagaagguggacacccggaccccgaaggccaagcgcgggaccgcccagaucauggaggucacggcgaaguggcuguggggcuuccucagccggaacaagaagccccgcaucugcacccgggaggaguucacccgcaaggugcgguccaacgccgccaucggcgccguguucgucgacgagaaccaguggaacagcgcgaaggaggccguggaggacgagcgcuucugggaccuggugcaccgggagcgcgagcugcacaagcaggggaagugcgcgaccugcgucuacaacaugaugggcaagcgggagaagaagcucggggaguucggcaaggccaaggggucccgcgccaucugguacauguggcugggcgcgcgguuccuggaguucgaggcccucggcuucaugaacgaggaccacugguucagccgcgagaacucccugagcgggguggagggcgaggggcugcacaagcucggcuacauccugcgggacaucuccaagauccccgggggcaacauguacgccgacgacacggccggcugggacacccgcaucaccgaggacgaccugcagaacgaggcccgcaucaccgacaucauggagccggagcacgcgcuccuggccaagagcaucuucaagcugacguaccagaacaaggugguccgggugcagcgccccgccaagaacgggaccgugauggacgucaucucccggcgcgaccagcggggcagcggccagguggggaccuacggccucaacaccuucacgaacauggaggcccagcugauccgccagauggaguccgaggggaucuucagccccuccgagcuggagacccccaaccucgccgagcgggugcuggacuggcuggagaaguacggcgucgagcgccucaagcggauggcgaucagcggggacgacugcguggugaagccgaucgacgaccgcuucgccaccgcccugaccgcccugaacgacaugggcaagguccggaaggacaucccccagugggagcccuccaagggguggaacgacuggcagcagguccccuucugcagccaccacuuccaccagcucaucaugaaggacggccgcgagaucguggucccgugccggaaccaggacgagcuggugggccgcgcccgggugagccagggggcgggcuggucccugcgcgagacggccugccucggcaagagcuacgcccagauguggcagcugauguacuuccaccggcgcgaccugcggcucgccgcgaacgccaucugcuccgccguccccguggacuggauccccaccagccgcaccaccugguccauccacgcccaccaccaguggaugacgaccgaggacaugcugagcguguggaaccgcgucuggaucgaggagaaccccuggauggaggacaagacccacaucuccagcuggggcgacgugccguaccuggggaagcgggaggaccaguggugcggcucccucaucggccugaccgcccgcgcgacgugggccaccaacauccagguggccaucaaccagguccggcgccugaucgggaacgagaacuaccucgacuacaugaccagcaugaagcgguucaagaacgaguccgaccccgagggcgcccugugguga

SEQ ID NO: 8534 - RNA, 9879 nt, Artificial Sequence
  derived and/or modified CDS sequence (opt1) from DENV-1__GQ199822__SS-prME
agcgugaccaugcugcucaugcugaugcccaccgcccuggccuuccaccucaccacccgcggcggggagccccacaugaucgugaccaagcaggagcggggcaagagccugcuguucaagaccagcgccggggugaacaugugcacccucaucgccauggaccugggcgagcugugcgaggacaccaugaccuacaagugcccccggaucaccgaggccgagcccgacgacguggacugcuggugcaacgccaccgacaccugggucaccuacgggaccugcagccagacgggcgagcaccggcgcgacaagcggagcguggcccucgcgccccacgugggccuggggcuggagacccgcaccgagaccuggauguccagcgagggcgccuggaagcagauccagcgggucgagacgugggcccuccgccaccccggguucaccgugaucgcccuguuccuggcgcacgccaucggcaccuccaucacccagaaggggaucaucuucauccuccugaugcuggugacgcccagcauggccaugcggugcgucggcaucggcucccgcgacuucguggaggggcucagcggcgccaccuggguggacgucgugcuggagcacggguccugcgugaccaccauggccaaggacaagcccacgcuggacaucgagcuccugaagaccgaggucaccaaccccgcggugcugcggaagcucugcaucgaggccaagaucagcaacaccacgaccgacucccgcugccccacccagggcgaggccacccugauggaggagcaggacgccaacuucgugugccggcgcacguucgucgaccggggcugggggaacggcugcgggcuguucggcaaggggagccucaucacgugcgccaaguucaagugcgugaccaagcuggagggcaagaucgugcaguacgagaaccugaaguacuccgucaucgugaccgugcacacgggcgaccagcaccaggucgggaacgagagcaccgagcacggcaccaccgcgaccaucacgccccaggcccccaccuccgagauccagcucaccgacuacggggcccugacccuggacugcagcccccgcacgggccucgacuucaacgagauggugcugcugaccaugaaggagaaguccuggcucguccacaagcagugguuccuggaccugccgcuccccuggaccagcggggccagcaccucccaggagacguggaaccggcaggaccugcuggugaccuucaagaccgcccacgcgaagaagcaggagguggucgugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgugaugugcaccggguccuucaagcucgagaaggaggucgcggagacgcagcacggcaccgugcuggugcagaucaaguacgagggcaccgacgcccccugcaagauccccuucagcacccaggacgagaagggggucacgcagaacggccggcugaucaccgccaacccgaucgugaccgacaaggagaagcccgugaacaucgaggccgagccgcccuucggggaguccuacaucgucaucggcgcgggcgagaaggcccugaagcucagcugguucaagaagggguccagcaucggcaagauguucgaggccaccgcccgcggggcccggcgcauggcgauccugggcgacacggccugggacuucggguccgugggcggcguguucaccagcgucgggaagcuggugcaccagaucuucggcaccgccuacggggugcuguucuccggcgucagcuggaccaugaagaucgggaucggcgugcugcugacguggcucggccugaacucccgcagcaccucccugagcaugaccugcaucgccguggggcucgucacccuguaccugggcgugauggugcaggccgacuccgggugcgucaucaacuggaagggccgggagcucaagugcgggagcggcaucuucgugacgaacgaggugcacaccuggaccgagcaguacaaguuccaggcggacagcccgaagcgccuguccgccgccaucggcaaggccugggaggagggggucugcggcauccggagcgccacccgccuggagaacaucauguggaagcagaucuccaacgagcucaaccacauccugcuggagaacgacaugaaguucaccgugguggucggggacguggugggcauccucgcgcaggggaagaagaugauccggccccagcccauggagcacaaguacagcuggaaguccuggggccgcgccaagaucaucggcgccgacguccagaacacgaccuucaucaucgacgggcccaacaccccggagugccccgacgaccagcgggccuggaacaucugggagguggaggacuacggcuucgggaucuucaccacgaacaucuggcugaagcugcgcgacagcuacacccaggugugcgaccaccggcucauguccgcggccaucaaggacagcaaggccguccacgccgacaugggcuacuggaucgaguccgagaagaacgagaccuggaagcuggcccgcgcgagcuucaucgaggugaagaccugcaucuggcccaagucccacacgcuguggagcaacggcgugcucgaguccgagaugaucauccccaagaucuacgggggcccgaucagccagcacaacuaccggcccggguacuucacccagaccgccggccccuggcaccuggggaagcuggagcucgacuucgaccugugcgagggcaccacggucgugguggacgagcacugcggcaaccgcgggccgucccugcggaccaccaccgucacgggcaagaucauccacgaguggugcugccgcagcugcacccugccgccccuccgguucaagggggaggacggcugcugguacgggauggagauccgccccgugaaggagaaggaggagaaccuggugaaguccauggucagcgccggcagcggcgagguggacuccuucagccucgggcugcugugcaucuccaucaugaucgaggaggugaugcggagccgcuggucccggaagaugcucaugaccggcacccuggccgucuuccugcuccugaucauggggcagcugacguggaacgaccucauccgccugugcaucauggugggcgccaacgcgagcgaccgcauggggaugggcaccaccuaccuggcccucauggccaccuucaagaugcggccgauguucgccgugggccugcuguuccgccggcucacgucccgcgagguccugcugcucaccaucgggcugagccugguggccuccgucgagcuccccaacagccuggaggagcugggcgacgggcucgcgaugggcaucaugauccugaagcugcucaccgacuuccagucccaccagcugugggccacccugcucagccugacguucaucaagaccacccugucccuccacuacgccuggaagaccauggccauggugcugagcaucgugucccuguucccccucugccugagcacgaccucccagaagaccaccuggcugcccguccuccugggcagccuggggugcaagccgcucacgauguuccugaucaccgagaacaagaucuggggccggaaguccuggccccugaacgaggggaucauggcggugggcguggucagcauccuccugagcucccugcucaagaacgacgugccccuggccgggccccugaucgccggcggcaugcucaucgccugcuacgugaucagcggguccagcgccgaccugucccuggagaaggcggccgaggucagcugggaggaggaggccgagcacuccggcgccagccacaacauccucguggaggugcaggacgacgggaccaugaagaucaaggacgaggagcgcgacgacacccugaccauccugcucaaggccacgcugcuggcggucuccggcguguacccgcucagcauccccgccacccuguucgugugguacuucuggcagaagaagaagcagcgguccgggguccugugggacacccccagcccgcccgagguggagcgcgccgugcuggacgacggcaucuaccggaucaugcagcgcggccuccuggggcggucccaggucggcguggggguguuccaggagaacgucuuccacaccauguggcacgugacgcgcggcgccgugcugauguaccaggggaagcggcucgagcccagcugggccuccgucaagaaggaccugaucagcuacggcggcggguggcgccugcagggcuccuggaacaccggggaggagguccaggugaucgcggucgagcccggcaagaaccccaagaacgugcagaccgcccccgggaccuucaagacgcccgagggcgaggugggcgccaucgcccucgacuucaagcccgggaccagcggcucccccaucgucaaccgggaggggaagaucgugggccuguacggcaacgggguggucaccaccagcggcacguacgugagcgccaucgcgcaggccaaggccucccaggaggggccgcugcccgagaucgaggacgagguguuccgcaagcggaaccucaccaucauggaccugcaccccggcagcgggaagacccgccgguaccugccggcccucguccgcgaggcgaucaagcggaagcugcgcacccugauccucgcccccacgcgcgugguggccuccgagauggccgaggcccugaagggcaugcccauccgguaccagaccaccgcggucaagagcgagcacaccggcaaggagaucguggaccugaugugccacgccacguucaccaugcgccuccugucccccgugcgggucccgaacuacaacaugaucaucauggacgaggcccacuucaccgaccccagcuccaucgccgcccgcggguacaucagcacccgggugggcaugggggaggcggccgccaucuucaugacggccacgccgcccggcuccguggaggccuucccgcagagcaacgcggucauccaggacgaggagcgcgacauccccgagcgguccuggaacagcggguacgaguggaucaccgacuuccccggcaagaccgugugguucgugcccuccaucaagagcggcaacgacaucgccaacugccugcgcaagaacgggaagcgggucauccagcucucccgcaagacguucgacaccgaguaccagaagaccaagaacaacgacugggacuacguggugaccacggacaucagcgagaugggcgccaacuuccgggccgaccgcgucaucgacccgcggcgcugccugaagcccgugauccugaaggacgggcccgagcgggucauccucgcgggccccaugccggugaccguggccuccgccgcccagcgccgggggcgcaucggccggaaccacaacaaggagggcgaccaguacaucuacauggggcagccccugaacaacgacgaggaccacgcccacuggaccgaggcgaagaugcugcucgacaacaucaacacccccgagggcaucauccccgcccuguucgagccggagcgcgagaaguccgccgccaucgacggggaguaccgccugcggggcgaggcccgcaagacguucgucgagcucaugcggcgcggggaccugcccguguggcuguccuacaagguggcgagcgagggcuuccaguacagcgaccggcgcuggugcuucgacggcgagcggaacaaccagguccucgaggagaacauggacguggagaucuggaccaaggagggggagcgcaagaagcugcggccccgcuggcuggacgcccggaccuacuccgacccccucgcccugcgcgaguucaaggaguucgccgccggccggcgcagcguguccggggaccugauccucgagaucggcaagcugccgcagcaccugacccagcgggcgcagaacgcccucgacaaccuggucaugcugcacaacagcgagcagggcgggcgcgccuaccggcacgccauggaggagcuccccgacacgaucgagacccugaugcugcucgcgcugaucgccgugcugaccggcggggugacccucuucuuccuguccggccgcgggcugggcaagaccagcaucggccuccugugcgucauggccuccagcgugcugcucuggauggccuccguggagccccacuggaucgccgcgagcaucauccuggaguucuuccugaugguccuccugauccccgagccggaccggcagcgcacgccccaggacaaccagcuggccuacguggugaucgggcuccuguucaugauccugaccgucgccgccaacgagaugggccuccuggagaccaccaagaaggaccuggggaucggccacguggccguggagaaccaccaccacgcgacgaugcucgacgucgaccugcaccccgccuccgccuggacccuguacgccguggccaccaccaucaucacgccgaugaugcggcacaccaucgagaacaccaccgcgaacaucagccucacggccaucgccaaccaggccgccauccugauggggcuggacaagggcuggcccaucuccaagauggacaucggcgugccccuccuggcgcuggggugcuacagccaggucaacccccucacccugaccgccgccgugcugaugcucguggcccacuacgcgaucaucggcccggggcugcaggccaaggccacccgcgaggcccagaagcgcacggccgcgggcaucaugaagaaccccaccgucgacgggaucguggccaucgaccuggaccccguggucuacgacgccaaguucgagaagcagcucggccagaucaugcugcugauccucugcaccucccagauccugcugaugcggaccacgugggcccucugcgagagcaucacccuggccaccggcccccugaccacgcucugggagggguccccgggcaaguucuggaacaccaccaucgcggugagcauggccaacaucuuccgcggguccuaccuggccggcgccggccuggccuucagccucaugaagucccucgggggcgggcggcgcgggaccggggcgcagggcgagacgcugggcgagaaguggaagcggcagcucaaccagcuguccaagagcgaguucaacaucuacaagcgcuccgggaucauggagguggaccggagcgaggccaaggagggccugaagcgcggggagaccacccggcacgccgucucccgcggcaccgccaagcugcggugguucguggagcgcaaccucgugaagcccgaggggaaggucaucgaccugggcugcggccgcggcggguggagcuacuacugcgcggggcugaagaaggugacggaggugaagggguacaccaagggcggccccggccacgaggagcccaucccgauggccaccuacggguggaaccucgucaagcugcacuccggcaaggacguguucuucacgccgcccgagaagugcgacacgcugcucugcgacaucggggagagcucccccaacccgaccaucgaggagggccgcacccugcgggugcugaagauggucgagcccuggcuccgcgggaaccaguucugcaucaagauccugaaccccuacaugcccagcgugguggagacccuggagcagaugcagcggaagcacggcggcaugcucguccgcaacccgcugucccggaacagcacccacgagauguacuggguguccugcgggacgggcaacaucgugagcgccgucaacaugaccucccgcaugcugcucaaccgcuucaccauggcccaccggaagcccaccuacgagcgcgacguggaccugggggccggcacgcggcacguggcggucgagcccgagguggccaaccuggacaucaucggccagcgcaucgagaacaucaagcacgagcacaagagcaccuggcacuacgacgaggacaaccccuacaagaccugggccuaccacggguccuacgaggucaagccgagcggcuccgccagcagcauggugaacgggguggucaagcuccugaccaagcccugggacgugauccccauggugacgcagaucgccaugaccgacaccacccccuucggccagcagcgggucuucaaggagaagguggacacgcgcaccccgaaggcgaagcgggggaccgcccagaucauggaggugaccgcccgcuggcuguggggcuuccucucccggaacaagaagccccgcaucugcacgcgggaggaguucacccgcaagguccggagcaacgccgccaucggcgcgguguucguggacgagaaccaguggaacuccgccaaggaggccgucgaggacgagcgcuucugggaccuggugcagaaggagcgggagcugcacaagcaggggaagugcgcgaccugcguguacaacaugaugggcaagcgcgagaagaagcucggggaguucggcaaggcgaaggggagccgggccaucugguacauguggcugggcgcccgcuuccuggaguucgaggcccucggcuucaugaacgaggaccacugguucucccgggagaacagccuguccggggucgagggcgaggggcugcacaagcucggcuacauccugcgcgacaucagcaagauccccgggggcaacauguacgccgacgacaccgcgggcugggacacgcggaucaccgaggacgaccugcagaacgaggccaagaucaccgacaucauggagccggagcacgcccuccuggccaccuccaucuucaagcugacguaccagaacaagguggugcgcguccagcgccccgccaagaacgggaccgugauggacgugaucagccggcgcgaccagcggggcuccgggcaggucggcaccuacggccucaacaccuucacgaacauggaggcgcagcugauccgccagauggagagcgaggggaucuuccugcccuccgagcucgagacccccaaccuggccgagcgggugcuggacuggcucgagaaguacggcguggagcgccugaagcggauggccaucagcggggacgacugcgucgugaagccgaucgacgaccgcuucgccaccgcccugaccgcgcucaacgacaugggcaaggugcggaaggacaucccccagugggagcccuccaagggguggaacgacuggcagcagguccccuucugcagccaccacuuccaccagcugaucaugaaggacggccgcgagaucguggugccgugccggaaccaggacgagcuggucggccgcgcccgggugucccagggggccggcuggagccuccgcgagacggccugccugggcaagagcuacgcccagauguggcagcugauguacuuccaccggcgcgaccuccggcuggcggccaacgccaucugcuccgccgugcccgucgacugggugcccaccagccgcaccaccugguccauccacgcgcaccaccaguggaugacgaccgaggacaugcugagcguguggaaccgggucuggaucgaggagaaccccuggauggaggacaagacccacguguccagcuggggcgacgugccguaccucgggaagcgcgaggaccaguggugcggcucccugaucggccugaccgcccgcgccaccugggccagcaacauccaggucgccaucaaccaggugcggcgccucaucgggaacgagaacuaccuggacuacaugacguccaugaagcgguucaagaacgagggcgaccccgagggggcgcugugguga

SEQ ID NO: 8535 - RNA, 9879 nt, Artificial Sequence
  derived and/or modified CDS sequence (opt1) from DENV-1__FJ882557__SS-prME
agcgugaccaugcugcucaugcugaugcccaccgcccuggccuuccaccucaccacccgcggcggggagccccacaugaucgugagcaagcaggagcggggcaagagccugcuguucaagaccuccgccggggugaacaugugcacccucaucgccauggaccugggcgagcugugcgaggacacgaugaccuacaagugcccccgcaucaccgaggccgagcccgacgacguggacugcuggugcaacgccaccgacacgugggugaccuacgggaccugcagccagaccggcgagcaccggcgcgacaagcgguccguggcccucgcgccccacgugggccuggggcuggagacgcgcaccgagaccuggaugagcuccgagggcgccuggaagcagauccagcgggucgagaccugggcccuccgccaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcggugcugcggaagcucugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacaccggcgaccagcaccagguggggaacgaguccacggagcacggcaccaccgcgaccaucacgccccaggcccccacgaccgagauccagcucaccgacuacggggcccugacccuggacugcagcccccgcacgggccucgacuucaacgagaugguccugcugaccaugaaggagaaguccuggcucgugcacaagcagugguuccuggaccugccccuccccuggaccagcggggccagcaccucccaggagacguggaaccggcaggaccugcuggugaccuucaagaccgcccacgcgaagaagcaggaggucguggugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgucaugugcaccggguccuucaagcucgagaaggagguggcggagacgcagcacggcaccgugcugguccagaucaaguacgagggcaccgacgcccccugcaagauccccuucagcacccaggacgagaagggggugacgcagaacggccggcugaucaccgccaacccgaucgugaccgacaaggagaagcccgucaacaucgaggccgagccgcccuucggggaguccuacaucgugaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcgucgggaagcugauccaccagaucuucggcaccgccuacgggguccucuucuccggcgugagcuggaccaugaagaucgggaucggcguccugcugacguggcucggccugaacucccgcagcaccucccugagcaugaccugcaucgccguggggcucgugacccuguaccugggcgucauggugcaggccgacuccgggugcgugaucaacuggaagggccgggagcucaagugcgggagcggcaucuucgucacgaacgaggugcacaccuggaccgagcaguacaaguuccaggcggacagcccgaagcgccuguccgccgccaucggcaaggccugggaggagggggugugcggcauccggagcgccacccgccuggagaacaucauguggaagcagaucuccaacgagcucaaccacauccugcuggagaacgacaugaagcucaccgucguggugggggacgucgcgggcauccuggggcagggcaagaagaugauccggccccagcccauggaguacaaguacagcuggaaguccuggggcaaggccaagaucaucggggccgacgcccagaacacgaccuucaucaucgacggccccaacaccccggagugccccgacgaccagcgcgcguggaacaucugggagguggaggacuacggguucggcaucuucaccacgaacaucuggcugaagcuccgggacagcuacacccaggugugcgaccaccgccugauguccgccgccaucaaggacagcaaggccguccacgccgacaugggcuacuggaucgaguccgagaagaacgagaccuggaagcuggcgcgggccagcuucaucgaggugaagaccugcaucuggcccaagucccacacgcucuggagcaacggggugcuggaguccgagaugaucauccccaagaucuacggcgggccgaucagccagcacaacuaccgccccggcuacuucacccagaccgccgggcccuggcaccugggcaagcucgagcuggacuucgaccugugcgagggcaccacggucgugguggacgagcacugcgggaaccggggcccgucccuccgcaccaccaccgucacggggaagaucauccacgaguggugcugccggagcugcacccugccgccccugcgcuuccggggcgaggacgggugcugguacggcauggagauccgccccgugaaggagaaggaggagaaccucgugaaguccauggucagcgccggcagcggggagguggacuccuucagccugggccugcucugcaucuccaucaugaucgaggaggugaugcggagccgcuggucccggaagaugcugaugaccgggacccuggccgucuucuuccuccugaucaugggccagcugacguggaacgaccucauccgccugugcaucauggugggggcgaacgccuucgaccgcaugggcaugggcaccaccuaccuggcccucauggccaccuucaagaugcggccgauguucgccguggggcugcuguuccgccggcucacgagccgcgagguccugcugcucaccaucggccugucccugguggcgagcguggagcuccccaacucccuggaggagcugggggacggccucgccaugggcaucaugauccugaagcugcucaccgacuuccagagccaccagcugugggccacccugcucucccugacguucaucaagaccaccuucagccugcacuacgccuggaagaccauggcgaugguccucuccaucgugagccuguucccccugugccucuccacgaccagccagaagaccaccuggcugcccguccugcucgggucccugggcugcaagccgcugacgauguuccucaucgccgagaacaagaucugggggcggaaguccuggccccugaacgagggcaucauggccguggggaucguguccauccugcucagcagccugcugaagaacgacgucccccucgccggcccccugaucgccggcgggaugcugaucgcgugcuacgugaucuccggcagcuccgccgaccucagccuggagaaggccgccgagguguccugggaggaggaggccgagcacagcggggcgucccacaacauccuggucgaggugcaggacgacggcaccaugaagaucaaggacgaggagcgcgacgacacccucaccauccugcugaaggccacccuccuggccgugagcggggucuacccgcuguccauccccgccacccucuucgugugguacuucuggcagaagaagaagcagcggagcggcgugcugugggacacccccagcccgcccgaggucgagcgcgccgugcuggacgacggcaucuaccggaucaugcagcgcgggcugcucggccggagccaggugggggucggcguguuccaggagaacguguuccacaccauguggcacgucacccgcggggcggugcugauguaccagggcaagcggcuggagcccuccugggccagcgugaagaaggaccucaucuccuacggcgggggcuggcgccugcgggggagcuggaacacgggcgaggagguccaggugaucgccguggagcccgggaagaaccccaagaacguccagaccgcccccggcaccuucaagacccccgagggcgaggugggggccaucgcgcuggacuucaagcccggcacguccgggagccccaucgugaaccgcgagggcaagaucgucggccucuacgggaacggcguggugaccaccuccgggaccuacgucagcgccaucgcccaggccaaggcgagccaggagggcccgcugcccgagaucgaggacgagguguuccggaagcgcaaccugacgaucauggaccuccaccccggguccggcaagacccggcgcuaccugccggccaucgugcgggaggccaucaagcgcaagcugcgcacccucauccuggcccccacccgggucguggccagcgagauggcggaggcccugaagggcaugcccauccgcuaccagacgaccgccgugaaguccgagcacaccgggaaggagaucgucgaccucaugugccacgccaccuucacgaugcggcugcugagccccgugcgcgugccgaacuacaacaugaucaucauggacgaggcccacuucaccgaccccuccagcaucgcggcccggggcuacaucuccacccgcgucgggaugggcgaggccgccgccaucuucaugaccgcgacgccgcccgggagcguggaggccuucccgcaguccaacgccgugauccaggacgaggagcgggacauccccgagcgcagcuggaacuccggccacgaguggaucaccgacuuccccggcaagaccgucugguucgugcccagcaucaaguccgggaacgacaucgccaacugccuccggaagaacggcaagcgcgugauccagcugagccggaagaccuucgacacggaguaccagaagaccaagaacaacgacugggacuacgucgugaccaccgacaucuccgagaugggggcgaacuuccgcgccgaccgggugaucgacccgcgccggugccugaagcccgucauccucaaggacggccccgagcgcgugauccuggccgggcccaugccggugacggucgccagcgccgcgcagcggcgcggccggaucggccgcaaccacaacaaggagggggaccaguacaucuacaugggccagccccugaacaacgacgaggaccacgcccacuggaccgaggccaagaugcuccuggacaacaucaacacccccgaggggaucauccccgcccuguucgagccggagcgcgagaaguccgccgcgguggacggcgaguaccggcuccgcggggaggcccggaagaccuucgucgagcugaugcgccggggcgaccugcccguguggcucagcuacaagguggccuccgagggcuuccaguacagcgaccgccgguggugcuucgacggggagcgcaacaaccagguccuggaggagaacauggacguggagaucuggacgaaggagggcgagcggaagaagcugcgcccccgguggcucgacgcccgcaccuacagcgacccccuggcccugcgggaguucaaggaguucgcggccgggcgccgguccgugagcggcgaccucauccuggagaucggcaagcugccgcagcaccucacccagcgcgcccagaacgcccuggacaaccuggucaugcuccacaacuccgagcagggcgggcgggcguaccgccacgccauggaggagcugcccgacaccaucgagacgcugaugcuccuggcccugaucgccgugcucaccgggggcgugacccuguucuuccugagcgggcggggccucggcaagaccuccaucgggcugcugugcgucauggccagcuccgugcuccuguggauggcgagcguggagccccacuggaucgccgccuccaucauccuggaguucuuccucaugguccugcugauccccgagccggaccgccagcggacgccccaggacaaccagcucgccuacguggugaucggccugcuguucaugauccucacggucgccgcgaacgagauggggcugcuggagaccaccaagaaggaccucggcaucgggcacguggccguggagaaccaccaccacgccgccaugcuggacgucgaccugcaccccgccagcgcguggacccucuacgccguggccacgaccaucaucaccccgaugaugcgccacaccaucgagaacacgaccgccaacaucucccugaccgccaucgcgaaccaggccgccauccugaugggccucgacaagggcuggcccaucagcaagauggacaucggggugccccugcuggcccucggcugcuacucccaggucaacccccugaccaugacggcggccgugcugaugcucguggcccacuacgccaucaucgggccgggccugcaggccaaggcgacccgcgaggcccagaagcggaccgccgccgggaucaugaagaaccccaccgucgacggcaucguggccaucgaccuggaccccguggucuacgacgcgaaguucgagaagcagcucggccagaucaugcugcugauccucugcacgagccagauccugcugaugcgcaccaccugggcccucugcgaguccaucacccuggccacggggccccugaccacccucugggagggcagcccggggaaguucuggaacaccacgaucgccguguccauggccaacaucuuccggggcagcuaccuggcgggcgccgggcuggccuucucccucaugaagucccugggcgggggccgccgggggaccggcgcccagggcgagacccugggggagaaguggaagcgccagcucaaccagcugagcaaguccgaguucaacaccuacaagcggagcggcaucauggagguggaccgcuccgaggcgaaggaggggcugaagcggggcgagacgaccaagcacgccgucagccgcgggaccgccaagcuccggugguucguggagcgcaaccuggugaagcccgagggcaaggucaucgaccugggcugcgggcggggcgggugguccuacuacugcgccggccugaagaaggugaccgaggugaagggguacacgaagggcggccccgggcacgaggagcccaucccgauggccaccuacggcuggaaccucgucaagcugcacagcgggaaggacguguucuucaucccgcccgagaagugcgacacccugcucugcgacaucggcgaguccagccccaacccgaccaucgaggaggggcgcacgcugcgggugcugaagauggucgagcccuggcuccgcggcaaccaguucugcaucaagauccugaaccccuacaugcccuccgugguggagacccuggagcagaugcagcggaagcacggcgggaugcucguccgcaacccgcugagccggaacuccacccacgagauguacugggugagcugcggcaccgggaacaucguguccgcggucaacaugaccagccgcaugcugcucaaccgcuucacgauggcccaccggaagcccaccuacgagcgcgacguggaccugggcaccggcacccggcacguggccgucgagcccgagguggccaaccuggacaucaucgggcagcgcaucgagaacaucaagcacgagcacaaguccacguggcacuacgacgaggacaaccccuacaagaccugggccuaccacggcagcuacgaggugaagccguccgggagcgcguccagcauggucaacggcguggucaagcuccugaccaagcccugggacgugauccccauggugacccagaucgccaugacggacaccacccccuucgggcagcagcgggucuucaaggagaagguggacacccgcacgccgaaggccaagcggggcaccgcccagaucauggaggugaccgcccgcuggcuguggggcuuccucagccggaacaagaagccccgcaucugcacccgggaggaguucacgcgcaagguccgguccaacgcggccaucggggccguguucguggacgagaaccaguggaacagcgccaaggaggcggucgaggacgagcgcuucugggaccuggugcaccgggagcgcgagcugcacaagcagggcaagugcgcgaccugcguguacaacaugauggggaagcgggagaagaagcucggcgaguucgggaaggccaagggcucccgcgccaucugguacauguggcugggcgcccgguuccuggaguucgaggcgcucggguucaugaacgaggaccacugguucagccgcgagaacucccugagcggcgucgagggggagggccugcacaagcucggguacauccugcgggacaucuccaagauccccggcggcaacauguacgccgacgacaccgccgggugggacacccgcaucacggaggacgaccugcagaacgaggccaagaucaccgacaucauggagccggagcacgcccuccuggcgaaggccaucuucaagcugaccuaccagaacaagguggugcgcguccagcggcccgccaagaacggcaccgugauggacgugaucagccgccgggaccagcgcggguccggccaggucggcacguacgggcucaacaccuucaccaacauggaggcccagcugauccggcagauggagagcgagggcaucuucucccccagcgagcuggagacccccaaccucgccgagcgcgcgcuggacuggcuggagaaguacgggguggagcggcucaagcgcauggccaucuccggcgacgacugcguggucaagccgaucgacgaccgguucgccacggcccugaccgcccugaacgacauggggaaggugcgcaaggacaucccccagugggagcccagcaagggcuggaacgacuggcagcagguccccuucugcucccaccacuuccaccagcucaucaugaaggacggccgggagaucgucgugccgugccgcaaccaggacgagcugguggggcgggcgcgcgucagccagggcgccggguggucccugcgggagaccgccugccucggcaagagcuacgcccagauguggcagcugauguacuuccaccgccgggaccugcgccucgcggccaacgccaucugcagcgccgugcccguggacuggguccccaccucccggacgaccuggagcauccacgcccaccaccaguggaugaccaccgaggacaugcuguccguguggaaccgcguguggaucgaggagaaccccuggauggaggacaagacgcacaucagcuccugggaggacgucccguaccuggggaagcgcgaggaccaguggugcggcagccucaucggccugaccgcgcgggccaccugggccaccaacauccagguggccaucaaccaggugcgccggcugaucgggaacgagaacuaccucgacuacaugaccuccaugaagcgcuucaagaacgagagcgaccccgagggcgcccugugguga

SEQ ID NO: 8536 - RNA, 9879 nt, Artificial Sequence
  derived and/or modified CDS sequence (opt1) from DENV-1__FJ882558__SS-prME
agcgugaccaugcugcucaugcugaugcccaccgcccuggccuuccaccucacgacccggggcggggagccccacaugaucgugagcaagcaggagcggggcaagagccugcuguucaagaccagcgccggggugaacaugugcacccucaucgccauggaccugggcgaguucugcgaggacaccaugaccuacaagugcccccgcaucaccgaggccgagcccgacgacguggacugcuggugcaacgccaccgacacgugggugaccuacgggaccugcagccagaccggcgagcaccggcgggacaagcgguccguggcccuggcgccccacgugggccucgggcuggagacgcgcaccgagaccuggaugagcuccgagggcgccuggaagcagauccagcggguggagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugcccgacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaagaccguccaguacgagaaccugaaguacagcgugaucgugaccguccacacgggcgaccagcaccagguggggaacgaguccaccgagcacggcaccaccgcgaccaucacgccccaggcccccagcaccgagauccagcugaccgacuacggggcccucacccuggacugcagcccccggacgggccuggacuucaacgagaugguccuccugaccaugaaggagaaguccuggcuggugcacaagcagugguuccucgaccugccgcugcccuggaccagcggggccuccaccagccaggagacguggaaccggaaggaccuccuggugaccuucaagaccgcccacgcgaagaagcaggaggucguggugcugggcucccaggagggcgccaugcacaccgcccucacgggggccaccgagauccagaccagcggcaccacgaccaucuucgccgggcaccugaagugccgccugaagauggacaagcucacccugaagggcauguccuacgucaugugcaccgggagcuucaagcuggagaaggagguggcggagacgcagcacggcaccgugcucguccagaucaaguacgagggcaccgacgcccccugcaagauccccuucuccacccaggacgagaagggggugacgcagaacggccggcugaucaccgccaacccgaucgugaccgacaaggagaagcccgucaacaucgaggccgagccgcccuucggggagagcuacaucgugaucggcgcgggcgagaaggcccugaagcuguccugguucaagaaggggagcuccaucggcaagauguucgaggccaccgcccgcggggcccggcgcauggcgauccucggcgacacggccugggacuucgggagcaucggcggcguguucaccuccgucgggaagcuggugcaccagaucuucggcaccgccuacggggugcuguucagcggcgucuccuggaccaugaagaucgggaucggcgugcuccugacguggcugggccucaacagccgcuccaccagccuguccaugaccugcaucgccguggggcuggucacccucuaccugggcgugauggugcaggccgacagcgggugcgucaucaacuggaagggccgggagcugaagugcgggagcggcaucuucgugacgaacgaggugcacaccuggaccgagcaguacaaguuccaggcggacuccccgaagcgccucagcgccgccaucggcaaggccugggaggagggggucugcggcauccgguccgccacccgccuggagaacaucauguggaagcagaucagcaacgagcugaaccacauccuccuggagaacgacaugaaguucaccgugguggucggggacguggcgggcauccuggcccaggggaagaagaugauccggccccagcccauggaguacaaguacuccuggaaguccuggggcaaggccaagaucaucggcgccgacgugcagaacacgaccuucaucaucgacgggcccaacaccccggagugccccgacgaccagcgcgcguggaacaucugggaggucgaggacuacggcuucgggaucuucaccacgaacaucuggcucaagcugcgggacuccuacacccaggugugcgaccaccgccugaugagcgccgccaucaaggacuccaaggccgugcacgccgacaugggcuacuggaucgagagcgagaagaacgagaccuggaagcucgcgcgggccuccuucaucgaggucaagaccugcaucuggcccaagagccacacgcugugguccaacggcgugcuggagagcgagaugaucauccccaagaucuacgggggcccgaucucccagcacaacuaccgccccggguacuucacccagaccgccggccccuggcaccucgggaagcuggagcuggacuucgaccucugcgagggcaccacgguggucguggacgagcacugcggcaaccgggggccgagccugcgcaccaccaccgugacgggcaagaucauccacgaguggugcugccgguccugcacccugccgccccugcgcuucaagggggaggacggcugcugguacgggauggagauccggcccgucaaggagaaggaggagaaccuggucaagagcauggugagcgccggcuccggcgaggucgacagcuucucccuggggcuccugugcaucagcaucaugaucgaggaggugaugcgcucccgguggagccgcaagaugcugaugaccggcacccucgccguguucuuccugcugaucauggggcagcucacguggaacgaccugauccggcugugcaucauggucggcgcgaacgccuccgaccgcauggggaugggcaccaccuaccucgcccugauggccaccuucaagaugcgcccgauguucgccgugggccuccuguuccggcgccugacgagccgggaggugcugcuccugaccaucgggcugucccucgucgcgagcguggagcugcccaacucccuggaggagcucggcgacgggcuggccaugggcaucaugauccugaagcuccugaccgacuuccagagccaccagcugugggccacccuccugucccugacguucaucaagaccaccuucagccuccacuacgccuggaagaccauggcgaugguccuguccaucgugagccuguucccccucugccuguccacgaccagccagaagaccaccuggcugcccgugcuccugggcucccuggggugcaagccgcucacgauguuccugaucgccgagaacaagaucuggggccgcaagagcuggccccugaacgaggggaucauggccgucggcaucgugagcauccuccuguccagccugcucaagaacgacgugccccuggccgggccccugaucgccggcggcaugcucaucgcgugcuacgucaucuccgggagcuccgccgaccugagccuggagaaggccgccgagguguccugggaggaggaggccgagcacagcggcgcgucccacaacauccucguggagguccaggacgacgggaccaugaagaucaaggacgaggagcgggacgacacccugaccauccugcucaaggccacccugcugacggugagcggcguguacccgcucuccauccccgccacccuguucgucugguacuucuggcagaagaagaagcagcgcagcggggugcugugggacacccccagcccgcccaagguggagcgggccguccucgacgacggcaucuaccgcaucaugcagcggggccugcuggggcgcagccaggugggcgugggggucuuccaggagaacguguuccacaccauguggcacgugacgcggggcgccguccugauguaccaggggaagcgccucgagcccuccugggcgagcgugaagaaggaccugaucuccuacggcggcggguggcggcugcagggcagcuggaacaccggggaggaggugcaggucaucgccguggagcccggcaagaaccccaagaacgugcagaccgcccccgggaccuucaagacguccgagggcgaggucggcgccaucgcccucgacuucaagcccgggaccagcggcagccccaucgugaaccgcgaggggaagaucgugggccuguacggcaacggggucgugaccaccuccggcacguacgugagcgcgaucgcccaggccaaggccucccaggaggggccccugccggagaucgaggacgaggucuuccggaagcgcaaccucaccaucauggaccugcaccccggcagcgggaagacccggcgcuaccugcccgcgaucgugcgggaggccaucaagcgcaagcuccggacccugauccuggccccgacgcgcguggucgccuccgagauggccgaggcgcucaagggcaugcccauccgcuaccagaccaccgccgucaagagcgagcacaccggcaaggagaucguggaccugaugugccacgccacguucaccaugcggcugcucucccccguccgcgugcccaacuacaacaugaucaucauggacgaggcccacuucaccgacccgagcuccaucgccgcgcggggguacaucagcacccgcgugggcaugggggaggccgccgccaucuucaugacggccacgccgcccggcuccgucgaggcguucccccagagcaacgccgugauccaggacgaggagcgggacaucccggagcgcuccuggaacagcggguacgaguggaucaccgacuuccccggcaagaccgugugguucguccccuccaucaagagcggcaacgacaucgccaacugccugcggaagaacgggaagcgcgugauccagcugucccggaagacguucgacaccgaguaccagaagaccaagaacaacgacugggacuacguggucaccacggacaucagcgagaugggcgccaacuuccgcgcggaccgggugaucgacccccgccggugccucaagccggugauccugaaggacgggcccgagcgcgucauccuggccggccccaugcccgugaccgucgccuccgccgcccagcggcgcgggcggaucggccgcaaccacaacaaggagggcgaccaguacaucuacauggggcagccgcucaacaacgacgaggaccacgcgcacuggaccgaggccaagaugcugcuggacaacaucaacacccccgagggcaucauccccgcccucuucgagcccgagcgggagaaguccgccgccaucgacggggaguaccgccugcgcggcgaggcgcggaagacguucguggagcugaugcgccgcggggaccucccgguguggcugagcuacaaggucgccuccgagggcuuccaguacagcgaccgccgguggugcuucgacggcgagcgcaacaaccaggugcuggaggagaacauggacguggagaucuggaccaaggagggggagcggaagaagcuccgcccccgguggcuggacgcccgcaccuacuccgacccccuggcccuccgggaguucaaggaguucgccgcgggccgccggagcgucuccggggaccugauccuggagaucggcaagcucccccagcaccugacccagcgcgcccagaacgcccuggacaaccucgugaugcugcacaacagcgagcagggcgggcgggccuaccgccacgcgauggaggagcugccggacacgaucgagaccaugaugcuccuggcccugaucgccgugcucaccggcggggucacccuguucuuccuguccggccgggggcucggcaagaccagcaucggccugcugugcgugauggccuccagcgugcuccuguggauggccuccgucgagccccacuggaucgcggccagcaucauccuggaguucuuccucauggugcugcugauccccgagcccgaccgccagcggacgccgcaggacaaccagcucgccuacguggucaucgggcugcuguucaugauccucaccguggccgccaacgagaugggccugcuggagaccaccaagaaggaccucgggaucggccacguggcggucgagaaccaccaccacgccgccaugcuggacguggaccugcaccccgccuccgccuggacgcucuacgcgguggccaccaccaucaucacccccaugaugcgccacacgaucgagaacaccaccgccaacaucagccugaccgccaucgccaaccaggcggccauccugauggggcucgacaagggcuggccgaucuccaagauggacaucggcgucccccugcuggcccucgggugcuacagccaggugaacccccugacgcugaccgccgcggugcucaugcuggucgcccacuacgccaucaucggccccgggcugcaggccaaggccacccgggaggcgcagaagcgcaccgccgccggcaucaugaagaacccgacgguggacgggaucguggccaucgaccucgaccccgucguguacgacgccaaguucgagaagcagcugggccagaucaugcugcucauccugugcaccucccagauccugcucaugcgcaccaccugggcgcugugcgagagcaucacgcuggccaccggcccccucaccacccugugggaggggucccccggcaaguucuggaacacgaccaucgccgugagcauggccaacaucuuccgggggagcuaccuggccggcgcgggccucgccuucucccugaugaagucccucgggggcgggcgccgggggaccggggcccagggcgagacccucggcgagaaguggaagcgccagcugaaccagcuguccaagagcgaguucaacacguacaagcgguccgggaucauggaggucgaccgcagcgaggccaaggagggccucaagcgcggggagaccaccaagcacgcggugucccgcggcaccgccaagcugcggugguucguggagcgcaaccuggucaagccggaggggaaggugaucgaccucggcugcggccgcggcggguggagcuacuacugcgccgggcugaagaaggugacggaggucaagggguacaccaagggcggccccggccacgaggagcccauccccauggccaccuacggguggaaccuggugaagcugcacuccggcaaggacguguucuucaucccgcccgagaagugcgacacccuccugugcgacaucggggagagcucccccaaccccacgaucgaggagggccgcacccugcggguccucaagaugguggagccguggcugcgcgggaaccaguucugcaucaagauccugaaccccuacaugcccagcguggucgagacccucgagcagaugcagcggaagcacggcggcaugcuggugcgcaacccccugucccggaacagcacccacgagauguacuggguguccugcgggaccggcaacaucgucagcgccgugaacaugacgucccgcaugcuccugaaccgguucaccauggcgcaccgcaagccgaccuacgagcgcgacguggaccugggggccggcacccggcacgucgccguggagcccgagguggccaaccucgacaucaucggccagcgcaucgagaacaucaagcacgagcacaagagcacguggcacuacgacgaggacaaccccuacaagaccugggccuaccacggguccuacgaggucaagcccagcggcagcgcguccagcauggugaacggggucgugaagcugcugaccaagccgugggacgugauccccauggucacccagaucgccaugacggacaccacccccuucggccagcagcggguguucaaggagaagguggacacccgcacgcccaaggccaagcgggggaccgcccagaucauggaggucaccgccaaguggcucuggggcuuccugucccgcaacaagaagccgcggaucugcacccgcgaggaguucacgcggaaggugcgcagcaacgcggccaucggcgccguguucgucgacgagaaccaguggaacuccgccaaggaggcgguggaggacgagcgguucugggaccuggugcaccgcgagcgggagcuccacaagcaggggaagugcgcgaccugcgucuacaacaugaugggcaagcgcgagaagaagcugggggaguucggcaaggccaaggggagccgggccaucugguacauguggcugggcgcccgcuuccucgaguucgaggcgcugggcuucaugaacgaggaccacugguucucccgggagaacagccuguccgggguggagggcgaggggcuccacaagcugggcuacauccugcgcgacaucagcaagauccccgggggcaacauguacgccgacgacaccgccggcugggacacccggaucacggaggacgaccuccagaacgaggccaagaucaccgacaucauggagcccgagcacgcccugcuggcgaaguccaucuucaagcucaccuaccagaacaaggugguccgcgugcagcggccggccaagaacgggaccgugauggacgucaucagccgccgcgaccagcggggcuccggccaggugggcacguacggccugaacaccuucaccaacauggaggcccagcugauccgccagauggagagcgaggggaucuucucccccagcgagcucgagacccccaaccuggcccggcgcgugcuggacuggcucgagaagcacggcgucgagcggcugaagcgcauggccaucuccggggacgacugcguggugaagcccaucgacgaccgguucgcgacggcccugaccgcccucaacgacaugggcaagguccgcaaggacaucccgcagugggagcccagcaagggguggaacgacuggcagcagguccccuucugcagccaccacuuccaccagcugaucaugaaggacggccgggagaucgugguccccugccgcaaccaggacgagcuggugggccgggcccgcgugucccagggggccggcuggagccuccgggagaccgcgugccuggggaaguccuacgcccagauguggcagcugauguacuuccaccgccgggaccuccgccuggccgccaacgcgaucugcagcgccgucccgguggacugggugcccaccucccggacgaccuggagcauccacgcccaccaccaguggaugaccaccgaggacaugcuguccgucuggaaccgcguguggaucgaggagaaccccuggauggaggacaagacgcacaucagcuccuggggcgacgugcccuaccucgggaagcgggaggaccaguggugcggcagccugaucggccugaccgcccgcgccaccugggcgaccaacauccaggucgccaucaaccaggugcgccggcucaucgggaacgagaacuaccuggacuacaugaccuccaugaagcgcuucaagaacgagagcgacccggagggcgcccugugguga

SEQ ID NO: 8537 - RNA, 9879 nt, Artificial Sequence
  derived and/or modified CDS sequence (opt1) from DENV-1__GQ199824__SS-prME
agcgugaccaugcugcugaugcugaugcccaccgcccuggccuuccaccucacgacccggggcggggagccccacaugaucguguccaagcaggagcggggcaagagccugcuguucaagaccuccgcgggggugaacaugugcacccucaucgccauggaccugggcgaguucugcgaggacacgaugaccuacaagugcccccgcaucaccgaggccgagcccgacgacguggacugcuggugcaacgccaccgacacgugggucaccuacgggaccugcagccagaccggcgagcaccggcgggacaagcgguccguggcccuggcgccccacgugggccucgggcuggagacgcgcaccgagaccuggaugagcuccgagggcgccuggaagcagauccagcgggucgagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugcccgacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaagaccguccaguacgagaaccugaaguacagcgugaucgugaccguccacacgggcgaccagcaccagguggggaacgaguccaccgagcacggcaccaccgcgaccaucacgccccaggcccccagcaccgagauccagcugaccgacuacggggcccucacccuggacugcagcccccggacgggccuggacuucaacgagaugguccuccugaccaugaaggagaaguccuggcuggugcacaagcagugguuccucgaccugccgcugcccuggaccagcggggccuccaccagccaggagacguggaaccggaaggaccuccuggugaccuucaagaccgcccacgcgaagaagcaggaggucguggugcugggcucccaggagggcgccaugcacaccgcccucacgggggccaccgagauccagaccagcggcaccacgaccaucuucgccgggcaccugaagugccgccugaagauggacaagcucacccugaagggcauguccuacgucaugugcaccgggagcuucaagcuggagaaggagguggcggagacgcagcacggcaccgugcucguccagaucaaguacgagggcaccgacgcccccugcaagauccccuucuccacccaggacgagaagggggugacgcagaacggccggcugaucaccgccaacccgaucgugaccgacaaggagaagcccgucaacaucgaggccgagccgcccuucggggagagcuacaucgugaucggcgcgggcgagaaggcccugaagcuguccugguucaagaaggggagcuccaucggcaagauguucgaggccaccgcccgcggggcccggcgcauggcgauccucggcgacacggccugggacuucgggagcaucggcggcguguucaccuccgucgggaagcuggugcaccagaucuucggcaccgccuacggggugcuguucagcggcgucuccuggaccaugaagaucgggaucggcgugcuccugacguggcugggccucaacagccgcuccaccagccuguccaugaccugcaucgccguggggcuggucacccucuaccugggcgugauggugcaggccgacagcgggugcgucaucaacuggaagggccgggagcugaagugcgggagcggcaucuucgugacgaacgaggugcacaccuggaccgagcaguacaaguuccaggcggacuccccgaagcgccucagcgccgccaucggcaaggccugggaggagggggucugcggcauccgguccgccacccgccuggagaacaucauguggaagcagauccugaacgagcucaaccacauccugcuggagaacgacaugaaguucaccgugguggucggggacguggcgggcauccucgcccaggggaagaagaugauccggccccagcccauggaguacaaguacagcuggaaguccuggggcaaggccaagaucaucggcgccgacgugcagaacacgaccuucaucaucgacgggcccaacaccccggagugccccgacgaccagcgcgcguggaacaucugggaggucgaggacuacggcuucgggaucuucaccacgaacaucuggcugaagcugcgggacagcuacacccaggugugcgaccaccgccucauguccgccgccaucaaggacagcaaggccgugcacgccgacaugggcuacuggaucgaguccgagaagaacgagaccuggaagcuggcgcgggccagcuucaucgaggucaagaccugcaucuggcccaagucccacacgcuguggagcaacggcgugcucgaguccgagaugaucauccccaagaucuacgggggcccgaucagccagcacaacuaccgccccggguacuucacccagaccgccggccccuggcaccuggggaagcuggagcucgacuucgaccugugcgagggcaccacgguggucguggacgagcacugcggcaaccgggggccgucccugcgcaccaccaccgugacgggcaagaucauccacgaguggugcugccggagcugcacccugccgccccuccgcuucaagggggaggacggcugcugguacgggauggagauccggcccgucaaggagaaggaggagaaccuggugaaguccauggugagcgccggcagcggcgaggucgacuccuucagccucgggcugcugugcaucuccaucaugaucgaggaggugaugcgcagccgguggucccgcaagaugcucaugaccggcacccuggccguguucuuccugcucaucauggggcagcugacguggaacgaccugauccggcucugcaucauggucggcgcgaacgccagcgaccgcauggggaugggcaccaccuaccuggcccugauggccaccuucaagaugcgcccgauguucgccgugggccuccuguuccggcgccugacgucccgggaggugcuccugcugaccaucgggcucagccuggucgcguccguggagcugcccaacagccucgaggagcugggcgacgggcuggccaugggcaucaugauccucaagcugcugaccgacuuccagucccaccagcucugggccacccugcugagccucacguucaucaagaccaccuucucccugcacuacgccuggaagaccauggcgaugguccugagcaucgugucccucuucccccugugccugagcacgaccucccagaagaccaccuggcuccccgugcugcugggcagccucgggugcaagccgcugacgauguuccugaucgccgagaacaagaucuggggccgcaaguccuggccccucaacgaggggaucauggccgucggcaucgugagcauccugcugagcucccuccugaagaacgacgugccccuggccgggccccucaucgccggcggcaugcugaucgcgugcuacgucaucagcggguccagcgccgaccugucccucgagaaggccgccgaggugagcugggaggaggaggccgagcacuccggcgcgagccacaacauccugguggagguccaggacgacgggaccaugaagaucaaggacgaggagcgggacgacacccugaccauccuccugaaggccacccugcucgccguguccggcguguacccgcugagcauccccgccacgcuguucgucugguacuucuggcagaagaagaagcagcgcuccggggugcucugggacacccccagcccgcccgagguggagcgggccguccuggacgacggcaucuaccgcaucaugcagcggggccugcuggggcgcucccaggugggcgugggggucuuccaggagaacguguuccacaccauguggcacgugacccggggcgcgguccucauguaccaggggaagcgccuggagcccagcugggccuccgugaagaaggaccugaucagcuacggcggcggguggcggcuccagggcuccuggaacacgggggaggaggugcaggucaucgccguggagcccggcaagaaccccaagaacgugcagaccgcccccgggaccuucaagaccagcgagggcgaggucggcgccaucgcgcuggacuucaagcccgggacguccggcagccccaucgugaaccgcgaggggaagaucgugggccuguacggcaacggggucgugaccaccagcggcaccuacguguccgccaucgcccaggccaaggcgagccaggaggggccccucccggagaucgaggacgaggucuuccggaagcgcaaccugacgaucauggaccugcaccccggcuccgggaagacccggcgcuaccuccccgccaucgugcgggaggccaucaagcgcaagcugcggacccugauccucgccccgacccgcguggucgccagcgagauggcggaggcccugaagggcaugcccauccgcuaccagacgaccgccgugaaguccgagcacaccggcaaggagaucguggaccugaugugccacgccaccuucacgaugcggcuccugagccccguccgcgugcccaacuacaacaugaucaucauggacgaggcccacuucaccgacccguccagcaucgcggcccggggguacaucuccacccgcgugggcaugggggaggccgccgccaucuucaugaccgcgacgccgcccggcagcgucgaggccuucccccaguccaacgccgugauccaggacgaggagcgggacaucccggagcgcagcuggaacuccggguacgaguggaucaccgacuuccccggcaagaccgugugguucguccccagcaucaaguccggcaacgacaucgccaacugccugcggaagaacgggaagcgcgugauccagcucagccggaagaccuucgacacggaguaccagaagaccaagaacaacgacugggacuacguggucaccaccgacaucuccgagaugggcgcgaacuuccgcgccgaccgggugaucgacccccgccggugccugaagccggugauccugaaggacgggcccgagcgcgucauccucgccggccccaugcccgugacggucgccagcgccgcgcagcggcgcgggcggaucggccgcaaccacaacaaggagggcgaccaguacaucuacauggggcagccgcugaacaacgacgaggaccacgcccacuggaccgaggccaagaugcugcucgacaacaucaacacccccgagggcaucauccccgcccuguucgagcccgagcgggagaaguccgccgcgaucgacggggaguaccgccugcgcggcgaggcccggaagaccuucguggagcucaugcgccgcggggaccugccgguguggcugagcuacaaggucgccagcgagggcuuccaguacuccgaccgccgguggugcuucgacggcgagcgcaacaaccaggugcucgaggagaacauggacguggagaucuggacgaaggagggggagcggaagaagcugcgcccccgguggcuggacgcccgcaccuacagcgacccccucgcccugcgggaguucaaggaguucgcggccggccgccgguccgucagcggggaccugauccucgagaucggcaagcugccccagcaccugacccagcgcgcccagaacgcccucgacaaccuggugaugcugcacaacuccgagcagggcgggcgggcguaccgccacgccauggaggagcucccggacaccaucgagacgcugaugcugcucgcccugaucgccgugcugaccggcggggucacccucuucuuccugagcggccgggggcugggcaagaccuccaucggccuccugugcgugauggccagcuccgugcugcucuggauggcgagcgucgagccccacuggaucgccgccuccaucauccuggaguucuuccugauggugcuccugauccccgagcccgaccgccagcggaccccgcaggacaaccagcuggccuacguggucaucgggcuccuguucaugauccugacgguggccgcgaacgagaugggccuccuggagaccaccaagaaggaccuggggaucggccacguggccgucgagaaccaccaccacgccgccaugcucgacguggaccugcaccccgccagcgcguggacccuguacgccguggccacgaccaucaucacccccaugaugcgccacaccaucgagaacacgaccgccaacaucucccucaccgccaucgcgaaccaggccgccauccugauggggcuggacaagggcuggccgaucagcaagauggacaucggcgucccccuccuggcccuggggugcuacucccaggugaacccccucacccugacggcggccgugcugaugcucgucgcccacuacgccaucaucggccccgggcugcaggccaaggcgacccgggaggcccagaagcgcaccgccgccggcaucaugaagaacccgaccguggacgggaucguggccaucgaccuggaccccgucguguacgacgcgaaguucgagaagcagcucggccagaucaugcugcugauccucugcacgagccagauccugcugaugcgcaccaccugggcccucugcgaguccaucacccuggccacgggcccccugaccacccucugggaggggagccccggcaaguucuggaacaccacgaucgccguguccauggccaacaucuuccgggggagcuaccuggcgggcgccggccuggccuucagccucaugaagucccucgggggcgggcgccgggggaccggggcccagggcgagacccugggcgagaaguggaagcgccagcucaaccagcugagcaaguccgaguucaacaccuacaagcggagcgggaucauggaggucgaccgcuccgaggcgaaggagggccugaagcgcggggagacgaccaagcacgccgugagccgcggcaccgccaagcuccggugguucguggagcgcaaccuggucaagccggaggggaaggugaucgaccugggcugcggccgcggcgggugguccuacuacugcgccgggcugaagaaggugaccgaggucaagggguacacgaagggcgggcccggccacgaggagcccauccccauggccaccuacggguggaaccucgugaagcugcacagcggcaaggacguguucuucaucccgcccgagaagugcgacacccugcucugcgacaucggggaguccagccccaaccccaccaucgaggagggccgcacgcugcggguccugaagaugguggagccguggcuccgcgggaaccaguucugcaucaagauccugaaccccuacaugcccuccguggucgagacccuggagcagaugcagcggaagcacggcggcaugcucgugcgcaacccccugagccggaacuccacccacgagauguacugggugagcugcgggaccggcaacaucgucuccgcggugaacaugaccagccgcaugcugcucaaccgguucacgauggcccaccgcaagccgaccuacgagcgcgacguggaccugggggccggcacccggcacgucgccguggagcccgagguggccaaccuggacaucaucggccagcgcaucgagaacaucaagcacgagcacaaguccaccuggcacuacgacgaggacaaccccuacaagacgugggcguaccacgggagcuacgaggucaagcccuccggcagcgccagcuccauggugaacggggucgugaagcuccugaccaagccgugggacgugauccccauggucacccagaucgccaugaccgacacgacccccuucggccagcagcggguguucaaggagaagguggacacccgcacccccaaggccaagcgggggacggcccagaucauggaggucaccgcgaaguggcuguggggcuuccucagccgcaacaagaagccgcggaucugcacccgcgaggaguucacccggaaggugcgcuccaacgccgccaucggcgccguguucgucgacgagaaccaguggaacagcgcgaaggaggccguggaggacgagcgguucugggaccuggugcaccgcgagcgggagcugcacaagcaggggaagugcgccacgugcgucuacaacaugaugggcaagcgcgagaagaagcucggggaguucggcaaggccaaggggucccgggccaucugguacauguggcugggcgcgcgcuuccuggaguucgaggcccucggcuucaugaacgaggaccacugguucagccgggagaacucccugagcgggguggagggcgaggggcugcacaagcucggcuacauccugcgcgacaucuccaagauccccgggggcaacauguacgccgacgacaccgccggcugggacacccggaucaccgaggacgaccugcagaacgaggccaagaucacggacaucauggagcccgagcacgcgcuccuggccaagagcaucuucaagcugaccuaccagaacaaggugguccgcgugcagcggccggccaagaacgggaccgugauggacgucaucucccgccgcgaccagcggggcagcggccaggugggcaccuacggccucaacacguucaccaacauggaggcccagcugauccgccagauggaguccgaggggaucuucagccccuccgagcuggagacccccaaccucgccggccgggugcuggacuggcuggagaagcacggggucgagcgccucaagcggauggcgaucagcggcgacgacugcguggugaagcccaucgacgaccgcuucgccaccgcccugacggcccugaacgacauggggaagguccggaaggacaucccgcagugggagcccuccaagggcuggaacgacuggcagcagguccccuucugcagccaccacuuccaccagcucaucaugaaggacggccgcgagaucgugguccccugccggaaccaggacgagcugguggggcgcgcccgggugagccagggcgcgggguggucccugcgcgagaccgccugccucggcaagagcuacgcccagauguggcagcugauguacuuccaccggcgcgaccugcggcucgccgcgaacgccaucugcuccgccgucccgguggacugggugcccaccagccgcaccacgugguccauccacgcccaccaccaguggaugaccaccgaggacaugcugagcgucuggaaccggguguggaucgaggagaaccccuggauggaggacaagacccacaucuccagcuggggcgacgugcccuaccugggcaagcgcgaggaccaguggugcggcucccucaucgggcugacggcccgggcgaccugggccaccaacauccaggucgccaucaaccaggugcgccgccugaucggcaacgagaacuaccucgacuacaugaccagcaugaagcgguucaagaacgaguccgacccggagggggcccugugguga

SEQ ID NO: 8538 - RNA, 9879 nt, Artificial Sequence
  derived and/or modified CDS sequence (opt1) from DENV-1__FJ882559__SS-prME
agcgugaccaugcugcucaugcugaugcccaccgcccuggccuuccaccucacgacccggggcggggagccccacaugaucgugagcaagcaggagcggggcaagagccugcuguucaagaccagcgccggggugaacaugugcacccucaucgccauggaccugggcgaguucugcgaggacaccaugaccuacaagugcccccgcaucaccgaggccgagcccgacgacguggacugcuggugcaacgccaccgacacgugggugaccuacgggaccugcagccagaccggcgagcaccggcgggacaagcgguccguggcccuggcgccccacgugggccucgggcuggagacgcgcaccgagaccuggaugagcuccgagggcgccuggaagcagauccagcggguggagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugcccgacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaagaucguccaguacgagaaccugaaguacagcgugaucgugaccguccacaccggcgaccagcaccagguggggaacgaguccacggagcacggcaccaccgcgaccaucacgccccaggcccccagcacggagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccagcggggccuccaccagccaggagaccuggaaccggcaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcauguccuacgucaugugcaccgggagcuucaagcuggagaaggagguggcggagacccagcacggcacggugcucguccagaucaaguacgagggcaccgacgcccccugcaagauccccuucuccacccaggacgagaagggggugacccagaacggccggcugaucacggccaacccgaucgugaccgacaaggagaagcccgucaacaucgaggccgagccgcccuucggggagagcuacaucgugaucggcgcgggcgagaaggcccugaagcuguccugguucaagaaggggagcuccaucggcaagauguucgaggccaccgcccgcggggcccggcgcauggcgauccucggcgacaccgccugggacuucgggagcaucggcggcguguucacguccgucgggaagcuggugcaccagaucuucggcaccgccuacggggugcuguucagcggcgucuccuggaccaugaagaucgggaucggcgugcuccugaccuggcugggccucaacagccgcuccacgagccuguccaugaccugcaucgccguggggcuggucacccucuaccugggcgugauggugcaggccgacagcgggugcgucaucaacuggaagggccgggagcugaagugcgggagcggcaucuucgugaccaacgaggugcacacguggaccgagcaguacaaguuccaggcggacuccccgaagcgccucagcgccgccaucggcaaggccugggaggagggggucugcggcauccgguccgccacccgccuggagaacaucauguggaagcagaucagcaacgagcugaaccacauccuccuggagaacgacaugaaguucaccgugguggucggggacguggcgggcauccuggcccaggggaagaagaugauccggccccagcccauggaguacaaguacuccuggaaguccuggggcaaggcccgcaucaucggcgccgacgugcagaacaccacguucaucaucgacgggcccaacaccccggagugccccgacgaccagcgggcguggaacaucugggaggucgaggacuacggcuucgggaucuucaccaccaacaucuggcuccgccugcgggacuccuacacccaggugugcgaccaccgccugaugagcgccgccaucaaggacuccaaggccgugcacgccgacaugggcuacuggaucgagagcgagaagaacgagaccuggaagcucgcgcgggccuccuucaucgaggucaagaccugcaucuggcccaagagccacacccugugguccaacggcgugcuggagagcgagaugaucauccccaagaucuacgggggcccgaucucccagcacaacuaccgccccggguacuucacgcagaccgccggccccuggcaccucgggaagcuggagcuggacuucgaccucugcgagggcaccaccguggucguggacgagcacugcggcaaccgggggccgagccugcgcacgaccaccgugaccggcaagaucguccacgaguggugcugccgguccugcacgcugccgccccugcgcuucaagggggaggacggcugcugguacgggauggagauccggcccgugaaggagaaggaggagaaccuggucaagagcauggucagcgccggcuccggcgagguggacagcuucucccuggggcuccugugcaucagcaucaugaucgaggaggugaugcgcucccgguggagccgcaagaugcugaugaccggcacccucgccgucuucuuccugcugaucauggggcagcucaccuggaacgaccugauccgccugugcaucauggugggcgcgaacgccuccgaccggauggggaugggcaugacguaccucgcccugauggccaccuucaagaugcgcccgauguucgccgugggccuccuguuccggcgccugaccagccgggagguccugcuccugaccaucgggcugucccucguggcgagcgccgagcugcccaacucccuggaggagcucggcgacgggcuggccaugggcaucaugauccugaagcuccugacggacuuccagagccaccagcugugggccacccuccugucccugaccuucaucaagaccacguucagccuccacuacgcguggaagaccauggccaugguccuguccaucgugagccuguucccccucugccuguccaccaccagccagaagacgaccuggcugcccgugcuccugggcucccuggggugcaagccgcucaccauguuccugaucgccgagaacaagaucuggggccgcaagagcuggccccugaacgaggggaucauggccgucggcaucgugagcauccuccuguccagccugcucaagaacgacgugccccuggccgggccccugaucgcgggcggcaugcucaucgccugcuacgucaucuccgggagcuccgccgaccugagccuggagaaggccgccgagguguccugggaggaggaggcggagcacagcggcgccucccacaacauccucguggagguccaggacgacgggaccaugaagaucaaggacgaggagcgggacgacacgcugaccauccugcucaaggccacccugcuggccgugagcggcguguacccgcucuccauccccgccacccuguucgucugguacuucuggcagaagaagaagcagcgcagcggggugcugugggacacccccagcccgcccgagguggagcgggcgguccucgacgacggcaucuaccgcaucaugcagcggggccugcuggggcgcagccaggugggcgugggggucuuccaggagaacguguuccacacgauguggcacgugacccggggcgccguccugauguaccaggggaagcgccucgagcccuccugggccagcgugaagaaggaccugaucuccuacggcggcggguggcggcugcagggcagcuggaacaccggggaggaggugcaggucaucgccguggagcccggcaagaaccccaagaacgugcagaccgcccccgggacguucaagaccuccgagggcgaggucggcgcgaucgcccucgacuucaagcccgggaccagcggcagccccaucgugaaccgcgaggggaagaucgugggccuguacggcaacggggucgugaccacguccggcaccuacgugagcgccaucgcccaggcgaaggccucccaggaggggccccugccggagaucgaggacgaggucuuccggaagcgcaaccucaccaucauggaccugcaccccggcagcgggaagacccggcgcuaccugcccgccaucgugcgggaggccaucaagcgcaagcuccgcacgcugauccuggccccgacccggguggucgcguccgagauggccgaggcccucaagggcaugcccauccgcuaccagaccaccgccgucaagagcgagcacacgggcaaggagaucguggaccugaugugccacgccaccuucaccaugcggcugcucucccccguccgcgugcccaacuacaacaugaucaucauggacgaggcgcacuucaccgacccgagcuccaucgccgcccggggguacaucagcacgcgcgugggcaugggggaggccgccgcgaucuucaugaccgccacgccgcccggcuccgucgaggccuucccccagagcaacgccgugauccaggacgaggagcgggacaucccggagcgcuccuggaacagcggguacgaguggaucaccgacuuccccggcaagacggugugguucguccccuccaucaagagcggcaacgacaucgcgaacugccugcggaagaacgggaagcgcgugauccagcugucccggaagaccuucgacaccgaguaccagaagaccaagaacaacgacugggacuacguggucacgaccgacaucagcgagaugggcgccaacuuccgcgccgaccgggugaucgacccccgccggugccucaagccggugauccugaaggacgggcccgagcgcgucauccuggccggccccaugcccgugaccgucgccuccgcggcccagcggcgcgggcggaucggccgcaaccacaacaaggagggcgaccaguacaucuacauggggcagccgcucaacaacgacgaggaccacgcccacuggaccgaggccaagaugcugcuggacaacaucaacacgcccgagggcaucauccccgcccucuucgagcccgagcgcgagaaguccgcggccaucgacggggaguaccggcugcgcggcgaggcccggaagaccuucguggagcugaugcgccgcggggaccucccgguguggcugagcuacaaggucgccuccgagggcuuccaguacagcgaccgccgguggugcuucgacggcgagcgcaacaaccaggugcuggaggagaacauggacguggagaucuggaccaaggagggggagcggaagaagcuccgcccccgguggcuggacgcccgcaccuacuccgacccccuggcgcuccgggaguucaaggaguucgccgccggccgccggagcgucuccggggaccugauccuggagaucggcaagcucccccagcaccugacgcagcgcgcccagaacgcgcuggacaaccucgugaugcugcacaacagcgagcagggcgggcgggccuaccgccacgccauggaggagcugccggacaccaucgagacccucaugcugcuggcccucaucgccgugcugaccggcggggucacgcuguucuuccucuccggccgggggcugggcaagaccagcaucggccugcucugcgugauggcguccagcgugcugcuguggauggccuccgucgagccccacuggaucgccgccagcaucauccucgaguucuuccugauggugcugcucauccccgagcccgaccgccagcggaccccgcaggacaaccagcuggccuacguggucaucgggcuccucuucaugauccugaccguggcggccaacgagaugggccugcucgagaccacgaagaaggaccuggggaucggccacguggccgucgagaaccaccaccacgccgccaugcuggacguggaccuccaccccgcguccgccuggacccuguacgccguggccaccaccaucaucacgcccaugaugcgccacaccaucgagaacaccaccgccaacaucagccugacggcgaucgccaaccaggccgccauccucauggggcuggacaagggcuggccgaucuccaagauggacaucggcgucccccugcucgcgcuggggugcuacagccaggugaacccccugacccucaccgccgccgugcugaugcuggucgcccacuacgccaucaucggccccgggcuccaggcgaaggccacccgcgaggcccagaagcggacggccgccggcaucaugaagaacccgaccguggacgggaucguggcgaucgaccuggaccccgucguguacgacgccaaguucgagaagcagcugggccagaucaugcuccugauccugugcaccucccagauccuccugaugcgcaccacgugggcccugugcgagagcaucacccucgccaccggcccccugaccacgcugugggaggggucccccggcaaguucuggaacaccaccaucgccgugagcauggcgaacaucuuccgggggagcuaccucgccggcgccggccuggccuucucccugaugaagucccucgggggcgggcgccggggcaccggggcgcagggcgagacgcugggcgagaaguggaagcgccagcugaaccagcucuccaagagcgaguucaacaccuacaagcgguccgggaucauggaggucgaccgcagcgaggccaaggagggccugaagcgcggggagaccaccaagcacgccgugucccgcggcacggccaagcugcggugguucguggagcgcaaccucgucaagccggaggggaaggugaucgaccugggcugcggccgcggcggguggagcuacuacugcgccgggcugaagaaggugaccgaggucaagggguacaccaagggcgggcccggccacgaggagcccauccccauggcgaccuacggguggaaccuggugcgccuccacuccggcaaggacguguucuucacgccgcccgagaagugcgacacccugcugugcgacaucggggagagcucccccaaccccaccaucgaggagggccggacccuccgcguccugaagaugguggagccguggcugcgggggaaccaguucugcaucaagauccucaaccccuacaugcccagcguggucgagacgcuggagcagaugcagcgcaagcacggcggcaugcuggugcggaacccccucucccgcaacagcacccacgagauguacuggguguccugcgggaccggcaacaucgucagcgccgugaacaugaccucccgcaugcugcugaaccgguucaccauggcccaccgcaagccgacguacgagcgggacguggaccucggggccggcacccgccacgucgccguggagcccgagguggcgaaccuggacaucaucggccagcggaucgagaacaucaagcacgagcacaagagcaccuggcacuacgacgaggacaaccccuacaagaccugggccuaccacggguccuacgaggucaagcccagcggcagcgccuccagcauggugaacggggucgugaagcugcucacgaagccgugggacgugauccccauggucacccagaucgccaugaccgacaccacgcccuucggccagcagcgcguguucaaggagaagguggacacccggacccccaaggccaagcgcgggaccguccagaucauggaggugacggcgaaguggcuguggggcuuccugucccggaacaagaagccgcgcaucugcacccgggaggaguucacccgcaaggugcggagcaacgccgccaucggcgccgucuucguggacgagaaccaguggaacuccgcgaaggaggccguggaggacgagcgcuucugggaccucguccaccgggagcgcgagcugcacaagcaggggaagugcgcgaccugcguguacaacaugaugggcaagcgggagaagaagcugggggaguucggcaaggccaaggggagccgcgccaucugguacauguggcucggcgcgcgguuccuggaguucgaggcccugggcuucaugaacgaggaccacugguucucccgcgagaacagccucuccgggguggagggcgaggggcugcacaagcugggcuacauccuccgggacaucagcaagauccccgggggcaacauguacgccgacgacacggccggcugggacacccgcaucaccgaggacgaccugcagaacgaggccaagaucaccgacaucauggagcccgagcacgcgcugcucgccaaguccaucuucaagcugacguaccagaacaaggucgugcgcgugcagcggccggccaagaacgggaccgucauggacgugaucagccgccgggaccagcgcggcuccggccaggugggcaccuacggccugaacaccuucacgaacauggaggcccagcucauccggcagauggagagcgaggggaucuucucccccagcgagcuggagacccccaaccuggccgagcgcgcgcucgacuggcuggagaagcacggcgucgagcggcugaagcgcauggccaucuccggggacgacugcguggugaagcccaucgacgaccgguucgccaccgcccucaccgcccugaacgacaugggcaagguccgcaaggacaucccgcagugggagcccagcaagggguggaacgacuggcagcagguccccuucugcagccaccacuuccaccagcugaucaugaaggacggccgggagaucgugguccccugccgcaaccaggacgagcucgugggccgggcgcgcgugucccagggggccggcuggagccugcgggagacggccugccuggggaaguccuacgcccagauguggcagcucauguacuuccaccgccgggaccugcgccuggcggccaacgccaucugcagcgccgucccgguggacugggugcccaccucccggaccaccuggagcauccacgcccaccaccaguggaugacgaccgaggacaugcucuccgucuggaaccgcguguggaucgaggagaaccccuggauggaggacaagacccacaucagcuccuggggcgacgugcccuaccuggggaagcgcgaggaccaguggugcggcagccugaucggccucaccgcgcgggccacgugggccaccaacauccaggucgccaucaaccaggugcgccggcugaucgggaacgagaacuaccuggacuacaugaccuccaugaagcgcuucaagaacgagagcgacccggagggcgcccucugguga

SEQ ID NO: 8539 - RNA, 9879 nt, Artificial Sequence
  derived and/or modified CDS sequence (opt1) from DENV-1__GQ199828__SS-prME
agcgugaccaugcugcucaugcugaugcccaccgcccuggccuuccaccucaccacccggggcggggagccccacaugaucgugagcaagcaggagcggggcaagagccugcuguucaagaccagcgcgggggugaacaugugcacccucaucgccauggaccugggcgagcugugcgaggacaccaugaccuacaagugcccccggaucaccgaggccgagcccgacgacguggacugcuggugcaacgccaccgacacgugggugaccuacgggaccugcagccagaccggcgagcaccggcgcgacaagcgguccguggcccucgcgccccacgugggccuggggcuggagacgcgcaccgagaccuggaugagcuccgagggcgccuggaagcagauccagcggguggagaccugggcccuccgccaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcggugcugcggaagcucugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacaccggcgaccagcaccagguggggaacgaguccacggagcacggcaccaccgcgaccaucacgccccaggcccccacgaccgagauccagcucaccgacuacggggcccugacccuggacugcagcccccgcacgggccucgacuucaacgagaugguccugcugaccaugaaggagaaguccuggcucgugcacaagcagugguuccuggaccugccccuccccuggaccagcggggccagcaccucccaggagacguggaaccggcaggaccugcuggugaccuucaagaccgcccacgcgaagaagcaggaggucguggugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgucaugugcaccggguccuucaagcucgagaaggagguggcggagacgcagcacggcaccgugcugguccagaucaaguacgagggcaccgacgcccccugcaagauccccuucagcacccaggacgagaagggggugacgcagaacggccggcugaucaccgccaacccgaucgugaccgacaaggagaagcccgucaacaucgaggccgagccgcccuucggggaguccuacaucgugaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcgucgggaagcuggugcaccagaucuucggcaccgccuacgggguccucuucuccggcgucagcuggaccaugaagaucgggaucggcgugcugcugacguggcucggccugaacucccgcagcaccucccugagcaugaccugcaucgccguggggcucgucacccuguaccugggcgugauggugcaggccgacuccgggugcgucaucaacuggaagggccgggagcucaagugcgggagcggcaucuucgugacgaacgaggugcacaccuggaccgagcaguacaaguuccaggcggacagcccgaagcgccuguccgccgccaucggcaaggccugggaggagggggucugcggcauccggagcgccacccgccuggagaacaucauguggaagcagaucuccaacgagcucaaccacauccugcuggagaacgacaugaagcucaccgugguggucggggacguggcgggcauccuggggcagggcaagaagaugauccggccccagcccauggaguacaaguacagcuggaaguccuggggcaaggccaagaucaucggggccgacgcccagaacacgaccuucaucaucgacggccccaacaccccggagugccccgacgaccagcgcgcguggaacaucugggagguggaggacuacggguucggcaucuucaccacgaacaucuggcugaagcuccgggacagcuacacccaggucugcgaccaccgccugauguccgccgccaucaaggacagcaaggccgugcacgccgacaugggcuacuggaucgaguccgagaagaacgagaccuggaagcuggcgcgggccagcuucaucgaggugaagaccugcgucuggcccaagucccacacgcucuggagcaacggggugcgcgaguccgagaugaucauccccaagaucuacggcgggccgaucagccagcacaacuaccggcccggcuacuucacccagaccgccgggcccuggcaccugggcaagcuggagcucgacuucgaccugugcgagggcaccacgguggucguggacgagcacugcgggaaccgcggcccgucccugcggaccaccaccgugacggggaagaucauccacgaguggugcugccgcagcugcacccugccgccccuccgguuccgcggcgaggacgggugcugguacggcauggagauccggcccgucaaggagaaggaggagaaccuggugaaguccauggugagcgccggcagcggggaggucgacuccuucagccucggccugcugugcaucuccaucaugaucgaggaggugaugcgcagccgguggucccgcaagaugcucaugaucgggacccuggccguguucuuccugcucaucaugggccagcugaccuggaacgaccugauccgccucugcaucauggucggggcgaacgccagcgaccggaugggcaugggcacgaccuaccuggcccugauggccaccuucaagaugcgcccgauguucgccguggggcuccuguuccggcgccugaccucccgggaggugcuccugcugacgaucggccucagccuggucgcguccguggagcugcccaacagccucgaggagcugggggacggccuggccaugggcaucaugauccucaagcugcugaccgacuuccagucccaccagcucugggccacccugcugagccucaccuucaucaagacgaccuucucccugcacuacgccuggaagaccauggcgaugguccugagcaucgugucccucuucccccugugccugagcaccacgucccagaagaccaccuggcuccccgugcugcuggggagccucggcugcaagccgcugaccauguuccugaucgccgagaacaagaucugggggcgcaaguccuggccccucaacgagggcaucauggccgucgggaucgugagcauccugcugagcucccuccugaagaacgacgugccccuggccggcccccucaucgccggcgggaugcugaucgcgugcuacgucaucagcggcuccagcgccgaccugucccucgagaaggccgccgaggugagcugggaggaggaggccgagcacuccggggcgagccacaacauccugguggagguccaggacgacggcacgaugaagaucaagaacgaggagcgggacgacacccugaccauccuccugaaggccacccugcucgccguguccgggguguacccgcugagcauccccgccacccuguucgucugguacuucuggcagaagaagaagcagcgcuccggcgugcucugggacacgcccagcccgcccgagguggagcgggccguccuggacgacggcaucuaccgcaucaugcagcgggggcugcugggccgcucccaggugggggugggcgucuuccaggagaacguguuccacaccauguggcacgugacccgcggggcgguccucauguaccagggcaagcgccuggagcccagcugggccuccgugaagaaggaccugaucagcuacggcgggggcuggcggcuccgcggguccuggaacaccggcgaggaggugcaggucaucgccguggagcccgggaagaaccccaagaacgugcagacggcccccggcaccuucaagacccccgagggcgaggucggggccaucgcgcuggacuucaagcccggcaccagcgggucccccaucgugaaccgggagggcaagaucgugggccuguacgggaacggcgucgugacgaccagcgggaccuacgugagcgccaucgcccaggccaaggcgucccaggagggcccgcuccccgagaucgaggacgaggucuuccgcaagcggaaccugaccaucauggaccugcaccccgggagcggcaagacgcgccgguaccucccggccaucgugcgcgaggccaucaagcgcaagcugcggacccugauccucgcccccacccgcguggucgccuccgagauggcggaggcccugaagggcaugcccauccgguaccagaccacggccgucaagagcgagcacaccgggaaggagaucguggaccugaugugccacgccaccuucaccaugcgccuccugucccccguccgggugccgaacuacaacaugaucaucauggacgaggcccacuucacggaccccagcuccaucgcggcccgcggcuacaucagcacccggguggggaugggcgaggccgccgccaucuucaugaccgcgacgccgcccggguccgucgaggccuucccgcagagcaacgccgugauccaggacgaggagcgcgacauccccgagcgguccuggaacagcggcuacgaguggaucacggacuuccccggcaagaccgugugguucguccccuccaucaagagcgggaacgacaucgccaacugccugcgcaagaacggcaagcgggugauccagcucucccgcaagaccuucgacaccgaguaccagaagacgaagaacaacgacugggacuacguggucaccaccgacaucagcgagaugggggcgaacuuccgggccgaccgcgugaucgacccgcggcgcugccugaagcccgugauccugaaggacggccccgagcgggucauccucgccgggcccaugccggugaccgucgccuccgccgcgcagcgccggggccgcaucggccgcaaccacaacaaggagggggaccaguacaucuacaugggccagccccugaacaacgacgaggaccacgcccacuggacggaggccaagaugcugcucgacaacaucaacacccccgaggggaucauccccgcccuguucgagccggagcgggagaaguccgccgcgguggacggcgaguaccgccugcgcggggaggcccgcaagaccuucguggagcucaugcggcgcggcgaccugcccgucuggcuguccuacaagguggccagcgagggcuuccaguacagcgaccggcgcuggugcuucgacggggagcggaacaaccaggugcucgaggagaacauggacgucgagaucuggaccaaggagggcgagcgcaagaagcugcggccccgcuggcuggacgcccggacguacuccgacccccucgcccugcgcgaguucaaggaguucgcggccgggcggcgcagcguguccggcgaccugauccucgagaucggcaagcugccgcagcaccugacccagcgggcccagaacgcccucgacaaccuggugaugcugcacaacagcgagcagggcgggcgcgcguaccggcacgccauggaggagcuccccgacaccaucgagacccugaugcugcucgcccugaucgccguccugaccggcggggugacccucuucuuccuguccgggcgcgggcugggcaagaccagcaucgggcuccugugcgugauggccuccagcguccugcucuggauggcguccguggagccccacuggaucgccgccagcaucauccuggaguucuuccugauggugcuccugauccccgagccggaccggcagcgcacgccccaggacaaccagcuggccuacgucgugaucggccuccuguucaugauccugaccguggccgcgaacgagauggggcuccuggagacgaccaagaaggaccugggcaucgggcacgucgccguggagaaccaccaccacgccgccaugcucgacguggaccugcaccccgccuccgcguggacccuguacgccgucgccaccacgaucaucaccccgaugaugcgccacaccaucgagaacaccacggccaacaucagccucaccgccaucgcgaaccaggccgccauccugaugggccuggacaagggcuggcccaucuccaagauggacaucggggugccccuccuggcccugggcugcuacagccaggugaacccccucacccugaccgcggccguccugaugcucguggcccacuacgccaucaucgggccgggccugcaggccaaggcgacgcgggaggcccagaagcgcaccgccgccgggaucaugaagaaccccaccguggacggcaucgucgccaucgaccuggaccccgugguguacgacgcgaaguucgagaagcagcucggccagaucaugcugcugauccucugcaccucccagauccugcugaugcggacgaccugggcccucugcgagagcaucacccuggccaccgggccccugacgacccucugggagggcuccccggggaaguucuggaacaccaccaucgccgucagcauggccaacaucuuccgcggcuccuaccuggcgggcgccgggcuggccuucagccucaugaagucccugggcgggggccggcgcgggacgggcgcccagggcgagacccugggggagaaguggaagcggcagcucaaccagcuguccaagagcgaguucaacaccuacaagcgcuccggcaucauggagguggaccggagcgaggcgaaggaggggcugaagcgcggcgagaccacgaagcacgccgugucccgggggaccgccaagcuccgcugguucgucgagcggaaccuggugaagcccgagggcaaggugaucgaccugggcugcgggcgcggcggguggagcuacuacugcgccggccugaagaaggucaccgaggugaagggguacaccaagggcggccccgggcacgaggagcccaucccgauggccacguacggcuggaaccucgugaagcugcacuccgggaaggacgucuucuucaucccgcccgagaagugcgacacccugcucugcgacaucggcgagagcucccccaacccgaccaucgaggaggggcggacccugcgcgugcugaagaugguggagcccuggcuccggggcaaccaguucugcaucaagauccugaaccccuacaugcccagcgucguggagacgcuggagcagaugcagcgcaagcacggcgggaugcucgugcggaacccgcugucccgcaacagcacccacgagauguacugggucuccugcggcaccgggaacaucgugagcgcggugaacaugaccucccgcaugcugcucaaccgguucaccauggcccaccgcaagcccacguacgagcgggacgucgaccugggcaccggcacccgccacguggccguggagcccgaggucgccaaccuggacaucaucgggcagcggaucgagaacaucaagcacgagcacaagagcaccuggcacuacgacgaggacaaccccuacaagacgugggccuaccacggcuccuacgaggugaagccgagcggguccgcgagcagcauggucaacggcguggugaagcuccugaccaagcccugggacgucauccccauggugacccagaucgccaugaccgacacgacccccuucgggcagcagcgcguguucaaggagaaggucgacacccggaccccgaaggccaagcgcggcacggcccagaucauggaggugaccgcccgguggcuguggggcuuccucucccgcaacaagaagccccggaucugcacccgcgaggaguucacccggaaggugcgcagcaacgcggccaucggggccgucuucguggacgagaaccaguggaacuccgccaaggaggcgguggaggacgagcgguucugggaccugguccaccgcgagcgggagcugcacaagcagggcaagugcgccacgugcguguacaacaugauggggaagcgcgagaagaagcucggcgaguucgggaaggccaagggcagccgggccaucugguacauguggcugggcgcccgcuuccuggaguucgaggcgcucggguucaugaacgaggaccacugguucucccgggagaacagccuguccggcguggagggggagggccugcacaagcucggguacauccugcgcgacaucagcaagauccccggcggcaacauguacgccgacgacaccgccgggugggacacccgcaucaccgaggacgaccugcagaacgaggccaagaucacggacaucauggagccggagcacgcccuccuggcgaaggccaucuucaagcugaccuaccagaacaaggucgugcgggugcagcgccccgccaagaacggcaccgucauggacgugaucucccggcgcgaccagcgggggagcggccaggugggcaccuacgggcucaacacguucaccaacauggaggcccagcugauccgccagauggaguccgaggagaucuucagccccuccgagcuggagacccccaaccucgccgagcgggcgcuggacuggcuggagaaguacggcgucgagcgccucaagcggauggccaucagcggggacgacugcguggugaagccgaucgacgaccgcuucgccaccgcccugacggcccugaacgacaugggcaagguccggaaggacaucccccagugggagcccuccaagggguggaacgacuggcagcagguccccuucugcagccaccacuuccaccagcucaucaugaaggacggccgcgagaucguggucccgugccggaaccaggacgagcuggugggccgcgcgcgggugucccagggggccggcuggagccugcgcgagaccgccugccucggcaagagcuacgcccagauguggcagcugauguacuuccaccggcgcgaccugcggcucgcggacaaggccaucggcuccgccguccccguggacugggugcccaccagccgcaccacgugguccauccacgcccaccaccaguggaugaccaccgaggacaugcugagcgucuggaaccgcguguggaucgaggagaaccccuggauggaggacaagacccacaucuccagcugggaggacgugccguaccuggggaagcgggaggaccaguggugcggcucccucaucggccugacggcccgcgcgaccugggccaccaacauccaggucgccaucaaccaggugcggcgccugaucgggaacgagaacuaccucgacuacaugaccagcaugaagcgguucaagaacgaguccgaccccgagggcgcccugugguga

SEQ ID NO: 8540 - RNA, 9879 nt, Artificial Sequence
  derived and/or modified CDS sequence (opt1) from DENV-1__GQ199829__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacacgaugaccuacaagugcccccggaucaccgagaccgagcccgacgacguggacugcuggugcaacgccacggacaccugggugaccuacgggaccugcagccagacgggcgagcaccggcgcgacaagcgguccguggcccucgcgccccacgugggccuggggcuggagacccggaccgagaccuggaugagcuccgagggcgcguggaagcagauccagcgggucgagacgugggcccuccgccaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacgcugguggaccggggcugggggaacggcugcgggcuguucggcaaggggucccugaucacgugcgccaaguucaagugcgugaccaagcuggagggcaagaucguccaguacgagaaccucaaguacagcgugaucgugaccguccacacgggcgaccagcaccagguggggaacgaguccaccgagcacggcaccaccgccaccaucacgccccaggcgcccaccaccgagauccagcugaccgacuacggggcccugacgcucgacugcagcccccgcaccggccuggacuucaacgagaugguccugcucaccaugaaggagaaguccuggcuggugcacaagcagugguuccuggaccucccccugcccuggaccagcggggccagcacgucccaggagaccuggaaccggcaggaccugcucgugaccuucaagaccgcccacgccaagaagcaggaggucguggugcugggcagccaggagggcgcgaugcacacggcccugaccggggccaccgagauccagaccuccggcacgaccaccaucuucgccgggcaccucaagugccgccugaagauggacaagcugacccucaagggcaugagcuacgucaugugcacgggguccuucaagcuggagaaggagguggccgagacccagcacggcaccgugcugguccagaucaaguacgagggcaccgacgcgcccugcaagauccccuucagcacgcaggacgagaagggggugacccagaacggccggcugaucaccgccaacccgaucgugaccgacaaggagaagcccgucaacaucgaggccgagccgcccuucggggaguccuacaucgugaucggcgccggcgagaaggcgcucaagcugagcugguucaagaagggguccagcaucggcaagauguucgaggccacggcccgcggggcccggcgcauggccauccugggcgacaccgcgugggacuucggguccaucggcggcguguucaccagcgucgggaagcucgugcaccagaucuucggcaccgccuacggggugcuguucuccggcgucagcuggacgaugaagaucgggaucggcgugcugcucaccuggcugggccugaacucccgcagcaccucccucagcaugaccugcaucgccguggggcuggucacgcuguaccucggcgugauggugcaggccgacuccgggugcgucaucaacuggaagggccgggagcugaagugcgggagcggcaucuucgugaccaacgaggugcacaccuggaccgagcaguacaaguuccaggccgacagcccgaagcgccuguccgcggccaucggcaaggccugggaggagggggucugcggcauccggagcgccacccgccucgagaacaucauguggaagcagaucuccaacgagcugaaccacauccugcucgagaacgacaugaaguucacggugguggucggggacguggccggcauccuggcgcaggggaagaagaugauccggccccagcccauggaguacaaguacagcuggaaguccuggggcaaggccaagaucaucggcgccgacgugcagaacaccaccuucaucaucgacgggcccaacaccccggagugccccgacgaccagcgcgccuggaacaucugggaggucgaggacuacggcuucgggaucuucacgaccaacaucuggcugaagcuccgggacagcuacacccaggugugcgaccaccgccugauguccgcggccaucaaggacagcaaggccgugcacgccgacaugggcuacuggaucgaguccgagaagaacgagaccuggaagcuggcccgggcgagcuucaucgaggucaagacgugcaucuggccccgcucccacacccucuggagcaacggcgugcuggaguccgagaugaucauccccaagaucuacgggggcccgaucagccagcacaacuaccggcccggguacuucacccaggccgccggccccuggcaccuggggaagcucgagcuggacuucgaccugugcgagggcaccacgguggucguggacgagcacugcggcaaccgcgggccgucccuccggaccaccaccgugacgggcaagaucauccacgaguggugcugccgcagcugcacccugccgccccugcgguuccgcggggaggacggcugcugguacgggauggagauccggcccgucaaggagaaggaggagaaccucgugaaguccauggugagcgccggcagcggcgaggucgacuccuucagccuggggcugcucugcaucuccaucaugaucgaggaggugaugcgcagccgguggucccgccgcaugcugaugaccggcacccuggccguguucuuccuccugaucauggggcagcugacguggaacgaccucauccggcugugcaucauggucggcgcgaacgccagcgaccgcauggggaugggcaccaccuaccuggcccucauggccaccuucaagaugcggccgauguucgccgugggccugcuguuccgccggcucacgucccgcgaggugcugcugcucaccaucgggcugagccuggucgcguccguggagcuccccaacagccuggaggagcugggcgacgggcucgccaugggcaucaugauccugaagcugcucaccgacuuccagucccaccagcugugggccacccugcucagccugacguucaucaagaccaccuucucccugcacuacgccuggaagaccauggcgaugguccucagcaucgugucccuguucccccugugccucagcacgaccucccagaagaccaccuggcugcccgugcugcucggcagccuggggugcaagccgcugacgauguuccucaucgccgagaacaagaucuggggccggcgcuccuggccccugaacgaggggaucauggccgucggcaucgugagcauccugcucagcucccugcugaagaacgacgugccccucgccgggccccugaucgccggcggcaugcugaucgcgugcuacgucaucagcggguccagcgccgaccucucccuggagaaggccgccgaggugagcugggaggaggaggccgagcacuccggcgcgagccacaacauccugguggagguccaggacgacgggaccaugaagaucaaggacgaggagcgggacgacacccucaccauccugcugaaggccacccuccuggccguguccggcguguacccgcugagcauccccgccacccucuucgucugguacuucuggcagaagaagaagcagcgcuccggggugcugugggacacccccagcccgcccgagguggagcgggccguccuggacgacggcaucuaccgcaucaugcagcggggccugcucgggcgcucccaggugggcgugggggucuuccaggagaacguguuccacaccauguggcacgugacccggggcgcgguccugauguaccaggggaagcgccuggagcccagcugggccuccgugaagaaggaccucaucagcuacggcggcggguggcggcugcagggcuccuggaacacgggggaggaggugcaggucaucgccguggagcccggcaagaaccccaagaacgugcagaccgcccccgggaccuucaagacccccgagggcgaggucggcgccaucgcgcuggacuucaagcccgggacgagcggcucccccaucgugaaccgcgaggggaagaucgugggccucuacggcaacggggucgugaccaccagcggcaccuacgugagcgccaucgcccaggccaaggcgucccaggaggggccgcugcccgagaucgaggacgaggucuuccggaagcgcaaccugacgaucauggaccuccaccccggcagcgggaagacccggcgcuaccugccggccaucgugcgcgaggccaucaagcggaagcugcgcacccucauccuggcccccacccggguggucgccuccgagauggcggaggcccugaagggcaugcccauccgcuaccagacgaccgccgucaagagcgagcacaccggcaaggagaucguggaccucaugugccacgccaccuucacgaugcggcugcugucccccguccgcgugccgaacuacaacaugaucaucauggacgaggcccacuucaccgaccccagcuccaucgcggcccggggguacaucagcacccgcgugggcaugggggaggccgccgccaucuucaugaccgcgacgccgcccggcuccgucgaggccuucccgcagagcaacgccgugauccaggacgaggagcgggacauccccgagcgcuccuggaacagcggguacgaguggaucaccgacuuccccggcaagaccgugugguucguccccuccaucaagagcggcaacgacaucgccaacugccuccggaagaacgggaagcgcgugauccagcugucccggaagaccuucgacacggaguaccagaagaccaagaacaacgacugggacuacguggucaccaccgacaucagcgagaugggcgcgaacuuccgcgccgaccgggugaucgacccgcgccggugccugaagcccgugauccucaaggacgggcccgagcgcgucauccuggccggccccaugccggugacggucgccuccgccgcgcagcggcgcgggcgcaucggccggaaccacaacaaggagggcgaccaguacaucuacauggggcagccccugaacaacgacgaggaccacgcccacuggaccgaggccaagaugcuccuggacaacaucaacacccccgagggcaucauccccgcccuguucgagccggagcgcgagaaguccgccgcgaucgacggggaguaccggcuccgcggcgaggcccggaagaccuucguggagcugaugcgccgcggggaccugcccguguggcucuccuacaaggucgccagcgagggcuuccaguacagcgaccgccgguggugcuucgacggcgagcgcaacaaccaggugcuggaggagaacauggacguggagaucuggacgaaggagggggagcggaagaagcugcgcccccgguggcucgacgcccgcaccuacuccgacccccuggcccugcgggaguucaaggaguucgcggccggccgccggagcgucuccggggaccucauccuggagaucggcaagcugccgcagcaccucacccagcgcgcccagaacgcccuggacaaccuggugaugcuccacaacagcgagcagggcgggcgggcguaccgccacgccauggaggagcugcccgacaccaucgagacgcugaugcuccuggcccugaucgccgugcucaccggcggggucacccuguucuuccuguccggccgggggcucggcaagaccagcaucggccugcugugcgugauggccuccagcgugcuccuguggauggcguccgucgagccccacuggaucgccgccagcaucauccuggaguucuuccucauggugcugcugauccccgagccggaccgccagcgcacgccccaggacaaccagcucgccuacguggucaucgggcugcuguucaugauccucacgguggccgcgaacgagaugggccugcuggagaccaccaagaaggaccucgggaucggccacguggccgucgagaaccaccaccacgccgccaugcuggacguggaccugcaccccgccuccgcguggacccucuacgccguggccacgaccaucaucaccccgaugaugcggcacaccaucgagaacacgaccgccaacaucagccugaccgccaucgcgaaccaggccgccauccugauggggcucgacaagggcuggcccaucuccaagauggacaucggcgucccccugcuggcccucgggugcuacagccaggugaacccccugacccugacggcggccgugcucaugcuggucgcccacuacgccaucaucggcccggggcugcaggccaaggcgacccgcgaggcccagaagcggaccgccgccggcaucaugaagaaccccaccguggacgggaucguggccaucgaccucgaccccgucguguacgacgcgaaguucgagaagcagcugggccagaucaugcugcucauccugugcacgucccagauccugcucaugcgcaccaccugggcccugugcgagagcaucacccuggccacgggcccccucaccacccugugggagggguccccgggcaaguucuggaacaccacgaucgccgugagcauggccaacaucuuccggggguccuaccuggcgggcgccggccucgccuucagccugaugaagucccucgggggcgggcgccgggggaccggggcccagggcgagacccucggcgagaaguggaagcgccagcugaaccagcuguccaagagcgaguucaacaccuacaagcgguccgggaucauggaggucgaccgcagcgaggcgaaggagggccucaagcgcggggagacgaccaagcacgccgugucccgcggcaccgccaagcugcggugguucguggagcgcaaccuggucaagcccgaggggaaggugaucgaccugggcugcggccgcggcggguggagcuacuacugcgccgggcucaagaaggugaccgaggucaagggguacacgaagggcggccccggccacgaggagcccaucccgauggccaccuacggguggaaccuggugaagcugcacuccggcaaggacguguucuucaucccgcccgagaagugcgacacccuccugugcgacaucggggagagcucccccaacccgaccaucgaggagggccgcacgcugcggguccucaagaugguggagcccuggcugcgcgggaaccaguucugcaucaagauccugaaccccuacaugcccagcguggucgagacccucgagcagaugcagcggaagcacggcggcaugcuggugcgcaacccgcugucccgcaacagcacccacgagauguacuggguguccugcgggaccggcaacaucgucagcgcggugaacaugaccucccggaugcuccugaaccgcuucacgauggcccaccggaagcccaccuacgagcgcgacguggaccugggggccggcacccggcacgucgccguggagcccgagguggccaaccucgacaucaucggccagcgcaucgagaacaucaagcacgagcacaagagcaccuggcacuacgacgaggacaaccccuacaagacgugggcguaccacggguccuacgaggucaagccgagcggcuccgccagcagcauggugaacggggucgugaagcugcugaccaagcccugggacgugauccccauggucacccagaucgccaugaccgacacgacccccuucggccagcagcggguguucaaggagaagguggacacccgcaccccgaaggccaagcgggggacggcccagaucauggaggucaccgcgaaguggcucuggggcuuccugucccgcaacaagaagccccggaucugcacccgcgaggaguucacccggaaggugcgcagcaacgccgccaucggcgccguguucgucgacgagaaccaguggaacuccgcgaaggaggccguggaggacgagcgguucugggaccuggugcaccgcgagcgggagcuccacaagcaggggaagugcgccacgugcgucuacaacaugaugggcaagcgcgagaagaagcugggggaguucggcaaggccaaggggagccgggccaucugguacauguggcugggcgcgcgcuuccucgaguucgaggcccugggcuucaugaacgaggaccacugguucucccgggagaacagccuguccgggguggagggcgaggggcuccacaagcugggcuacauccugcgcgacaucagcaagauccccgggggcaacauguacgccgacgacaccgccggcugggacacccgcaucaccgaggacgaccuccagaacgaggcccggaucacggacaucauggagccggagcacgcgcugcuggccaaguccaucuucaagcucaccuaccagaacaaggugguccgcgugcagcggcccgccaagaacgggaccgugauggacgucaucagccgccgggaccagcgcggcuccggccaggugggcaccuacggccugaacacguucaccaacauggaggcccagcugauccggcagauggagagcgaggggaucuucucccccagcgagcucgagacccccaaccuggccgagcgcgugcuggacuggcucgagaaguacggcgucgagcggcugaagcgcauggcgaucuccggggacgacugcguggugaagccgaucgacgaccgguucgccaccgcccugacggcccucaacgacaugggcaagguccgcaaggacaucccccagugggagcccagcaagggguggaacgacuggcagcagguccccuucugcucccaccacuuccaccagcugaucaugaaggacggccgggagaucguggucccgugccgcaaccaggacgagcuggugggccgggcccgcgugagccagggggcgggcuggagccuccgggagaccgccugccuggggaaguccuacgcccagauguggcagcugauguacuuccaccgccgggaccuccgccuggccgcgaacgccaucugcagcgccguccccguggacuggauccccaccucccgcaccacguggagcauccacgcccaccaccaguggaugaccaccgaggacaugcuguccguguggaaccgggucuggaucgaggagaaccccuggauggaggacaagacccacaucagcuccuggggcgacgugccguaccucgggaagcgcgaggaccaguggugcggcagccugaucggccugacggcccgggcgaccugggccaccaacauccagguggccaucaaccagguccgccggcucaucgggaacgagaacuaccuggacuacaugaccuccaugaagcgcuucaagaacgagagcgaccccgagggcgcccugugguga

SEQ ID NO: 8541 - RNA, 9879 nt, Artificial Sequence
  derived and/or modified CDS sequence (opt1) from DENV-1__FJ882562__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacacgaugaccuacaagugcccccgcaucaccgaggccgagcccgacgacguggacugcuggugcaacgccaccgacacgugggugaccuacgggaccugcagccagaccggcgagcaccggcgcgacaagcgguccguggcccucgcgccccacgugggccuggggcuggagacgcgcaccgagaccuggaugagcuccgagggcgccuggaagcagauccagcgggucgagaccugggcccuccgccaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcggugcugcggaagcucugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacaccggcgaccagcaccagguggggaacgaguccacggagcacggcaccaccgcgaccaucacgccccaggcccccacgaccgagauccagcucaccgacuacggggcccugacccuggacugcagcccccgcacgggccucgacuucaacgagaugguccugcugaccaugaaggagaaguccuggcucgugcacaagcagugguuccuggaccugccccuccccuggaccagcggggccagcaccucccaggagacguggaaccggcaggaccugcuggugaccuucaagaccgcccacgcgaagaagcaggaggucguggugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgucaugugcaccggguccuucaagcucgagaaggagguggcggagacgcagcacggcaccgugcugguccagaucaaguacgagggcaccgacgcccccugcaagauccccuucagcacccaggacgagaagggggugacgcagaacggccggcugaucaccgccaacccgaucgugaccgacaaggagaagcccgucaacaucgaggccgagccgcccuucggggaguccuacaucgugaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggccuguucaccagcguggggaagcucguccaccagaucuucggcaccgccuacggggugcuguucuccggcgugagcuggaccaugaagaucgggaucggcguccugcucacguggcugggccugaacucccgcagcaccucccucagcaugaccugcaucgccguggggcuggugacccuguaccucggcgucauggugcaggccgacuccgggugcgugaucaacuggaagggccgggagcugaagugcgggagcggcaucuucgucacgaacgaggugcacaccuggaccgagcaguacaaguuccaggcggacagcccgaagcgccuguccgccgccaucggcaaggccugggaggagggggugugcggcauccggagcgccacccgccucgagaacaucauguggaagcagaucuccaacgagcugaaccacauccugcucgagaacgacaugaagcugaccgucguggugggggacgucgcgggcauccuggcccaggggaagaagaugauccggccccagcccauggaguacaaguacagcuggaaguccuggggcaaggccaagaucaucggcgccgacgcgcagaacacgaccuucaucaucgacgggcccaacaccccggagugccccgacgaccagcgcgccuggaacaucugggagguggaggacuacggcuucgggaucuucaccacgaacaucuggcucaagcugcgggacagcuacacccaggugugcgaccaccgccugauguccgccgccaucaaggacagcaaggccguccacgcggacaugggcuacuggaucgaguccgagaagaacgagaccuggaagcucgcccgggccagcuucaucgaggugaagaccugcaucuggcccaagucccacacgcuguggagcaacggcgugcuggaguccgagaugaucauccccaagaucuacgggggcccgaucagccagcacaacuaccgccccggguacuucacccagaccgccggccccuggcaccucgggaagcuggagcuggacuucgaccucugcgagggcaccacggucgugguggacgagcacugcggcaaccgggggccgucccugcgcaccaccaccgucacgggcaagaucauccacgaguggugcugccggagcugcacccugccgccccugcgcuuccgcggggaggacggcugcugguacgggauggagauccgccccgugaaggagaaggaggagaaccuggugaaguccauggucagcgccggcagcggcgagguggacuccuucagccuggggcuccugugcaucuccaucaugaucgaggaggugaugcggagccgcuggucccggaagaugcugaugaccggcacccucgcggucuucuuccugcugaucauggggcagcucacguggaacgaccugauccgccugugcaucauggugggcgccaacgccagcgaccgcauggggaugggcaccaccuaccucgcccugauggccaccuucaagaugcggccgauguucgcgguggggcuccuguuccgccggcugacgucccgcgagguccugcuccugaccaucgggcugagccucguggccuccguggagcugcccaacagccuggaggagcucggcgacgggcuggccaugggcaucaugauccugaagcuccugaccgacuuccagucccaccagcugugggccacccuccugagccugacguucaucaagaccaccuucucccuccacuacgcguggaagaccauggccaugguccugagcaucgugucccuguucccccucugccugagcacgaccucccagaagaccaccuggcugcccguccuccugggcagccuggggugcaagccgcucacgauguuccugaucgccgagaacaagaucuggggccggaaguccuggccccugaacgaggggaucauggccgugggcaucgugagcauccuccugagcucccugcucaagaacgacgucccccuggccgggccccugaucgcgggcggcaugcucaucgccugcuacgugaucagcggguccagcgccgaccugucccuggagaaggccgccgaggugagcugggaggaggaggcggagcacuccggcgccagccacaacauccucgucgaggugcaggacgacgggaccaugaagaucaaggacgaggagcgcgacgacacccugaccauccugcucaaggccacccugcuggccguguccggcgucuacccgcucagcauccccgccacgcuguucgugugguacuucuggcagaagaagaagcagcgguccggggugcugugggacacccccagcccgcccgaggucgagcgcgcggugcuggacgacggcaucuaccggaucaugcagcgcggccuccuggggcggucccaggugggcgucgggguguuccaggagaacguguuccacaccauguggcacgucacccgcggcgccgugcugauguaccaggggaagcggcucgagcccagcugggccuccgugaagaaggaccugaucagcuacggcggcggguggcgccugcagggcuccuggaacacgggggaggagguccaggugaucgccguggagcccggcaagaaccccaagaacguccagaccgcccccgggaccuucaagacccccgagggcgaggugggcgcgaucgcccucgacuucaagcccgggacgagcggcucccccaucgugaaccgggaggggaagaucgucggccuguacggcaacgggguggugaccaccagcggcaccuacgucagcgccaucgcccaggcgaaggccucccaggaggggccgcugcccgagaucgaggacgagguguuccgcaagcggaaccucacgaucauggaccugcaccccggcagcgggaagacccgccgguaccugccggccaucgugcgcgaggccaucaagcggaagcuccgcacccugauccuggcccccacccgcgucguggcguccgagauggccgaggcccucaagggcaugcccauccgguaccagacgaccgccgucaagagcgagcacaccggcaaggagaucgucgaccugaugugccacgccaccuucacgaugcgccugcucucccccgugcgggugccgaacuacaacaugaucaucauggacgaggcgcacuucaccgaccccagcuccaucgccgcccgcggguacaucagcacccgggucggcaugggggaggccgccgcgaucuucaugaccgccacgccgcccggcuccguggaggccuucccgcagagcaacgccgugauccaggacgaggagcgcgacauccccgagcgguccuggaacagcggguacgaguggaucaccgacuuccccggcaagaccgucugguucgugcccuccaucaagagcggcaacgacaucgcgaacugccugcgcaagaacgggaagcgggugauccagcugucccgcaagaccuucgacacggaguaccagaagaccaagaacaacgacugggacuacgucgugaccaccgacaucagcgagaugggcgccaacuuccgggccgaccgcgugaucgacccgcggcgcugccucaagcccgucauccugaaggacgggcccgagcgggugauccuggccggccccaugccggugacggucgccuccgcggcccagcgccgggggcgcaucggccggaaccacaacaaggagggcgaccaguacaucuacauggggcagccccucaacaacgacgaggaccacgcccacuggaccgaggccaagaugcugcuggacaacaucaacacccccgagggcaucauccccgcccucuucgagccggagcgcgagaaguccgcggccaucgacggggaguaccgccugcggggcgaggcccgcaagaccuucguggagcugaugcggcgcggggaccuccccgucuggcuguccuacaagguggccagcgagggcuuccaguacagcgaccggcgcuggugcuucgacggcgagcggaacaaccaggugcuggaggagaacauggacgucgagaucuggacgaaggagggggagcgcaagaagcuccggccccgcuggcuggacgcccggaccuacuccgacccccuggcgcuccgcgaguucaaggaguucgccgccggccggcgcagcguguccggggaccugauccuggagaucggcaagcucccgcagcaccugacccagcgggcccagaacgcgcuggacaaccucgugaugcugcacaacagcgagcagggcgggcgcgccuaccggcacgccauggaggagcugcccgacaccaucgagacgcucaugcugcuggcccucaucgccguccugaccggcggggugacccuguucuuccucuccggccgcgggcugggcaagaccagcaucggccugcucugcgugaugaccuccagcguccugcuguggauggcguccguggagccccacuggaucgccgccagcaucauccucgaguucuuccugauggugcugcucauccccgagccggaccggcagcgcacgccccaggacaaccagcuggccuacgucgugaucgggcuccucuucaugauccugaccguggccgcgaacgagaugggccugcucgagaccaccaagaaggaccuggggaucggccacgucgccguggagaaccaccaccacgccgccaugcuggacguggaccuccaccccgccuccgcguggacgcuguacgccgucgccaccaccaucaucaccccgaugaugcggcacacgaucgagaacaccaccgccaacaucagccugaccgccaucgcgaaccaggccgccauccucauggggcuggacaagggcuggcccaucuccaagauggacaucggcgugccccugcucgcccuggggugcuacagccaggugaacccccugacgcucaccgcggccguccugaugcugguggcccacuacgccaucaucggcccggggcuccaggccaaggcgacccgcgaggcccagaagcgcaccgccgccggcaucaugaagaaccccacgguggacgggaucgucgccaucgaccuggaccccgugguguacgacgcgaaguucgagaagcagcugggccagaucaugcuccugauccugugcaccucccagauccuccugaugcggaccaccugggcccugugcgagagcaucacgcucgccaccggcccccugaccacccugugggagggguccccgggcaaguucuggaacacgaccaucgccgucagcauggccaacaucuuccgcggguccuaccucgcgggcgccggccuggccuucagccugaugaagucccucgggggcgggcggcgcggcaccggggcccagggcgagacccugggcgagaaguggaagcggcagcugaaccagcucuccaagagcgaguucaacacguacaagcgcuccgggaucauggagguggaccggagcgaggcgaaggagggccugaagcgcggggagaccaccaagcacgccgugucccggggcaccgccaagcugcgcugguucgucgagcggaaccuggugaagcccgaggggaaggugaucgaccucggcugcggccgcgggggcuggagcuacuacugcgccgggcugaagaaggucacggaggugaagggcuacaccaagggcgggcccggccacgaggagcccaucccgauggccaccuacggguggaaccuggugaagcuccacuccggcaaggacgucuucuucaucccgcccgagaagugcgacacccugcugugcgacaucggggagagcucccccaacccgacgaucgaggagggccggacccuccgcgugcugaagaugguggagcccuggcugcgggggaaccaguucugcaucaagauccucaaccccuacaugcccagcgucguggagacccuggagcagaugcagcgcaagcacggcggcaugcuggugcggaacccgcucucccgcaacagcacccacgagauguacugggucuccugcgggaccggcaacaucgugagcgcggugaacaugacgucccggaugcugcugaaccgcuucaccauggcccaccgcaagcccaccuacgagcgggacgucgaccucgggaccggcacgcgccacguggccguggagcccgaggucgccaaccuggacaucaucggccagcggaucgagaacaucaagcacgagcacaagagcaccuggcacuacgacgaggacaaccccuacaagaccugggccuaccacggguccuacgaggugaagccgagcggcuccgcgagcagcauggugaacggggucgugaagcugcucaccaagcccugggacgucauccccauggugacgcagaucgccaugaccgacaccacccccuucggccagcagcgcguguucaaggagaaggucgacacgcggaccccgaaggccaagcgcgggaccgcccagaucauggaggugaccgcccgguggcuguggggcuuccugucccgcaacaagaagccccggaucugcacgcgcgaggaguucacccggaaggugcgcagcaacgcggccaucggcgccgucuucguggacgagaaccaguggaacuccgccaaggaggcgguggaggacgagcgguucugggaccucguccaccgcgagcgggagcugcacaagcaggggaagugcgcgaccugcguguacaacaugaugggcaagcgcgagaagaagcugggggaguucggcaaggccaaggggagccgggccaucugguacauguggcucggcgcccgcuuccuggaguucgaggcgcugggcuucaugaacgaggaccacugguucucccgggagaacagccucuccgggguggagggcgaggggcugcacaagcugggcuacauccuccgcgacaucagcaagauccccgggggcaacauguacgccgacgacaccgccggcugggacacgcggaucaccgaggacgaccugcagaacgaggccaagaucaccgacaucauggagccggagcacgcccugcucgcgaaggccaucuucaagcugaccuaccagaacaaggucgugcgcgugcagcgccccgccaagaacgggacggucauggacgugaucucccggcgcgaccagcggggcagcggccagguggggaccuacggccugaacaccuucaccaacauggaggcccagcucauccgccagauggaguccgaggggaucuucagccccuccgagcuggagacgcccaaccuggccgagcgggcgcucgacuggcuggagaaguacggcgucgagcgccugaagcggauggccaucagcggggacgacugcguggugaagccgaucgacgaccgcuucgccaccgcccucaccgcccugaacgacaugggcaagguccggaaggacaucccccagugggagcccuccaagggguggaacgacuggcagcagguccccuucugcagccaccacuuccaccagcugaucaugaaggacggccgcgagaucguggucccgugccggaaccaggacgagcucgugggccgcgcgcgggugucccagggggccggcuggagccugcgcgagaccgccugccugggcaagagcuacgcccagauguggcagcucauguacuuccaccggcgcgaccugcggcuggcggccaacgccaucugcuccgccguccccguggacugggugcccacgagccgcaccaccugguccauccacgcccaccaccaguggaugaccacggaggacaugcucagcgucuggaaccggguguggaucgaggagaaccccuggauggaggacaagacccacaucuccagcugggaggacgugccguaccugggcaagcgcgaggaccaguggugcgggucccugaucggccucaccgcgcgcgccaccugggccaccaacauccaggucgccaucaaccaggugcggcgccugaucggcaacgagaacuaccuggacuacaugacgagcaugaagcgguucaagaacgaguccgaccccgagggggcccucugguga

SEQ ID NO: 8542 - RNA, 9879 nt, Artificial Sequence
  derived and/or modified CDS sequence (opt1) from DENV-1__FJ882564__SS-prME
agcgugaccaugcugcucaugcugaugcccaccgcccuggccuuccaccucaccacccggggcggggagccccacaugaucgugaccaagcaggagcggggcaagagccugcuguucaagaccagcgcgggggugaacaugugcacccucaucgccauggaccugggcgagcugugcgaggacaccaugaccuacaagugcccccgcaucaccgaggccgagcccgacgacguggacugcuggugcaacgccaccgacaccugggugaccuacgggaccugcagccagacgggcgagcaccggcgcgacaagcggagcguggcccucgcgccccacgugggccuggggcuggagacccgcaccgagaccuggauguccagcgagggcgccuggaagcagauccagcgggucgagacgugggcccuccgccaccccggguucaccgugaucgcccuguuccuggcgcacgccaucggcaccuccaucacccagaaggggaucaucuucauccuccugaugcuggugacgcccagcauggccaugcggugcgucggcaucggcucccgcgacuucguggaggggcucagcggcgccaccuggguggacgucgugcuggagcacggguccugcgugaccaccauggccaaggacaagcccacgcuggacaucgagcuccugaagaccgaggucaccaaccccgcggugcugcggaagcucugcaucgaggccaagaucagcaacaccacgaccgacucccgcugccccacccagggcgaggccacccugauggaggagcaggacgccaacuucgugugccggcgcacguucgucgaccggggcugggggaacggcugcgggcuguucggcaaggggagccucaucacgugcgccaaguucaagugcgugaccaagcuggagggcaagaucgugcaguacgagaaccugaaguacuccgucaucgugaccgugcacacgggcgaccagcaccaggucgggaacgagagcaccgagcacggcaccaccgcgaccaucacgccccaggcccccaccuccgagauccagcucaccgacuacggggcccugacccuggacugcagcccccgcacgggccucgacuucaacgagauggugcugcugaccaugaaggagaaguccuggcucguccacaagcagugguuccuggaccugccgcuccccuggaccagcggggccagcaccucccaggagacguggaaccggcaggaccugcuggugaccuucaagaccgcccacgcgaagaagcaggagguggucgugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgugaugugcaccggguccuucaagcucgagaaggaggucgcggagacgcagcacggcaccgugcuggugcagaucaaguacgagggcaccgacgcccccugcaagauccccuucagcacccaggacgagaagggggucacgcagaacggccggcugaucaccgccaacccgaucgugaccgacaaggagaagcccgugaacaucgaggccgagccgcccuucggggaguccuacaucgucaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcguggggaagcugguccaccagaucuucggcaccgccuacgggguccuguucuccggcgugagcuggaccaugaagaucgggaucggcguccugcugacguggcucggccugaacucccgcagcaccucccugagcaugaccugcaucgccguggggcucgugacccuguaccugggcgucauggugcaggccgacuccgggugcgugaucaacuggaagggccgggagcucaagugcgggagcggcaucuucgucacgaacgaggugcacaccuggaccgagcaguacaaguuccaggcggacagcccgaagcgccuguccgccgccaucggcaaggccugggaggagggggugugcggcauccggagcgccacccgccuggagaacaucauguggaagcagaucuccaacgagcucaaccacauccugcuggagaacgggaugaaguucaccgucguggugggcgacgucguggggauccucgcgcagggcaagaagaugauccggccccagcccauggagcacaaguacagcuggaaguccuggggcaaggccaagaucaucggggccgacgugcagaacacgaccuucaucaucgacggccccaacaccccggagugccccgacgaccagcgcgccuggaacaucugggaggucgaggacuacggguucggcaucuucaccacgaacaucuggcugaagcugcgggacagcuacacccaggugugcgaccaccgccucauguccgcggccaucaaggacagcaaggccgugcacgccgacaugggcuacuggaucgaguccgagaagaacgagaccuggaagcuggcccgggcgagcuucaucgaggucaagaccugcaucuggcccaagucccacacgcuguggagcaacggggugcucgaguccgagaugaucauccccaagaucuacggcgggccgaucagccagcacaacuaccgccccggcuacuucacccagaccgccgggcccuggcaccugggcaagcuggagcucgacuucgaccugugcgagggcaccacgguggucguggacgagcacugcgggaaccggggcccgucccugcgcaccaccaccgugacggggaagaucauccacgaguggugcugccggagcugcacccugccgccccuccgcuucaagggcgaggacgggugcugguacggcauggagauccggcccgucaaggagaaggaggagaaccuggugaaguccauggugagcgccggcagcggggaggucgacuccuucagccucggccugcugugcaccuccaucaugaucgaggaggugaugcgcagccgguggucccgcaagaugcucaugaccgggacgcuggccguguuccugcuccugaucaugggccagcugaccuggaacgaccucauccggcugugcaucauggucggggccaacgcgagcgaccgcaugggcaugggcaccaccuaccuggcccucauggccacguucaagaugcgcccgaugguggccguggggcugcuguuccggcgccucaccucccgggagguccugcugcucaccaucgggcugagccugguggccuccgucgagcuccccaacagccuggaggagcugggggacggccucgcgaugggcaucaugauccugaagcugcucaccgacuuccagucccaccagcugugggccacgcugcucagccugaccuucaucaagaccacccugucccuccacuacgccuggaagacgauggccauggugcugagcaucgugucccuguucccccucugccugagcaccaccucccagaagaccacguggcugcccguccuccuggggagccugggcugcaagccgcucaccauguuccugaucgcggagaacaagaucugggggcgcaaguccuggccccugaacgagggcaucauggccguggggguggucagcauccuccugagcucccugcucaagaacgacgugccccuggccggcccccugaucgccggcgggaugcucaucgccugcuacgugaucagcggcuccagcgcggaccugucccuggagaaggccgccgaggucagcugggaggaggaggccgagcacuccggggccagccacaacauccucguggaggugcaggacgacggcaccaugaagaucaaggacgaggagcgggacgacacccugaccauccugcucaaggcgacgcugcuggccgucuccgggguguacccgcucagcauccccgccacccuguucgugugguacuucuggcagaagaagaagcagcgcuccggcguccugugggacacccccagcccgcccgagguggagcgggccgugcuggacgacggcaucuaccgcaucaugcagcgggggcuccugggccgcucccaggucggggugggcguguuccaggagaacgucuuccacaccauguggcacgugacgcgcggggccgugcugauguaccagggcaagcgccucgagcccagcugggcguccgucaagaaggaccugaucagcuacggcgggggcuggcggcugcagggguccuggaacaccggcgaggagguccaggugaucgccgucgagcccgggaagaaccccaagaacgugcagaccgcccccggcaccuucaagacgcccgagggcgaggugggggccaucgcccucgacuucaagcccggcaccagcgggucccccaucgucaaccgcgagggcaagaucgugggccuguacgggaacggcguggucaccaccagcgggacguacgugagcgcgaucgcccaggccaaggccucccaggagggcccgcugcccgagaucgaggacgagguguuccggaagcgcaaccucaccaucauggaccugcaccccgggagcggcaagacccggcgcuaccugccggcgaucguccgggaggccaucaagcgcaagcuccggacccugauccuggcccccacgcgcgugguggccuccgagauggccgaggcgcucaagggcaugcccauccgcuaccagaccaccgccgucaagagcgagcacaccgggaaggagaucguggaccugaugugccacgccacguucaccaugcggcugcucucccccgugcgcgucccgaacuacaacaugaucaucauggacgaggcccacuucaccgaccccagcuccaucgccgcgcggggcuacaucagcacccgcguggggaugggcgaggccgccgccaucuucaugacggccacgccgcccggguccguggaggcguucccgcagagcaacgccgucauccaggacgaggagcgggacauccccgagcgcuccuggaacagcggcuacgaguggaucaccgacuuccccggcaagaccgugugguucgugcccuccaucaagagcgggaacgacaucgccaacugccugcggaagaacggcaagcgcgucauccagcugucccggaagacguucgacaccgaguaccagaagaccaagaacaacgacugggacuacguggugaccacggacaucagcgagaugggggccaacuuccgcgcggaccgggucaucgacccgcgccggugccucaagcccgugauccugaaggacggccccgagcgcgucauccuggccgggcccaugccggugaccguggccuccgccgcccagcggcgcggccggaucggccgcaaccacaacaaggagggggaccaguacaucuacaugggccagccccucaacaacgacgaggaccacgcgcacuggaccgaggccaagaugcugcuggacaacaucaacacccccgaggggaucauccccgcccucuucgagccggagcgggagaaguccgccgccaucgacggcgaguaccgccugcgcggggaggcgcggaagacguucgucgagcugaugcgccggggcgaccuccccguguggcuguccuacaagguggccagcgagggcuuccaguacagcgaccgccgguggugcuucgacggggagcgcaacaaccagguccuggaggagaacauggacguggagaucuggaccaaggagggcgagcggaagaagcuccgcccccgguggcuggacgcccgcaccuacuccgacccccuggcccuccgggaguucaaggaguucgccgcggggcgccggagcguguccggcgaccugauccuggagaucggcaagcucccgcagcaccugacccagcgcgcccagaacgcccuggacaaccucgucaugcugcacaacagcgagcagggcgggcgggccuaccgccacgcgauggaggagcugcccgacacgaucgagacccucaugcugcuggcccucaucgccgugcugaccgggggcgugacccuguucuuccucuccgggcggggccugggcaagaccagcaucgggcugcucugcgucauggccuccagcgugcugcuguggauggccuccguggagccccacuggaucgcggccagcaucauccucgaguucuuccugaugguccugcucauccccgagccggaccgccagcggacgccccaggacaaccagcuggccuacguggugaucggccuccucuucaugauccugaccgucgccgccaacgagauggggcugcucgagaccaccaagaaggaccugggcaucgggcacguggcgguggagaaccaccaccacgccacgaugcuggacgucgaccuccaccccgccuccgccuggacccuguacgccguggcgaccaccaucaucacgccgaugaugcgccacaccaucgagaacaccaccgccaacaucagccugacggccaucgccaaccaggccgcgauccucaugggccuggacaagggcuggcccaucuccaagauggacaucggggugccccugcucgcccugggcugcuacagccaggucaacccccugacccucaccgccgccgugcugaugcugguggcgcacuacgccaucaucgggccgggccuccaggccaaggccacccgggaggcccagaagcgcacggcggccgggaucaugaagaaccccaccgucgacggcaucguggccaucgaccuggaccccguggucuacgacgccaaguucgagaagcagcugggccagaucaugcuccugauccugugcaccucccagauccuccugaugcgcaccacgugggcccugugcgagagcaucacccucgcgaccgggccccugaccacgcugugggagggcuccccggggaaguucuggaacaccaccaucgccgugagcauggccaacaucuuccggggcuccuaccucgccggcgccgggcuggcguucagccugaugaagucccucggcgggggccgccgggggaccggcgcccagggcgagacgcugggggagaaguggaagcgccagcugaaccagcucuccaagagcgaguucaacaucuacaagcgguccggcaucauggagguggaccgcagcgaggccaaggaggggcugaagcggggcgagaccacccgccacgccgucucccgggggaccgcgaagcugcgcugguucguggagcggaaccuggugaagcccgagggcaaggucaucgaccucggcugcgggcgcggcggguggagcuacuacugcgccggccugaagaaggugacggaggugaagggguacaccaagggcggccccgggcacgaggagcccaucccgauggccaccuacggcuggaaccuggucaagcuccacuccgggaaggacguguucuucacgccgcccgagaagugcgacacgcugcugugcgacaucggcgagagcucccccaacccgaccaucgaggaggggcggacccuccgcgugcugaagauggucgagcccuggcugcggggcaaccaguucugcaucaagauccucaaccccuacaugcccagcgugguggagacccuggagcagaugcagcgcaagcacggcgggaugcugguccggaacccgcucucccgcaacagcacccacgagauguacuggguguccugcggcacggggaacaucgugagcgccgucaacaugaccucccggaugcugcugaaccgcuucaccauggcccaccgcaagcccaccuacgagcgggacguggaccucggcgcgggcacgcgccacguggccgucgagcccgagguggccaaccuggacaucaucgggcagcggaucgagaacaucaagcacgagcacaagagcaccuggcacuacgacgaggacaaccccuacaagaccugggccuaccacggcuccuacgaggucaagccgagcggguccgccagcagcauggugaacggcguggucaagcugcucaccaagcccugggacgugauccccauggugacgcagaucgcgaugaccgacaccacccccuucgggcagcagcgcgucuucaaggagaagguggacacgcggaccccgaaggccaagcgcggcaccgcccagaucauggaggugaccgcccgguggcuguggggcuuccugucccgcaacaagaagccccggaucugcacgcgcgaggaguucacccggaagguccgcagcaacgccgcgaucggggccguguucguggacgagaaccaguggaacuccgccaaggaggccgucgaggacgagcgguucugggaccucgugcagaaggagcgcgagcugcacaagcagggcaagugcgcgaccugcguguacaacaugauggggaagcgggagaagaagcugggcgaguucgggaaggccaagggcagccgcgccaucugguacauguggcucggcgcccgguuccuggaguucgaggcccugggguucaugaacgaggaccacugguucucccgcgagaacagccucuccggcgucgagggggagggccugcacaagcugggguacauccuccgggacaucagcaagauccccggcggcaacauguacgcggacgacaccgccgggugggacacgcgcaucaccgaggacgaccugcagaacgaggccaagaucaccgacaucauggagccggagcacgcccugcucgccaccuccaucuucaagcugacguaccagaacaagguggugcggguccagcgccccgcgaagaacggcaccgugauggacgugaucagccgccgggaccagcgcggguccggccaggucggcaccuacgggcugaacaccuucacgaacauggaggcccagcucauccggcagauggagagcgagggcaucuuccugcccuccgagcuggagacccccaaccucgccgagcgcgugcuggacuggcuggagaaguacgggguggagcggcucaagcgcauggccaucagcggcgacgacugcgucgugaagccgaucgacgaccgguucgccaccgcgcugaccgcccugaacgacauggggaaggugcgcaaggacaucccccagugggagcccuccaagggcuggaacgacuggcagcagguccccuucugcagccaccacuuccaccagcucaucaugaaggacggccgggagaucguggugccgugccgcaaccaggacgagcuggucgggcgggcccgcgugucccagggcgccggguggagccugcgggagacggccugccucggcaagagcuacgcgcagauguggcagcugauguacuuccaccgccgggaccugcgccucgccgccaacgccaucugcuccgcggugcccgucgacugggugcccaccagccggaccaccugguccauccacgcccaccaccaguggaugacgaccgaggacaugcugagcguguggaaccgcgucuggaucgaggagaaccccuggauggaggacaagacccacguguccagcuggggcgacgugccguaccugggcaagcgggaggaccaguggugcggcucccucaucgggcugaccgcccgcgccaccugggccagcaacauccaggucgcgaucaaccaggugcgccggcugaucggcaacgagaacuaccucgacuacaugacguccaugaagcgcuucaagaacgagggggaccccgagggcgcccugugguga

SEQ ID NO: 8543 - RNA, 9879 nt, Artificial Sequence
  derived and/or modified CDS sequence (opt1) from DENV-1__FJ882565__SS-prME
agcgugaccaugcugcucaugcugaugcccaccgcccuggccuuccaccucaccacccggggcggggagccccacaugaucgugaccaagcaggagcggggcaagagccugcuguucaagaccagcgcgggggugaacaugugcacccucaucgccauggaccugggcgagcugugcgaggacaccaugaccuacaagugcccccgcaucaccgaggccgagcccgacgacguggacugcuggugcaacgccaccgacaccugggugaccuacgggaccugcagccagacgggcgagcaccggcgcgacaagcggagcguggcccucgcgccccacgugggccuggggcuggagacccgcaccgagaccuggauguccagcgagggcgccuggaagcagauccagcggguggagacgugggcccuccgccaccccggguucaccgugaucgcccuguuccuggcgcacgccaucggcaccuccaucacccagaaggggaucaucuucauccuccugaugcuggugacgcccagcauggccaugcggugcgucggcaucggcucccgcgacuucguggaggggcucagcggcgccaccuggguggacgucgugcuggagcacggguccugcgugaccaccauggccaaggacaagcccacgcuggacaucgagcuccugaagaccgaggucaccaaccccgcggugcugcggaagcucugcaucgaggccaagaucagcaacaccacgaccgacucccgcugccccacccagggcgaggccacccugauggaggagcaggacgccaacuucgugugccggcgcacguucgucgaccggggcugggggaacggcugcgggcuguucggcaaggggagccucaucacgugcgccaaguucaagugcgugaccaagcuggagggcaagaucgugcaguacgagaaccugaaguacuccgucaucgugaccgugcacacgggcgaccagcaccaggucgggaacgagagcaccgagcacggcaccaccgcgaccaucacgccccaggcccccaccuccgagauccagcucaccgacuacggggcccugacccuggacugcagcccccgcacgggccucgacuucaacgagauggugcugcugaccaugaaggagaaguccuggcucguccacaagcagugguuccuggaccugccgcuccccuggaccagcggggccagcaccucccaggagacguggaaccggcaggaccugcuggugaccuucaagaccgcccacgcgaagaagcaggagguggucgugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgugaugugcaccggguccuucaagcucgagaaggaggucgcggagacgcagcacggcaccgugcuggugcagaucaaguacgagggcaccgacgcccccugcaagauccccuucagcacccaggacgagaagggggucacgcagaacggccggcugaucaccgccaacccgaucgugaccgacaaggagaagcccgugaacaucgaggccgagccgcccuucggggaguccuacaucgucaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcguggggaagcugguccaccagaucuucggcaccgccuacgggguccuguucuccggcgugagcuggaccaugaagaucgggaucggcguccugcugacguggcucggccugaacucccgcagcaccucccugagcaugaccugcaucgccguggggcucgugacccuguaccugggcgucauggugcaggccgacuccgggugcgugaucaacuggaagggccgggagcucaagugcgggagcggcaucuucgucacgaacgaggugcacaccuggaccgagcaguacaaguuccaggcggacagcccgaagcgccuguccgccgccaucggcaaggccugggaggagggggugugcggcauccggagcgccacccgccuggagaacaucauguggaagcagaucuccaacgagcucaaccacauccugcuggagaacgacaugaaguucaccgucguggugggggacgucgugggcauccucgcgcaggggaagaagaugauccggccccagcccauggagcacaaguacagcuggaaguccuggggcaaggccaagaucaucggcgccgacgugcagaacacgaccuucaucaucgacgggcccaacaccccggagugccccgacgaccagcgcgccuggaacaucugggaggucgaggacuacggcuucgggaucuucaccacgaacaucuggcugaagcugcggggcagcuacacccaggugugcgaccaccgccucauguccgcggccaucaaggacagcaaggccgugcacgccgacaugggcuacuggaucgaguccgagaagaacgagaccuggaagcuggcccgggcgagcuucaucgaggucaagaccugcaucuggcccaagucccacacgcuguggagcaacggggugcucgaguccgagaugaucauccccaagaucuacggcgggccgaucagccagcacaacuaccgccccggcuacuucacccagaccgccgggcccuggcaccugggcaagcuggagcucgacuucgaccugugcgagggcaccacgguggucguggacgagcacugcgggaaccggggcccgucccugcgcaccaccaccgugacggggaagaucauccacgaguggugcugccggagcugcacccugccgccccuccgcuucaagggcgaggacgggugcugguacggcauggagauccggcccgucaaggagaaggaggagaaccuggugaaguccauggugagcgccggcagcggggaggucgacuccuucagccucggccugcugugcaucuccaucaugaucgaggaggugaugcgcagccgguggucccgcaagaugcucaugaccgggacccuggccguguuccugcuccugaucaugggccagcugacguggaacgaccucauccggcugugcaucauggucggggccaacgcgagcgaccgcaugggcaugggcaccaccuaccuggcccucauggccaccuucaagaugcgcccgauguucgccguggggcugcuguuccggcgccucacgucccgggaggugcugcugcucaccaucgggcugagccuggucgccuccguggagcuccccaacagccuggaggagcugggggacggccucgcgaugggcaucaugauccugaagcugcucaccgacuuccagucccaccagcugugggccacccugcucagccugacguucaucaagaccacccugucccuccacuacgccuggaagaccauggccaugguccugagcaucgugucccuguucccccucugccugagcacgaccucccagaagaccaccuggcugcccgugcuccuggggagccugggcugcaagccgcucacgauguuccugaucgcggagaacaagaucugggggcgcaaguccuggccccugaacgagggcaucauggccgucgggguggugagcauccuccugagcucccugcucaagaacgacgucccccuggccggcccccugaucgccggcgggaugcucaucgccugcuacgugaucagcggcuccagcgcggaccugucccuggagaaggccgccgaggugagcugggaggaggaggccgagcacuccggggccagccacaacauccucgucgaggugcaggacgacggcaccaugaagaucaaggacgaggagcgggacgacacccugaccauccugcucaaggcgacccugcuggccguguccggggucuacccgcucagcauccccgccacgcuguucgugugguacuucuggcagaagaagaagcagcgcuccggcgugcugugggacacccccagcccgcccgaggucgagcgggccgugcuggacgacggcaucuaccgcaucaugcagcgggggcuccugggccgcucccaggugggggucggcguguuccaggagaacguguuccacaccauguggcacgucacccgcggggccgugcugauguaccagggcaagcgccucgagcccagcugggcguccgugaagaaggaccugaucagcuacggcgggggcuggcggcugcagggguccuggaacacgggcgaggagguccaggugaucgccguggagcccgggaagaaccccaagaacguccagaccgcccccggcaccuucaagacccccgagggcgaggugggggccaucgcccucgacuucaagcccggcacgagcgggucccccaucgugaaccgcgagggcaagaucgucggccuguacgggaacggcguggugaccaccagcgggaccuacgucagcgcgaucgcccaggccaaggccucccaggagggcccgcugcccgagaucgaggacgagguguuccggaagcgcaaccucacgaucauggaccugcaccccgggagcggcaagacccggcgcuaccugccggcgaucgugcgggaggccaucaagcgcaagcuccggacccugauccuggcccccacccgcgucguggccuccgagauggccgaggcgcucaagggcaugcccauccgcuaccagacgaccgccgucaagagcgagcacaccgggaaggagaucgucgaccugaugugccacgccaccuucacgaugcggcugcucucccccgugcgcgugccgaacuacaacaugaucaucauggacgaggcccacuucaccgaccccagcuccaucgccgcgcggggcuacaucagcacccgcgucgggaugggcgaggccgccgccaucuucaugaccgccacgccgcccggguccguggaggcguucccgcagagcaacgccgugauccaggacgaggagcgggacauccccgagcgcuccuggaacagcggcuacgaguggaucaccgacuuccccggcaagaccgucugguucgugcccuccaucaagagcgggaacgacaucgccaacugccugcggaagaacggcaagcgcgugauccagcugucccggaagaccuucgacacggaguaccagaagaccaagaacaacgacugggacuacgucgugaccaccgacaucagcgagaugggggccaacuuccgcgcggaccgggugaucgacccgcgccggugccucaagcccgucauccugaaggacggccccgagcgcgugauccuggccgggcccaugccggucacgguggccuccgccgcccagcggcgcggccggaucggccgcaaccacaacaaggagggggaccaguacaucuacaugggccagccccucaacaacgacgaggaccacgcgcacuggaccgaggccaagaugcugcuggacaacaucaacacccccgaggggaucauccccgcccucuucgagccggagcgggagaaguccgccgccaucgacggcgaguaccgccugcgcggggaggcgcggaagaccuucguggagcugaugcgccggggcgaccuccccgucuggcuguccuacaagguggccagcgagggcuuccaguacagcgaccgccgguggugcuucgacggggagcgcaacaaccaggugcuggaggagaacauggacgucgagaucuggacgaaggagggcgagcggaagaagcuccgcccccgguggcuggacgcccgcaccuacuccgacccccuggcccuccgggaguucaaggaguucgccgcggggcgccggagcguguccggcgaccugauccuggagaucggcaagcucccgcagcaccugacccagcgcgcccagaacgcccuggacaaccucgugaugcugcacaacagcgagcagggcgggcgggccuaccgccacgcgauggaggagcugcccgacaccaucgagacgcucaugcugcuggcccucaucgccguccugaccgggggcgugacccuguucuuccucuccgggcggggccugggcaagaccagcaucgggcugcucugcgugauggccuccagcguccugcuguggauggccuccguggagccccacuggaucgcggccagcaucauccucgaguucuuccugauggugcugcucauccccgagccggaccgccagcggacgccccaggacaaccagcuggccuacgucgugaucggccuccucuucaugauccugacgguggccgccaacgagauggggcugcucgagaccaccaagaaggaccugggcaucgggcacgucgcgguggagaaccaccaccacgccaccaugcuggacguggaccuccaccccgccuccgccuggacgcuguacgccgucgcgaccaccaucaucaccccgaugaugcgccacacgaucgagaacaccaccgccaacaucagccugaccgccaucgccaaccaggccgcgauccucaugggccuggacaagggcuggcccaucuccaagauggacaucggggugccccugcucgcccugggcugcuacagccaggugaacccccugacgcucaccgccgccguccugaugcugguggcgcacuacgccaucaucgggccgggccuccaggccaaggccacccgggaggcccagaagcgcaccgcggccgggaucaugaagaaccccacgguggacggcaucgucgccaucgaccuggaccccgugguguacgacgccaaguucgagaagcagcugggccagaucaugcuccugauccugugcaccucccagauccuccugaugcgcaccaccugggcccugugcgagagcaucacgcucgcgaccgggccccugaccacccugugggagggcuccccggggaaguucuggaacacgaccaucgccgucagcauggccaacaucuuccggggcuccuaccucgccggcgccgggcuggcguucagccugaugaagucccucggcgggggccgccgggggaccggcgcccagggcgagacccugggggagaaguggaagcgccagcugaaccagcucuccaagagcgaguucaacaucuacaagcgguccggcaucauggagguggaccgcagcgaggccaaggaggggcugaagcggggcgagacgacccgccacgccgugucccgggggaccgcgaagcugcgcugguucgucgagcggaaccuggugaagcccgagggcaaggugaucgaccucggcugcgggcgcggcggguggagcuacuacugcgccggccugaagaaggucaccgaggugaagggguacacgaagggcggccccgggcacgaggagcccaucccgauggccaccuacggcuggaaccuggugaagcuccacuccgggaaggacgucuucuucacgccgcccgagaagugcgacacccugcugugcgacaucggcgagagcucccccaacccgacgaucgaggaggggcggacccuccgcgugcugaagaugguggagcccuggcugcggggcaaccaguucugcaucaagauccucaaccccuacaugcccagcgucguggagacccuggagcagaugcagcgcaagcacggcgggaugcuggugcggaacccgcucucccgcaacagcacccacgagauguacugggucuccugcggcaccgggaacaucgugagcgccgugaacaugacgucccggaugcugcugaaccgcuucaccauggcccaccgcaagcccaccuacgagcgggacgucgaccucggcgcgggcacccgccacguggccguggagcccgaggucgccaaccuggacaucaucgggcagcggaucgagaacaucaagcacgagcacaagagcacguggcacuacgacgaggacaaccccuacaagaccugggccuaccacggcuccuacgaggugaagccgagcggguccgccagcagcauggucaacggcguggugaagcugcucaccaagcccugggacgucauccccauggugacccagaucgcgaugacggacaccacccccuucgggcagcagcgcguguucaaggagaaggucgacacccggacgccgaaggccaagcgcggcaccgcccagaucauggaggugaccgcccgguggcuguggggcuuccugucccgcaacaagaagccccggaucugcacccgcgaggaguucacgcggaaggugcgcagcaacgccgcgaucggggccgucuucguggacgagaaccaguggaacuccgccaaggaggccguggaggacgagcgguucugggaccucguccagaaggagcgcgagcugcacaagcagggcaagugcgcgaccugcguguacaacaugauggggaagcgggagaagaagcugggcgaguucgggaaggccaagggcagccgcgccaucugguacauguggcucggcgcccgguuccuggaguucgaggcccugggguucaugaacgaggaccacugguucucccgcgagaacagccucuccggcguggagggggagggccugcacaagcugggguacauccuccgggacaucagcaagauccccggcggcaacauguacgcggacgacaccgccgggugggacacccgcaucacggaggacgaccugcagaacgaggccaagaucaccgacaucauggagccggagcacgcccugcucgccaccuccaucuucaagcugaccuaccagaacaaggucgugcgggugcagcgccccgcgaagaacggcacggucauggacgugaucagccgccgggaccagcgcggguccggccaggugggcaccuacgggcugaacaccuucaccaacauggaggcccagcucauccggcagauggagagcgagggcaucuuccugcccuccgagcuggagacgcccaaccucgccgagcgcguccuggacuggcuggagaaguacgggguggagcggcucaagcgcauggccaucagcggcgacgacugcguggucaagccgaucgacgaccgguucgccaccgcgcugaccgcccugaacgacauggggaaggugcgcaaggacaucccccagugggagcccuccaagggcuggaacgacuggcagcagguccccuucugcagccaccacuuccaccagcucaucaugaaggacggccgggagaucgucgugccgugccgcaaccaggacgagcugguggggcgggcccgcgucucccagggcgccggguggagccugcgggagaccgccugccucggcaagagcuacgcgcagauguggcagcugauguacuuccaccgccgggaccugcgccucgccgccaacgccaucugcuccgcggugcccguggacuggguccccacgagccggaccaccugguccauccacgcccaccaccaguggaugaccacggaggacaugcugagcguguggaaccgcguguggaucgaggagaaccccuggauggaggacaagacccacgucuccagcuggggcgacgugccguaccugggcaagcgggaggaccaguggugcggcucccucaucgggcugaccgcccgcgccaccugggccagcaacauccagguggcgaucaaccagguccgccggcugaucggcaacgagaacuaccucgacuacaugaccuccaugaagcgcuucaagaacgagggggaccccgagggcgcccugugguga

SEQ ID NO: 8544 - RNA, 9879 nt, Artificial Sequence
  derived and/or modified CDS sequence (opt1) from DENV-1__FJ882567__SS-prME
agcgugaccaugcugcucaugcugaugcccaccgcccuggccuuccaccucaccacccggggcggggagccccacaugaucgugaccaagcaggagcggggcaagagccugcuguucaagaccagcgcgggggugaacaugugcacccucaucgccauggaccugggcgagcugugcgaggacaccaugaccuacaagugcccccgcaucaccgaggccgagcccgacgacguggacugcuggugcaacgccaccgacaccugggugaccuacgggaccugcagccagacgggcgagcaccggcgcgacaagcggagcguggcccucgcgccccacgugggccuggggcuggagacccgcaccgagaccuggauguccagcgagggcgccuggaagcagauccagcggguggagacgugggcccuccgccaccccggguucaccgugaucgcccuguuccuggcgcacgccaucggcaccuccaucacccagaaggggaucaucuucauccuccugaugcuggugacgcccagcauggccaugcggugcgucggcaucggcucccgcgacuucguggaggggcucagcggcgccaccuggguggacgucgugcuggagcacggguccugcgugaccaccauggccaaggacaagcccacgcuggacaucgagcuccugaagaccgaggucaccaaccccgcggugcugcggaagcucugcaucgaggccaagaucagcaacaccacgaccgacucccgcugccccacccagggcgaggccacccugauggaggagcaggacgccaacuucgugugccggcgcacguucgucgaccggggcugggggaacggcugcgggcuguucggcaaggggagccucaucacgugcgccaaguucaagugcgugaccaagcuggagggcaagaucgugcaguacgagaaccugaaguacuccgucaucgugaccgugcacacgggcgaccagcaccaggucgggaacgagagcaccgagcacggcaccaccgcgaccaucacgccccaggcccccaccuccgagauccagcucaccgacuacggggcccugacccuggacugcagcccccgcacgggccucgacuucaacgagauggugcugcugaccaugaaggagaaguccuggcucguccacaagcagugguuccuggaccugccgcuccccuggaccagcggggccagcaccucccaggagacguggaaccggcaggaccugcuggugaccuucaagaccgcccacgcgaagaagcaggagguggucgugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgugaugugcaccggguccuucaagcucgagaaggaggucgcggagacgcagcacggcaccgugcuggugcagaucaaguacgagggcaccgacgcccccugcaagauccccuucagcacccaggacgagaagggggucacgcagaacggccggcugaucaccgccaacccgaucgugaccgacaaggagaagcccgugaacaucgaggccgagccgcccuucggggaguccuacaucgucaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcguggggaagcugguccaccagaucuucggcaccgccuacgggguccuguucuccggcgugagcuggaccaugaagaucgggaucggcguccugcugacguggcucggccugaacucccgcagcaccucccugagcaugaccugcaucgccguggggcucgugacccuguaccugggcgucauggugcaggccgacuccgggugcgugaucaacuggaagggccgggagcucaagugcgggagcggcaucuucgucacgaacgaggugcacaccuggaccgagcaguacaaguuccaggcggacagcccgaagcgccuguccgccgccaucggcaaggccugggaggagggggugugcggcauccggagcgccacccgccuggagaacaucauguggaagcagaucuccaacgagcucaaccacauccugcuggagaacgggaugaaguucaccgucguggugggcgacgucguggggauccucgcgcagggcaagaagaugauccggccccagcccauggagcacaaguacagcuggaaguccuggggcaaggccaagaucaucggggccgacgugcagaacacgaccuucaucaucgacggccccaacaccccggagugccccgacgaccagcgcgccuggaacaucugggaggucgaggacuacggguucggcaucuucaccacgaacaucuggcugaagcugcgggacagcuacacccaggugugcgaccaccgccucauguccgcggccaucaaggacagcaaggccgugcacgccgacaugggcuacuggaucgaguccgagaagaacgagaccuggaagcuggcccgggcgagcuucaucgaggucaagaccugcaucuggcccaagucccacacgcuguggagcaacggggugcucgaguccgagaugaucauccccaagaucuacggcgggccgaucagccagcacaacuaccgccccggcuacuucacccagaccgccgggcccuggcaccugggcaagcuggagcucgacuucgaccugugcgagggcaccacgguggucguggacgagcacugcgggaaccggggcccgucccugcgcaccaccaccgugacggggaagaucauccacgaguggugcugccggagcugcacccugccgccccuccgcuucaagggcgaggacgggugcugguacggcauggagauccggcccgucaaggagaaggaggagaaccuggugaaguccauggugagcgccggcagcggggaggucgacuccuucagccucggccugcugugcaccuccaucaugaucgaggaggugaugcgcagccgguggucccgcaagaugcucaugaccgggacgcuggccguguuccugcuccugaucaugggccagcugaccuggaacgaccucauccggcugugcaucauggucggggccaacgcgagcgaccgcaugggcaugggcaccaccuaccuggcccucauggccacguucaagaugcgcccgauguucgccguggggcugcuguuccggcgccucaccucccgggaggugcugcugcucaccaucgggcugagccuggucgccuccguggagcuccccaacagccuggaggagcugggggacggccucgcgaugggcaucaugauccugaagcugcucaccgacuuccagucccaccagcugugggccacgcugcucagccugaccuucaucaagaccacccugucccuccacuacgccuggaagacgauggccaugguccugagcaucgugucccuguucccccucugccugagcaccaccucccagaagaccacguggcugcccgugcuccuggggagccugggcugcaagccgcucaccauguuccugaucgcggagaacaagaucugggggcgcaaguccuggccccugaacgagggcaucauggccgucgggguggugagcauccuccugagcucccugcucaagaacgacgucccccuggccggcccccugaucgccggcgggaugcucaucgccugcuacgugaucagcggcuccagcgcggaccugucccuggagaaggccgccgaggugagcugggaggaggaggccgagcacuccggggccagccacaacauccucgucgaggugcaggacgacggcaccaugaagaucaaggacgaggagcgggacgacacccugaccauccugcucaaggcgacgcugcuggccguguccggggucuacccgcucagcauccccgccacccuguucgugugguacuucuggcagaagaagaagcagcgcuccggcgugcugugggacacccccagcccgcccgaggucgagcgggccgugcuggacgacggcaucuaccgcaucaugcagcgggggcuccugggccgcucccaggugggggucggcguguuccaggagaacguguuccacaccauguggcacgucacgcgcggggccgugcugauguaccagggcaagcgccucgagcccagcugggcguccgugaagaaggaccugaucagcuacggcgggggcuggcggcugcagggguccuggaacaccggcgaggagguccaggugaucgccguggagcccgggaagaaccccaagaacguccagaccgcccccggcaccuucaagacgcccgagggcgaggugggggccaucgcccucgacuucaagcccggcaccagcgggucccccaucgugaaccgcgagggcaagaucgucggccuguacgggaacggcguggugaccaccagcgggacguacgucagcgcgaucgcccaggccaaggccucccaggagggcccgcugcccgagaucgaggacgagguguuccggaagcgcaaccucaccaucauggaccugcaccccgggagcggcaagacccggcgcuaccugccggcgaucgugcgggaggccaucaagcgcaagcuccggacccugauccuggcccccacgcgcgucguggccuccgagauggccgaggcgcucaagggcaugcccauccgcuaccagaccaccgccgucaagagcgagcacaccgggaaggagaucgucgaccugaugugccacgccacguucaccaugcggcugcucucccccgugcgcgugccgaacuacaacaugaucaucauggacgaggcccacuucaccgaccccagcuccaucgccgcgcggggcuacaucagcacccgcgucgggaugggcgaggccgccgccaucuucaugacggccacgccgcccggguccguggaggcguucccgcagagcaacgccgugauccaggacgaggagcgggacauccccgagcgcuccuggaacagcggcuacgaguggaucaccgacuuccccggcaagaccgucugguucgugcccuccaucaagagcgggaacgacaucgccaacugccugcggaagaacggcaagcgcgugauccagcugucccggaagacguucgacaccgaguaccagaagaccaagaacaacgacugggacuacgucgugaccacggacaucagcgagaugggggccaacuuccgcgcggaccgggugaucgacccgcgccggugccucaagcccgucauccugaaggacggccccgagcgcgugauccuggccgggcccaugccggucaccguggccuccgccgcccagcggcgcggccggaucggccgcaaccacaacaaggagggggaccaguacaucuacaugggccagccccucaacaacgacgaggaccacgcgcacuggaccgaggccaagaugcugcuggacaacaucaacacccccgaggggaucauccccgcccucuucgagccggagcgggagaaguccgccgccaucgacggcgaguaccgccugcgcggggaggcgcggaagacguucguggagcugaugcgccggggcgaccuccccgucuggcuguccuacaagguggccagcgagggcuuccaguacagcgaccgccgguggugcuucgacggggagcgcaacaaccaggugcuggaggagaacauggacgucgagaucuggaccaaggagggcgagcggaagaagcuccgcccccgguggcuggacgcccgcaccuacuccgacccccuggcccuccgggaguucaaggaguucgccgcggggcgccggagcguguccggcgaccugauccuggagaucggcaagcucccgcagcaccugacccagcgcgcccagaacgcccuggacaaccucgugaugcugcacaacagcgagcagggcgggcgggccuaccgccacgcgauggaggagcugcccgacacgaucgagacccucaugcugcuggcccucaucgccguccugaccgggggcgugacccuguucuuccucuccgggcggggccugggcaagaccagcaucgggcugcucugcgugauggccuccagcguccugcuguggauggccuccguggagccccacuggaucgcggccagcaucauccucgaguucuuccugauggugcugcucauccccgagccggaccgccagcggacgccccaggacaaccagcuggccuacgucgugaucggccuccucuucaugauccugaccguggccgccaacgagauggggcugcucgagaccaccaagaaggaccugggcaucgggcacgucgcgguggagaaccaccaccacgccacgaugcuggacguggaccuccaccccgccuccgccuggacccuguacgccgucgcgaccaccaucaucacgccgaugaugcgccacaccaucgagaacaccaccgccaacaucagccugacggccaucgccaaccaggccgcgauccucaugggccuggacaagggcuggcccaucuccaagauggacaucggggugccccugcucgcccugggcugcuacagccaggugaacccccugacccucaccgccgccguccugaugcugguggcgcacuacgccaucaucgggccgggccuccaggccaaggccacccgggaggcccagaagcgcacggcggccgggaucaugaagaaccccaccguggacggcaucgucgccaucgaccuggaccccgugguguacgacgccaaguucgagaagcagcugggccagaucaugcuccugauccugugcaccucccagauccuccugaugcgcaccacgugggcccugugcgagagcaucacccucgcgaccgggccccugaccacgcugugggagggcuccccggggaaguucuggaacaccaccaucgccgucagcauggccaacaucuuccggggcuccuaccucgccggcgccgggcuggcguucagccugaugaagucccucggcgggggccgccgggggaccggcgcccagggcgagacgcugggggagaaguggaagcgccagcugaaccagcucuccaagagcgaguucaacaucuacaagcgguccggcaucauggagguggaccgcagcgaggccaaggaggggcugaagcggggcgagaccacccgccacgccgugucccgggggaccgcgaagcugcgcugguucgucgagcggaaccuggugaagcccgagggcaaggugaucgaccucggcugcgggcgcggcggguggagcuacuacugcgccggccugaagaaggucacggaggugaagggguacaccaagggcggccccgggcacgaggagcccaucccgauggccaccuacggcuggaaccuggugaagcuccacuccgggaaggacgucuucuucacgccgcccgagaagugcgacacgcugcugugcgacaucggcgagagcucccccaacccgaccaucgaggaggggcggacccuccgcgugcugaagaugguggagcccuggcugcggggcaaccaguucugcaucaagauccucaaccccuacaugcccagcgucguggagacccuggagcagaugcagcgcaagcacggcgggaugcuggugcggaacccgcucucccgcaacagcacccacgagauguacugggucuccugcggcacggggaacaucgugagcgccgugaacaugaccucccggaugcugcugaaccgcuucaccauggcccaccgcaagcccaccuacgagcgggacgucgaccucggcgcgggcacgcgccacguggccguggagcccgaggucgccaaccuggacaucaucgggcagcggaucgagaacaucaagcacgagcacaagagcaccuggcacuacgacgaggacaaccccuacaagaccugggccuaccacggcuccuacgaggugaagccgagcggguccgccagcagcauggucaacggcguggugaagcugcucaccaagcccugggacgucauccccauggugacgcagaucgcgaugaccgacaccacccccuucgggcagcagcgcguguucaaggagaaggucgacacgcggaccccgaaggccaagcgcggcaccgcccagaucauggaggugaccgcccgguggcuguggggcuuccugucccgcaacaagaagccccggaucugcacgcgcgaggaguucacccggaaggugcgcagcaacgccgcgaucggggccgucuucguggacgagaaccaguggaacuccgccaaggaggccguggaggacgagcgguucugggaccucguccagaaggagcgcgagcugcacaagcagggcaagugcgcgaccugcguguacaacaugauggggaagcgggagaagaagcugggcgaguucgggaaggccaagggcagccgcgccaucugguacauguggcucggcgcccgguuccuggaguucgaggcccugggguucaugaacgaggaccacugguucucccgcgagaacagccucuccggcguggagggggagggccugcacaagcugggguacauccuccgggacaucagcaagauccccggcggcaacauguacgcggacgacaccgccgggugggacacgcgcaucaccgaggacgaccugcagaacgaggccaagaucaccgacaucauggagccggagcacgcccugcucgccaccuccaucuucaagcugacguaccagaacaaggucgugcgggugcagcgccccgcgaagaacggcaccgucauggacgugaucagccgccgggaccagcgcggguccggccaggugggcaccuacgggcugaacaccuucacgaacauggaggcccagcucauccggcagauggagagcgagggcaucuuccugcccuccgagcuggagacccccaaccucgccgagcgcguccuggacuggcuggagaagcacgggguggagcggcucaagcgcauggccaucagcggcgacgacugcguggucaagccgaucgacgaccgguucgccaccgcgcugaccgcccugaacgacauggggaaggugcgcaaggacaucccccagugggagcccuccaagggcuggaacgacuggcagcagguccccuucugcagccaccacuuccaccagcucaucaugaaggacggccgggagaucgucgugccgugccgcaaccaggacgagcugguggggcgggcccgcgucucccagggcgccggguggagccugcgggagacggccugccucggcaagagcuacgcgcagauguggcagcugauguacuuccaccgccgggaccugcgccucgccgccaacgccaucugcuccgcggugcccguggacuggguccccaccagccggaccaccugguccauccacgcccaccaccaguggaugacgaccgaggacaugcugagcguguggaaccgcguguggaucgaggagaaccccuggauggaggacaagacccacgucuccagcuggggcgacgugccguaccugggcaagcgggaggaccaguggugcggcucccucaucgggcugaccgcccgcgccaccugggccagcaacauccagguggcgaucaaccagguccgccggcugaucggcaacgagaacuaccucgacuacaugacguccaugaagcgcuucaagaacgagggggaccccgagggcgcccugugguga

SEQ ID NO: 8545 - RNA, 9879 nt, Artificial Sequence
  derived and/or modified CDS sequence (opt1) from DENV-1__GQ199831__SS-prME
agcgugaccaugcugcucaugcugaugcccaccgcccuggccuuccaccucaccacccggggcggggagccccacaugaucgugaccaagcaggagcggggcaagagccugcuguucaagaccagcgccggggugaacaugugcacccucaucgccauggaccugggggagcugugcgaggacaccaugaccuacaagugcccccggaucaccgagaccgagcccgacgacguggacugcuggugcaacgccaccgacaccugggugaccuacgggaccugcagccagaccggggagcaccggcgcgacaagcggagcguggcccucgcgccccacgugggccuggggcuggagacccgcaccgagacguggauguccagcgagggcgccuggaagcagauccagcggguggagaccugggcccuccgccaccccggguucaccgugaucgcccuguuccuggcccacgcgaucggcaccuccaucacgcagaaggggaucaucuucauccuccugaugcuggugacccccagcauggccaugcggugcgucggcaucggcucccgcgacuucguggaggggcucagcggcgccaccuggguggacgucgugcuggagcacggguccugcgugaccacgauggccaaggacaagcccacccuggacaucgagcuccugaagaccgaggucaccaaccccgccgugcugcggaagcucugcaucgaggcgaagaucagcaacacgaccaccgacucccgcugccccacccagggcgaggccacgcugauggaggagcaggacgccaacuucgugugccggcgcaccuucgucgaccggggcugggggaacggcugcgggcuguucggcaaggggagccucaucacgugcgccaaguucaagugcgugaccaagcuggagggcaagaucgugcaguacgagaaccugaaguacuccgucaucgugacggugcacaccggcgaccagcaccaggucgggaacgagagcaccgagcacggcaccaccgccacgaucacgccccaggcgcccaccuccgagauccagcucaccgacuacggggcccugacgcuggacugcagcccccgcaccggccucgacuucaacgagauggugcugcugaccaugaaggagaaguccuggcucguccacaagcagugguuccuggaccugccgcuccccuggaccagcggggccagcacgucccaggagaccuggaaccggcaggaccugcuggugaccuucaagaccgcccacgccaagaagcaggagguggucgugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgugaugugcacgggguccuucaagcucgagaaggaggucgccgagacccagcacggcaccgugcuggugcagaucaaguacgagggcaccgacgcgcccugcaagauccccuucagcacgcaggacgagaagggggucacccagaacggccggcugaucaccgccaacccgaucgugaccgacaaggagaagcccgugaacaucgaggccgagccgcccuucggggaguccuacaucgucaucggcgccggcgagaaggcgcugaagcucagcugguucaagaagggguccagcaucggcaagauguucgaggccacggcccgcggggcccggcgcauggccauccugggcgacaccgcgugggacuucggguccaucggcggcguguucaccagcguggggaagcugguccaccagaucuucggcaccgccuacgggguccuguucuccggcgugagcuggacgaugaagaucgggaucggcguccugcugaccuggcucggccugaacucccgcagcaccucccugagcaugaccugcaucgccguggggcucgugacgcuguaccugggcgucauggugcaggccgacuccgggugcgugaucaacuggaagggccgggagcucaagugcgggagcggcaucuucgucaccaacgaggugcacaccuggaccgagcaguacaaguuccaggccgacagcccgaagcgccuguccgcggccaucggcaaggccugggaggagggggugugcggcauccggagcgccacccgccuggagaacaucauguggaagcagaucuccaacgagcucaaccacauccugcuggagaacgacaugaaguucacggucguggugggggacgucgugggcauccucgcccaggggaagaagaugauccggccccagcccauggagcacaaguacagcuggaaguccuggggcaaggcgaagaucaucggcgccgacgugcagaacaccaccuucaucaucgacgggcccaacaccccggagugccccgacgaccagcgcgccuggaacaucugggaggucgaggacuacggcuucgggaucuucacgaccaacaucuggcugaagcugcgggacagcuacacccaggugugcgaccaccgccucauguccgccgcgaucaaggacagcaaggccgugcacgccgacaugggcuacuggaucgaguccgagaagaacgagaccuggaagcuggcccgggccagcuucaucgaggucaagacgugcaucuggcccaagucccacacccuguggagcaacggcgugcucgaguccgagaugaucauccccaagaucuacgggggcccgaucagccagcacaacuaccgccccggguacuucacccagaccgcgggccccuggcaccuggggaagcuggagcucgacuucgaccugugcgagggcacgaccguggucguggacgagcacugcggcaaccgggggccgucccugcgcaccaccacggugaccggcaagaucauccacgaguggugcugccggagcugcacccugccgccccuccgcuucaagggggaggacggcugcugguacgggauggagauccggcccgucaaggagaaggaggagaaccuggugaaguccauggugagcgccggcagcggcgaggucgacuccuucagccucgggcugcugugcaucuccaucaugaucgaggaggugaugcgcagccgguggucccgcaagaugcucaugaccggcacgcuggccguguuccugcuccugaucauggggcagcugaccuggaacgaccucauccggcugugcaucauggucggcgccaacgccagcgaccgcauggggaugggcaccaccuaccuggcgcucauggccacguucaagaugcgcccgauguucgccgugggccugcuguuccggcgccucaccucccgggaggugcugcugcucaccaucgggcugagccuggucgccuccguggagcuccccaacagccuggaggagcugggcgacgggcucgccaugggcaucaugauccugaagcugcucaccgacuuccagucccaccagcugugggcgacgcugcucagccugaccuucaucaagaccacccugucccuccacuacgccuggaagacgauggccaugguccugagcaucgugucccuguucccccucugccugagcaccaccucccagaagaccacguggcugcccgugcuccugggcagccuggggugcaagccgcucaccauguuccugaucgccgagaacaagaucuggggccgcaaguccuggccccugaacgaggggaucauggcggucggcguggugagcauccuccugagcucccugcucaagaacgacgucccccuggccgggccccugaucgccggcggcaugcucaucgccugcuacgugaucagcggguccagcgccgaccugucccuggagaaggcggccgaggugagcugggaggaggaggccgagcacuccggcgccagccacaacauccucgucgaggugcaggacgacgggaccaugaagaucaaggacgaggagcgggacgacacccugaccauccugcucaaggccacgcugcuggcgguguccggcgucuacccgcucagcauccccgccacccuguucgugugguacuucuggcagaagaagaagcagcgcuccggggugcugugggacacccccagcccgcccgaggucgagcgggccgugcuggacgacggcaucuaccgcaucaugcagcggggccuccuggggcgcucccaggugggcgucgggguguuccaggagaacguguuccacaccauguggcacgucacgcggggcgccgugcugauguaccaggggaagcgccucgagcccagcugggccuccgugaagaaggaccugaucagcuacggcggcggguggcggcugcagggcuccuggaacaccggggaggagguccaggugaucgcgguggagcccggcaagaaccccaagaacguccagaccgcccccgggaccuucaagacgcccgagggcgaggugggcgccaucgcccucgacuucaagcccgggaccagcggcucccccaucgugaaccgcgaggggaagaucgucggccuguacggcaacgggguggugaccaccagcggcacguacgucagcgccaucgcgcaggccaaggccucccaggaggggccgcugcccgagaucgaggacgagguguuccggaagcgcaaccucaccaucauggaccugcaccccggcagcgggaagacccggcgcuaccugccggccaucgugcgggaggcgaucaagcgcaagcuccggacccugauccuggcccccacgcgcgucguggccuccgagauggccgaggcccucaagggcaugcccauccgcuaccagaccaccgcggucaagagcgagcacaccggcaaggagaucgucgaccugaugugccacgccacguucaccaugcggcugcucucccccgugcgcgugccgaacuacaacaugaucaucauggacgaggcccacuucaccgaccccagcuccaucgccgcccggggguacaucagcacccgcgucggcaugggggaggcggccgccaucuucaugacggccacgccgcccggcuccguggaggccuucccgcagagcaacgcggugauccaggacgaggagcgggacauccccgagcgcuccuggaacagcggguacgaguggaucaccgacuuccccggcaagaccgucugguucgugcccuccaucaagagcggcaacgacaucgccaacugccugcggaagaacgggaagcgcgugauccagcugucccggaagacguucgacaccgaguaccagaagaccaagaacaacgacugggacuacgucgugaccacggacaucagcgagaugggcgccaacuuccgcgccgaccgggugaucgacccgcgccggugccucaagcccgucauccugaaggacgggcccgagcgcgugauccuggcgggccccaugccggucaccguggccuccgccgcccagcggcgcgggcggaucggccgcaaccacaacaaggagggcgaccaguacaucuacauggggcagccccucaacaacgacgaggaccacgcccacuggaccgaggcgaagaugcugcuggacaacaucaacacccccgagggcaucauccccgcccucuucgagccggagcgggagaaguccgccgccaucgacggggaguaccgccugcgcggcgaggcccggaagacguucguggagcugaugcgccgcggggaccuccccgucuggcuguccuacaagguggcgagcgagggcuuccaguacagcgaccgccgguggugcuucgacggcgagcgcaacaaccaggugcuggaggagaacauggacgucgagaucuggaccaaggagggggagcggaagaagcuccgcccccgguggcuggacgcccgcaccuacuccgacccccuggcccuccgggaguucaaggaguucgccgccggccgccggagcguguccggggaccugauccuggagaucggcaagcucccgcagcaccugacccagcgcgcgcagaacgcccuggacaaccucgugaugcugcacaacagcgagcagggcgggcgggccuaccgccacgccauggaggagcugcccgacacgaucgagacccucaugcugcuggcgcucaucgccguccugaccggcggggugacccuguucuuccucuccggccgggggcugggcaagaccagcaucggccugcucugcgugauggccuccagcguccugcuguggauggccuccguggagccccacuggaucgccgcgagcaucauccucgaguucuuccugauggugcugcucauccccgagccggaccgccagcggacgccccaggacaaccagcuggccuacgucgugaucgggcuccucuucaugauccugaccguggccgccaacgagaugggccugcucgagaccaccaagaaggaccuggggaucggccacgucgccguggagaaccaccaccacgcgacgaugcuggacguggaccuccaccccgccuccgccuggacccuguacgccgucgccaccaccaucaucacgccgaugaugcgccacaccaucgagaacaccaccgcgaacaucagccugacggccaucgccaaccaggccgccauccucauggggcuggacaagggcuggcccaucuccaagauggacaucggcgugccccugcucgcgcuggggugcuacagccaggugaacccccugacccucaccgccgccguccugaugcugguggcccacuacgcgaucaucggcccggggcuccaggccaaggccacccgggaggcccagaagcgcacggccgcgggcaucaugaagaaccccaccguggacgggaucgucgccaucgaccuggaccccgugguguacgacgccaaguucgagaagcagcugggccagaucaugcuccugauccugugcaccucccagauccuccugaugcgcaccacgugggcccugugcgagagcaucacccucgccaccggcccccugaccacgcugugggagggguccccgggcaaguucuggaacaccaccaucgcggucagcauggccaacaucuuccggggguccuaccucgccggcgccggccuggccuucagccugaugaagucccucgggggcgggcgccggggcaccggggcgcagggcgagacgcugggcgagaaguggaagcgccagcugaaccagcucuccaagagcgaguucaacaucuacaagcgguccgggaucauggagguggaccgcagcgaggccaaggagggccugaagcgcggggagaccacccgccacgccgugucccggggcaccgccaagcugcgcugguucgucgagcggaaccuggugaagcccgaggggaaggugaucgaccucggcugcggccgcgggggcuggagcuacuacugcgcggggcugaagaaggucacggaggugaagggcuacaccaagggcgggcccggccacgaggagcccaucccgauggccaccuacggguggaaccuggugaagcuccacuccggcaaggacgucuucuucacgccgcccgagaagugcgacacgcugcugugcgacaucggggagagcucccccaacccgaccaucgaggagggccggacccuccgcgugcugaagaugguggagcccuggcugcgggggaaccaguucugcaucaagauccucaaccccuacaugcccagcgucguggagacccuggagcagaugcagcgcaaguacggcggcaugcuggugcggaacccgcucucccgcaacagcacccacgagauguacugggucuccugcgggacgggcaacaucgugagcgccgugaacaugaccucccggaugcugcugaaccgcuucaccauggcccaccgcaagcccaccuacgagcgggacgucgaccucggggccggcacgcgccacguggcgguggagcccgaggucgccaaccuggacaucaucggccagcggaucgagaacaucaagcacgagcacaagagcaccuggcacuacgacgaggacaaccccuacaagaccugggccuaccacggguccuacgaggugaagccgagcggcuccgccagcagcauggucaacgggguggugaagcugcucaccaagcccugggacgucauccccauggugacgcagaucgccaugaccgacaccacccccuucggccagcagcgcguguucaaggagaaggucgacacgcggaccccgaaggcgaagcgcgggaccgcccagaucauggaggugaccgcccgguggcuguggggcuuccugucccgcaacaagaagccccggaucugcacgcgcgaggaguucacccggaaggugcgcagcaacgccgccaucggcgcggucuucguggacgagaaccaguggaacuccgccaaggaggccguggaggacgagcgguucugggaccucguccagaaggagcgcgagcugcacaagcaggggaagugcgcgaccugcguguacaacaugaugggcaagcgggagaagaagcugggggaguucggcaaggcgaaggggagccgcgccaucugguacauguggcucggcgcccgguuccuggaguucgaggcccugggcuucaugaacgaggaccacugguucucccgcgagaacagccucuccgggguggagggcgaggggcugcacaagcugggcuacauccuccgggacaucagcaagauccccgggggcaacauguacgccgacgacaccgcgggcugggacacgcgcaucaccgaggacgaccugcagaacgaggccaagaucaccgacaucauggagccggagcacgcccugcucgccaccuccaucuucaagcugacguaccagaacaaggucgugcgggugcagcgccccgccaagaacgggaccgucauggacgugaucagccgccgggaccagcgcggcuccggccaggugggcaccuacggccugaacaccuucacgaacauggaggcgcagcucauccggcagauggagagcgaggggaucuuccugcccuccgagcuggagacccccaaccucgccgagcgcguccuggacuggcuggagaaguacggcguggagcggcucaagcgcauggccaucagcggggacgacugcguggucaagccgaucgacgaccgguucgccaccgcccugaccgcgcugaacgacaugggcaaggugcgcaaggacaucccccagugggagcccuccaagggguggaacgacuggcagcagguccccuucugcagccaccacuuccaccagcucaucaugaaggacggccgggagaucgucgugccgugccgcaaccaggacgagcuggugggccgggcccgcgucucccagggggccggcuggagccugcgggagacggccugccucggcaagagcuacgcccagauguggcagcugauguacuuccaccgccgggaccugcgccucgcggccaacgccaucugcuccgccgaccccguggacugggugcccaccagccggaccaccugguccauccacgcgcaccaccaguggaugacgaccgaggacaugcugagcgucuggaaccgcguguggaucgaggagaaccccuggauggaggacaagacccacguguccagcuggggcgacgucccguaccuggggaagcgggaggaccaguggugcggcucccucaucggccugaccgcccgcgccaccugggccagcaacauccagguggccaucaaccaggugcgccggcugaucgggaacgagaacuaccucgacuacaugacguccaugaagcgcuucaagaacgagggcgaccccgagggggcgcugugguga

SEQ ID NO: 8546 - RNA, 9879 nt, Artificial Sequence
  derived and/or modified CDS sequence (opt1) from DENV-1__GQ199832__SS-prME
agcgugaccaugcugcucaugcugaugcccaccgcccuggccuuccaccucaccacccggggcggggagccccacaugaucgugaccaagcaggagcggggcaagagccugcuguucaagaccagcgcgggggugaacaugugcacccucaucgccauggaccugggcgagcugugcgaggacaccaugaccuacaagugcccccgcaucaccgaggccgagcccgacgacguggacugcuggugcaacgccacggacaccugggugaccuacgggaccugcagccagacgggcgagcaccggcgcgacaagcggagcguggcccucgcgccccacgugggccuggggcuggagacccgcaccgagaccuggauguccagcgagggcgccuggaagcagauccagcggguggagacgugggcccuccgccaccccggguucaccgugaucgcccuguuccuggcgcacgccaucggcaccuccaucacccagaaggggaucaucuucauccuccugaugcuggugacgcccagcauggccaugcggugcgucggcaucggcucccgcgacuucguggaggggcucagcggcgccaccuggguggacgucgugcuggagcacggguccugcgugaccaccauggccaaggacaagcccacgcuggacaucgagcuccugaagaccgaggucaccaaccccgcggugcugcggaagcucugcaucgaggccaagaucagcaacaccacgaccgacucccgcugcccgacccagggcgaggccacccugauggaggagcaggacgccaacuucgugugccggcgcacguucgucgaccggggcugggggaacggcugcgggcuguucggcaaggggagccucaucacgugcgccaaguucaagugcgugaccaagcuggagggcaagaucgugcaguacgagaaccugaaguacuccgucaucgugaccgugcacacgggcgaccagcaccaggucgggaacgagagcaccgagcacggcaccaccgcgaccaucacgccccaggcccccaccuccgagauccagcucaccgacuacggggcccugacccuggacugcagcccccgcacgggccucgacuucaacgagauggugcugcugaccaugaaggagaaguccuggcucguccacaagcagugguuccuggaccugccccuccccuggaccagcggggccagcaccucccaggagacguggaaccggcaggaccugcuggugaccuucaagaccgcccacgcgaagaagcaggagguggucgugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgugaugugcaccggguccuucaagcucgagaaggaggucgcggagacgcagcacggcaccgugcuggugcagaucaaguacgagggcaccgacgcccccugcaagauccccuucagcacccaggacgagaagggggucacgcagaacggccggcugaucaccgccaacccgaucgugaccgacaaggagaagcccgugaacaucgaggccgagccgcccuucggggaguccuacaucgucaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcguggggaagcugguccaccagaucuucggcaccgccuacgggguccuguucuccggcgugagcuggaccaugaagaucgggaucggcguccugcugacguggcucggccugaacucccgcagcaccucccugagcaugaccugcaucgccguggggcucgugacccuguaccugggcgucauggugcaggccgacuccgggugcgugaucaacuggaagggccgggagcucaagugcgggagcggcaucuucgucacgaacgaggugcacaccuggaccgagcaguacaaguuccaggcggacagcccgaagcgccuguccgccgccaucggcaaggccugggaggagggggugugcggcauccggagcgccacccgccuggagaacaucauguggaagcagaucuccaacgagcucaaccacauccugcuggagaacgggaugaaguucaccgucguggugggcgacgucguggggauccucgcgcagggcaagaagaugauccggccccagcccauggagcacaaguacagcuggaaguccuggggcaaggccaagaucaucggggccgacgugcagaacacgaccuucaucaucgacggccccaacaccccggagugccccgacgaccagcgcgccuggaacaucugggaggucgaggacuacggguucggcaucuucaccacgaacaucuggcugaagcugcgggacagcuacacccaggugugcgaccaccgccucauguccgcggccaucaaggacagcaaggccgugcacgccgacaugggcuacuggaucgaguccgagaagaacgagaccuggaagcuggcccgggcgagcuucaucgaggucaagaccugcaucuggcccaagucccacacgcuguggagcaacggggugcucgaguccgagaugaucauccccaagaucuacggcgggccgaucagccagcacaacuaccgccccggcuacuucacccagaccgccgggcccuggcaccugggcaagcuggagcucgacuucgaccugugcgagggcaccacgguggucguggacgagcacugcgggaaccggggcccgucccugcgcaccaccaccgugacggggaagaucauccacgaguggugcugccggagcugcacccugccgccccuccgcuucaagggcgaggacgggugcugguacggcauggagauccggcccgucaaggagaaggaggagaaccuggugaaguccauggugagcgccggcagcggggaggucgacuccuucagccucggccugcugugcaccuccaucaugaucgaggaggugaugcgcagccgguggucccgcaagaugcucaugaccgggacgcuggccguguuccugcuccugaucaugggccagcugaccuggaacgaccucauccggcugugcaucauggucggggccaacgcgagcgaccgcaugggcaugggcaccaccuaccuggcccucauggccacguucaagaugcgcccgauguucgccguggggcugcuguuccggcgccucaccucccgggaggugcugcugcucaccaucgggcugagccuggucgccuccguggagcuccccaacagccuggaggagcugggggacggccucgcgaugggcaucaugauccugaagcugcucaccgacuuccagucccaccagcugugggccacgcugcucagccugaccuucaucaagaccacccugucccuccacuacgccuggaagacgauggccaugguccugagcaucgugucccuguucccccucugccugagcaccaccucccagaagaccacguggcugcccgugcuccuggggagccugggcugcaagccgcucaccauguuccugaucgcggagaacaagaucugggggcgcaaguccuggccccugaacgagggcaucauggccgucgggguggugagcauccuccugagcucccugcucaagaacgacgucccccuggccggcccccugaucgccggcgggaugcucaucgccugcuacgugaucagcggcuccagcgcggaccugucccuggagaaggccgccgaggugagcugggaggaggaggccgagcacuccggggccagccacaacauccucgucgaggugcaggacgacggcaccaugaagaucaaggacgaggagcgggacgacacccugaccauccugcucaaggcgacgcugcuggccguguccggggucuacccgcucagcauccccgccacccuguucgugugguacuucuggcagaagaagaagcagcgcuccggcgugcugugggacacccccagcccgcccgaggucgagcgggccgugcuggacgacggcaucuaccgcaucaugcagcgggggcuccugggccgcucccaggugggggucggcguguuccaggagaacguguuccacaccauguggcacgucacgcgcggggccgugcugauguaccagggcaagcgccucgagcccagcugggcguccgugaagaaggaccugaucagcuacggcgggggcuggcggcugcagggguccuggaacaccggcgaggagguccaggugaucgccguggagcccgggaagaaccccaagaacguccagaccgcccccggcaccuucaagacgcccgagggcgaggugggggccaucgcccucgacuucaagcccggcaccagcgggucccccaucgugaaccgcgagggcaagaucgucggccuguacgggaacggcguggugaccaccagcgggacguacgucagcgcgaucgcccaggccaaggccucccaggagggcccgcugcccgagaucgaggacgagguguuccggaagcgcaaccucaccaucauggaccugcaccccgggagcggcaagacccggcgcuaccugccggcgaucgugcgggaggccaucaagcgcaagcuccggacccugauccuggcccccacgcgcgucguggccuccgagauggccgaggcgcucaagggcaugcccauccgcuaccagaccaccgccgucaagagcgagcacaccgggaaggagaucgucgaccugaugugccacgccacguucaccaugcggcugcucucccccgugcgcgugccgaacuacaacaugaucaucauggacgaggcccacuucaccgaccccagcuccaucgccgcgcggggcuacaucagcacccgcgucgggaugggcgaggccgccgccaucuucaugacggccacgccgcccggguccguggaggcguucccgcagagcaacgccgugauccaggacgaggagcgggacauccccgagcgcuccuggaacagcggcuacgaguggaucaccgacuuccccggcaagaccgucugguucgugcccuccaucaagagcgggaacgacaucgccaacugccugcggaagaacggcaagcgcgugauccagcugucccggaagacguucgacaccgaguaccagaagaccaagaacaacgacugggacuacgucgugaccacggacaucagcgagaugggggccaacuuccgcgcggaccgggugaucgacccgcgccggugccucaagcccgucauccugaaggacggccccgagcgcgugauccuggccgggcccaugccggucaccguggccuccgccgcccagcggcgcggccggaucggccgcaaccacaacaaggagggggaccaguacaucuacaugggccagccccucaacaacgacgaggaccacgcgcacuggaccgaggccaagaugcugcuggacaacaucaacacccccgaggggaucauccccgcccucuucgagccggagcgggagaaguccgccgccaucgacggcgaguaccgccugcgcggggaggcgcggaagacguucguggagcugaugcgccggggcgaccuccccgucuggcuguccuacaagguggccagcgagggcuuccaguacagcgaccgccgguggugcuucgacggggagcgcaacaaccaggugcuggaggagaacauggacgucgagaucuggaccaaggagggcgagcggaagaagcuccgcccccgguggcuggacgcccgcaccuacuccgacccccuggcccuccgggaguucaaggaguucgccgcggggcgccggagcguguccggcgaccugauccuggagaucggcaagcucccgcagcaccugacccagcgcgcccagaacgcccuggacaaccucgugaugcugcacaacagcgagcagggcgggcgggccuacaagcacgcgauggaggagcugcccgacacgaucgagacccucaugcugcuggcccucaucgccguccugaccgggggcgugacccuguucuuccucuccgggcgcggccugggcaagaccagcaucgggcugcucugcgugauggccuccagcguccugcuguggauggccuccguggagccccacuggaucgcggccagcaucauccucgaguucuuccugauggugcugcucauccccgagccggaccggcagcgcacgccccaggacaaccagcuggccuacgucgugaucggccuccucuucaucauccugaccguggccgccaacgagauggggcugcucgagaccaccaagaaggaccugggcaucgggcacgucgcgguggagaaccaccaccacgccacgaugcuggacguggaccuccaccccgccuccgccuggacccuguacgccgucgcgaccaccaucaucacgccgaugaugcggcacaccaucgagaacaccaccgccaacaucagccugacggccaucgccaaccaggccgcgauccucaugggccuggacaagggcuggcccaucuccaagauggacaucggggugccccugcucgcccugggcugcuacagccaggugaacccccugacccucaccgccgccguccugaugcugguggcgcacuacgccaucaucgggccgggccuccaggccaaggccacccgcgaggcccagaagcggacggcggccgggaucaugaagaaccccaccguggacggcaucgucgccaucgaccuggaccccgugguguacgacgccaaguucgagaagcagcugggccagaucaugcuccugauccugugcaccucccagauccuccugaugcgcaccacgugggcccugugcgagagcaucacccucgcgaccgggccccugaccacgcugugggagggcuccccggggaaguucuggaacaccaccaucgccgucagcauggccaacaucuuccgcggcuccuaccucgccggcgccgggcuggcguucagccugaugaagucccucggcgggggccggcgcgggaccggcgcccagggcgagacgcugggggagaaguggaagcggcagcugaaccagcucuccaagagcgaguucaacaucuacaagcgcuccggcaucauggagguggaccggagcgaggccaaggaggggcugaagcgcggcgagaccacccggcacgccgugucccgcgggaccgcgaagcugcggugguucgucgagcgcaaccuggugaagcccgagggcaaggugaucgaccucggcugcgggcggggcggguggagcuacuacugcgccggccugaagaaggucacggaggugaagggguacaccaagggcggccccgggcacgaggagcccaucccgauggccaccuacggcuggaaccuggugaagcuccacuccgggaaggacgucuucuucaucccgcccgagaagugcgacacccugcugugcgacaucggcgagagcucccccaacccgacgaucgaggaggggcgcacccuccgggugcugaagaugguggagcccuggcugcgcggcaaccaguucugcaucaagauccucaaccccuacaugcccagcgucguggagacccuggagcagaugcagcggaagcacggcgggaugcuggugcgcaacccgcucucccggaacagcacccacgagauguacugggucuccugcggcaccgggaacaucgugagcgccgugaacaugacgucccgcaugcugcugaaccgguucaccauggcccaccgcaagcccaccuacgagcgcgacgucgaccucggcgcgggcacccggcacguggccguggagcccgaggucgccaaccuggacaucaucgggcagcgcaucgagaacaucaagcacgagcacaagagcacguggcacuacgacgaggacaaccccuacaagaccugggccuaccacggcuccuacgaggugaagccgagcggguccgccagcagcauggucaacggcguggugaagcugcucaccaagcccugggacgucauccccauggugacccagaucgcgaugacggacaccacccccuucgggcagcagcggguguucaaggagaaggucgacacccgcacgccgaaggccaagcggggcaccgcccagaucauggaggugaccgcccgcuggcuguggggcuuccugucccggaacaagaagccccgcaucugcacccgggaggaguucacgcgcaaggugcggagcaacgccgcgaucggggccgucuucguggacgagaaccaguggaacuccgccaaggaggccguggaggacgagcgcuucugggaccucguccagaaggagcgggagcugcacaagcagggcaagugcgcgaccugcguguacaacaugauggggaagcgcgagaagaagcugggcgaguucgggaaggccaagggcagccgggccaucugguacauguggcucggcgcccgcuuccuggaguucgaggcccugggguucaugaacgaggaccacugguucucccgggagaacagccucuccggcguggagggggagggccugcacaagcugggguacauccuccgcgacaucagcaagauccccggcggcaacauguacgcggacgacaccgccgggugggacacccggaucacggaggacgaccugcagaacgaggccaagaucaccgacaucauggagccggagcacgcccugcucgccaccuccaucuucaagcugaccuaccagaacaaggucgugcgcgugcagcggcccgcgaagaacggcacggucauggacgugaucagccgccgcgaccagcggggguccggccaggugggcaccuacgggcugaacaccuucaccaacauggaggcccagcucauccgccagauggagagcgagggcaucuuccugcccuccgagcuggagacgcccaaccucgccgagcggguccuggacuggcuggagaaguacgggguggagcgccucaagcggauggccaucagcggcgacgacugcguggucaagccgaucgacgaccgcuucgccaccgcgcugaccgcccugaacgacauggggaaggugcggaaggacaucccccagugggagcccuccaagggcuggaacgacuggcagcagguccccuucugcagccaccacuuccaccagcucaucaugaaggacggccgcgagaucgucgugccgugccggaaccaggacgagcugguggggcgcgcccgggucucccagggcgccggguggagccugcgcgagaccgccugccucggcaagagcuacgcgcagauguggcagcugauguacuuccaccggcgcgaccugcggcucgccgccaacgccaucugcuccgcggugcccguggacuggguccccacgagccgcaccaccugguccauccacgcccaccaccaguggaugaccacggaggacaugcugagcguguggaaccggguguggaucgaggagaaccccuggauggaggacaagacccacgucuccagcuggggcgacgugccguaccugggcaagcgcgaggaccaguggugcggcucccucaucgggcugaccgcccgggccaccugggccagcaacauccagguggcgaucaaccagguccgccgccugaucggcaacgagaacuaccucgacuacaugaccuccaugaagcgguucaagaacgagggggaccccgagggcgcccugugguga

SEQ ID NO: 8547 - RNA, 9879 nt, Artificial Sequence
  derived and/or modified CDS sequence (opt1) from DENV-1__FJ882568__SS-prME
agcgugaccaugcugcucaugcugaugcccaccgcccuggccuuccaccucaccacccggggcggggagccccacaugaucgugaccaagcaggagcggggcaagagccugcuguucaagaccagcgcgggggugaacaugugcacccucaucgccauggaccugggcgagcugugcgaggacaccaugaccuacaagugcccccgcaucaccgaggccgagcccgacgacguggacugcuggugcaacgccaccgacaccugggugaccuacgggaccugcucccagacgggcgagcaccggcgcgacaagcggagcguggcccucgcgccccacgugggccuggggcuggagacccgcaccgagaccuggauguccagcgagggcgccuggaagcagauccagcgggucgagacgugggcccuccgccaccccggguucaccgugaucgcccuguuccuggcgcacgccaucggcaccuccaucacccagaaggggaucaucuucauccuccugaugcuggugacgcccagcauggccaugcggugcgucggcaucggcucccgcgacuucguggaggggcucagcggcgccaccuggguggacgucgugcuggagcacggguccugcgugaccaccauggccaaggacaagcccacgcuggacaucgagcuccugaagaccgaggucaccaaccccgcggugcugcggaagcucugcaucgaggccaagaucagcaacaccacgaccgacucccgcugccccacccagggcgaggccacccugauggaggagcaggacgccaacuucgugugccggcgcacggucguggaccggggcugggggaacggcugcgggcuguucggcaaggggagccucaucacgugcgccaaguucaagugcgugaccaagcuggagggcaagaucguccaguacgagaaccugaaguacuccgugaucgugaccguccacacgggcgaccagcaccagguggggaacgagagcaccgagcacggcaccaccgcgaccaucacgccccaggcccccaccuccgagauccagcucaccgacuacggggcccugacccuggacugcagcccccgcacgggccucgacuucaacgagaugguccugcugaccaugaaggagaaguccuggcucgugcacaagcagugguuccuggaccugccgcuccccuggaccagcggggccagcaccucccaggagacguggaaccggcaggaccugcuggugaccuucaagaccgcccacgcgaagaagcaggaggucguggugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgucaugugcaccggguccuucaagcucgagaaggagguggcggagacgcagcacggcaccgugcugguccagaucaaguacgagggcaccgacgcccccugcaagauccccuuccugacccaggacgagaagggggugacgcagaacggccggcugaucaccgccaacccgaucgugaccgacaaggagaagcccgucaacaucgaggccgagccgcccuucggggagagcuacaucgugaucggcgcgggcgagaaggcccucaagcuguccugguucaagaaggggagcuccaucggcaagauguucgaggccaccgcccgcggggcccggcgcauggcgauccugggcgacacggccugggacuucgggagcaucggcggcguguucaccuccgucgggaagcucgugcaccagaucuucggcaccgccuacggggugcuguucagcggcgucuccuggaccaugaagaucgggaucggcgugcugcucacguggcugggccugaacagccgcuccaccagccucuccaugaccugcaucgccguggggcuggucacccuguaccucggcgugauggugcaggccgacagcgggugcgucaucaacuggaagggccgggagcugaagugcggguccggcaucuucgugacgaacgaggugcacaccuggaccgagcaguacaaguuccaggcggacagcccgaagcgccugagcgccgccaucggcaaggccugggaggagggggucugcggcauccgguccgccacccgccucgagaacaucauguggaagcagaucagcaacgagcugaaccacauccugcucgagaacgggaugaaguucaccgugguggucggcgacgugguggggauccuggcgcagggcaagaagaugauccggccccagcccauggagcacaaguacuccuggaaguccuggggcaaggccaagaucaucggggccgacguccagaacacgaccuucaucaucgacggccccaacaccccggagugccccgacgaccagcgcgccuggaacaucugggagguggaggacuacggguucggcaucuucaccacgaacaucuggcugaagcuccgggacuccuacacccaggugugcgaccaccgccugaugagcgcggccaucaaggacuccaaggccguccacgccgacaugggcuacuggaucgagagcgagaagaacgagaccuggaagcuggcccgggcguccuucaucgaggugaagaccugcaucuggcccaagagccacacgcucugguccaacggggugcuggagagcgagaugaucauccccaagaucuacggcgggccgaucucccagcacaacuaccgccccggcuacuucacccagaccgccgggcccuggcaccugggcaagcucgagcuggacuucgaccugugcgagggcaccacggucgugguggacgagcacugcgggaaccggggcccgagccuccgcaccaccaccgucacggggaagaucauccacgaguggugcugccgguccugcacccugccgccccugcgcuucaagggcgaggacgggugcugguacggcauggagauccggcccgugaaggagaaggaggagaaccucgucaagagcauggucuccgccggcagcggggagguggacagcuucucccugggccugcucugcaccagcaucaugaucgaggaggugaugcgcucccgguggagccgcaagaugcugaugaccgggacgcuggccgucuuccuccugcugaucaugggccagcucaccuggaacgaccugauccggcugugcaucauggugggggccaacgcguccgaccgcaugggcaugggcaccaccuaccucgcccugauggccacguucaagaugcgcccgauguucgccguggggcuccuguuccggcgccugaccagccgggagguccugcuccugaccaucgggcugucccucguggccagcgucgagcugcccaacucccuggaggagcucggggacggccuggcgaugggcaucaugauccugaagcuccugaccgacuuccagagccaccagcugugggccacgcuccugucccugaccuucaucaagaccacccucagccugcacuacgccuggaagacgauggccauggugcuguccaucgugagccucuucccccugugccuguccaccaccagccagaagaccacguggcuccccguccugcuggggucccucggcugcaagccgcugaccauguuccugaucgcggagaacaagaucugggggcgcaagagcuggccccucaacgagggcaucauggccguggggguggucuccauccugcugagcagccuccugaagaacgacgugccccuggccggcccccucaucgccggcgggaugcugaucgccugcuacgugaucuccggcagcuccgcggaccugagccucgagaaggccgccgaggucuccugggaggaggaggccgagcacagcggggccucccacaacauccugguggaggugcaggacgacggcaccaugaagaucaaggacgaggagcgggacgacacccugaccauccuccugaaggcgacgcugcucgccgucagcgggguguacccgcuguccauccccgccacccuguucgugugguacuucuggcagaagaagaagcagcgcagcggcguccugugggacacccccagcccgcccgagguggagcgggccgugcucgacgacggcaucuaccgcaucaugcagcgggggcugcugggccgcagccaggucggggugggcguguuccaggagaacgucuuccacaccauguggcacgugacgcgcggggccgugcucauguaccagggcaagcgccuggagcccuccugggcgagcgucaagaaggaccugaucuccuacggcgggggcuggcggcuccaggggagcuggaacaccggcgaggagguccaggugaucgccgucgagcccgggaagaaccccaagaacgugcagaccgcccccggcaccuucaagacgcccgagggcgaggugggggccaucgcccuggacuucaagcccggcaccuccgggagccccaucgucaaccgcgagggcaagaucgugggccuguacgggaacggcguggucaccaccuccgggacguacgugagcgcgaucgcccaggccaaggccagccaggagggcccgcuccccgagaucgaggacgagguguuccggaagcgcaaccugaccaucauggaccugcaccccggguccggcaagacccggcgcuaccucccggcgaucguccgggaggccaucaagcgcaagcugcggacccugauccucgcccccacgcgcgugguggccagcgagauggccgaggcgcugaagggcaugcccauccgcuaccagaccaccgccgucaaguccgagcacaccgggaaggagaucguggaccugaugugccacgccacguucaccaugcggcuccugagccccgugcgcgucccgaacuacaacaugaucaucauggacgaggcccacuucaccgaccccuccagcaucgccgcgcggggcuacaucuccacccgcguggggaugggcgaggccgccgccaucuucaugacggccacgccgcccgggagcguggaggcguucccgcaguccaacgccgucauccaggacgaggagcgggacauccccgagcgcagcuggaacuccggcuacgaguggaucaccgacuuccccggcaagaccgugugguucgugcccagcaucaaguccgggaacgacaucgccaacugccugcggaagaacggcaagcgcgucauccagcucagccggaagacguucgacaccgaguaccagaagaccaagaacaacgacugggacuacguggugaccacggacaucuccgagaugggggccaacuuccgcgcggaccgggucaucgacccgcgccggugccugaagcccgugauccugaaggacggccccgagcgcgucauccucgccgggcccaugccggugaccguggccagcgccgcccagcggcgcggccggaucggccgcaaccacaacaaggagggggaccaguacaucuacaugggccagccccugaacaacgacgaggaccacgcgcacuggaccgaggccaagaugcugcucgacaacaucaacacccccgaggggaucauccccgcccuguucgagccggagcgggagaaguccgccgccaucgacggcgaguaccgccugcgcggggaggcgcggaagacguucgucgagcucaugcgccggggcgaccugcccguguggcugagcuacaagguggccuccgagggcuuccaguacagcgaccgccgguggugcuucgacggggagcgcaacaaccagguccucgaggagaacauggacguggagaucuggaccaaggagggcgagcggaagaagcugcgcccccgguggcuggacgcccgcaccuacagcgacccccucgcccugcgggaguucaaggaguucgccgcggggcgccgguccgugagcggcgaccugauccucgagaucggcaagcugccgcagcaccugacccagcgcgcccagaacgcccucgacaaccuggucaugcugcacaacuccgagcagggcgggcgggccuaccgccacgcgauggaggagcuccccgacacgaucgagacccugaugcugcucgcccugaucgccgugcugaccgggggcgugacccucuucuuccugagcgggcggggccugggcaagaccuccaucgggcuccugugcgucauggccagcuccgugcugcucuggauggccagcguggagccccacuggaucgcggccuccaucauccuggaguucuuccugaugguccuccugauccccgagccggaccgccagcggacgccccaggacaaccagcuggccuacguggugaucggccuccuguucaucauccugaccgucgccgccaacgagauggggcuccuggagaccaccaagaaggaccugggcaucgggcacguggcgguggagaaccaccaccacgccacgaugcucgacgucgaccugcaccccgccagcgccuggacccuguacgccguggcgaccaccaucaucacgccgaugaugcgccacaccaucgagaacaccaccgccaacaucucccucacggccaucgccaaccaggccgcgauccugaugggccuggacaagggcuggcccaucagcaagauggacaucggggugccccuccuggcccugggcugcuacucccaggucaacccccucacccugaccgccgccgugcugaugcucguggcgcacuacgccaucaucgggccgggccugcaggccaaggccacccgggaggcccagaagcgcacggcggccgggaucaugaagaaccccaccgucgacggcaucguggccaucgaccuggaccccguggucuacgacgccaaguucgagaagcagcucggccagaucaugcugcugauccucugcaccagccagauccugcugaugcgcaccacgugggcccucugcgaguccaucacccuggcgaccgggccccugaccacgcucugggagggcagcccggggaaguucuggaacaccaccaucgccguguccauggccaacaucuuccggggcagcuaccuggccggcgccgggcuggcguucucccucaugaagucccugggcgggggccgccgggggaccggcgcccagggcgagacgcugggggagaaguggaagcgccagcucaaccagcugagcaaguccgaguucaacaucuacaagcggagcggcaucauggagguggaccgcuccgaggccaaggaggggcugaagcggggcgagaccacccgccacgccgucagccgggggaccgcgaagcugcgcugguucguggagcggaaccucgugaagcccgagggcaaggucaucgaccugggcugcgggcgcggcgggugguccuacuacugcgccggccugaagaaggugacggaggugaagggguacaccaagggcggccccgggcacgaggagcccaucccgauggccaccuacggcuggaaccucgucaagcugcacagcgggaaggacguguucuucacgccgcccgagaagugcgacacgcugcucugcgacaucggcgaguccagccccaacccgaccaucgaggaggggcggacccugcgcgugcugaagauggucgagcccuggcuccggggcaaccaguucugcaucaagauccugaaccccuacaugcccuccgugguggagacccuggagcagaugcagcgcaagcacggcgggaugcucguccggaacccgcugagccgcaacuccacccacgagauguacugggugagcugcggcacggggaacaucguguccgccgucaacaugaccagccggaugcugcucaaccgcuucaccauggcccaccgcaagcccaccuacgagcgggacguggaccugggcgcgggcacgcgccacguggccgucgagcccgagguggccaaccuggacaucaucgggcagcggaucgagaacaucaagcacgagcacaaguccaccuggcacuacgacgaggacaaccccuacaagaccugggccuaccacggcagcuacgaggucaagccguccgggagcgccuccagcauggugaacggcguggucaagcuccugaccaagcccugggacgugauccccauggugacgcagaucgcgaugaccgacaccacccccuucgggcagcagcgcgucuucaaggagaagguggacacgcggaccccgaaggccaagcgcggcaccgcccagaucauggaggugaccgcccgguggcuguggggcuuccucagccgcaacaagaagccccggaucugcacgcgcgaggaguucacccggaagguccgcuccaacgccgcgaucggggccguguucguggacgagaaccaguggaacagcgccaaggaggccgucgaggacgagcgguucugggaccuggugcagaaggagcgcgagcugcacaagcagggcaagugcgcgaccugcguguacaacaugauggggaagcgggagaagaagcucggcgaguucgggaaggccaagggcucccgcgccaucugguacauguggcugggcgcccgguuccuggaguucgaggcccucggguucaugaacgaggaccacugguucagccgcgagaacucccugagcggcgucgagggggagggccugcacaagcucggguacauccugcgggacaucuccaagauccccggcggcaacauguacgcggacgacaccgccgggugggacacgcgcaucaccgaggacgaccugcagaacgaggccaagaucaccgacaucauggagccggagcacgcccuccuggccaccagcaucuucaagcugacguaccagaacaagguggugcggguccagcgccccgcgaagaacggcaccgugauggacgugaucucccgccgggaccagcgcgggagcggccaggucggcaccuacgggcucaacaccuucacgaacauggaggcccagcugauccggcagauggaguccgagggcaucuuccugcccagcgagcucgagacccccaaccuggccgagcgcgugcuggacuggcucgagaaguacgggguggagcggcugaagcgcauggccaucuccggcgacgacugcgucgugaagccgaucgacgaccgguucgccaccgcgcugaccgcccucaacgacauggggaaggugcgcaaggacaucccccagugggagcccagcaagggcuggaacgacuggcagcagguccccuucugcucccaccacuuccaccagcugaucaugaaggacggccgggagaucguggugccgugccgcaaccaggacgagcuggucgggcgggcccgcgugagccagggcgccggguggucccuccgggagacggccugccugggcaagagcuacgcgcagauguggcagcugauguacuuccaccgccgggaccuccgccuggccgccaacgccaucugcagcgcggugcccgucgacugggugcccaccucccggaccaccuggagcauccacgcccaccaccaguggaugacgaccgaggacaugcuguccguguggaaccgcgucuggaucgaggagaaccccuggauggaggacaagacccacgugagcuccuggggcgacgugccguaccucggcaagcgggaggaccaguggugcggcagccugaucgggcugaccgcccgcgccaccugggccuccaacauccaggucgcgaucaaccaggugcgccggcucaucggcaacgagaacuaccuggacuacaugacgagcaugaagcgcuucaagaacgagggggaccccgagggcgcccugugguga

SEQ ID NO: 8548 - RNA, 9879 nt, Artificial Sequence
  derived and/or modified CDS sequence (opt1) from DENV-1__FJ882569__SS-prME
agcgugaccaugcugcucaugcugaugcccaccgcccuggccuuccaccucaccacccggggcggggagccccacaugaucgugaccaagcaggagcggggcaagagccugcuguucaagaccagcgcgggggugaacaugugcacccucaucgccauggaccugggcgagcugugcgaggacaccaugaccuacaagugcccccgcaucaccgaggccgagcccgacgacguggacugcuggugcaacgccaccgacaccugggugaccuacgggaccugcagccagacgggcgagcaccggcgcgacaagcggagcguggcccucgcgccccacgugggccuggggcuggagacccgcaccgagaccuggauguccagcgagggcgccuggaagcagauccagcggguggagacgugggcccuccgccaccccggguucaccgugaucgcccuguuccuggcgcacgccaucggcaccuccaucacccagaaggggaucaucuucauccuccugaugcuggugacgcccagcauggccaugcggugcgucggcaucggcucccgcgacuucguggaggggcucagcggcgccaccuggguggacgucgugcuggagcacggguccugcgugaccaccauggccaaggacaagcccacgcuggacaucgagcuccugaagaccgaggucaccaaccccgcggugcugcggaagcucugcaucgaggccaagaucagcaacaccacgaccgacucccgcugccccacccagggcgaggccacccugauggaggagcaggacgccaacuucgugugccggcgcacguucgucgaccggggcugggggaacggcugcgggcuguucggcaaggggagccucaucacgugcgccaaguucaagugcgugaccaagcuggagggcaagaucgugcaguacgagaaccugaaguacuccgucaucgugaccgugcacacgggcgaccagcaccaggucgggaacgagagcaccgagcacggcaccaccgcgaccaucacgccccaggcccccaccuccgagauccagcucaccgacuacggggcccugacccuggacugcagcccccgcacgggccucgacuucaacgagauggugcugcugaccaugaaggagaaguccuggcucguccacaagcagugguuccuggaccugccgcuccccuggaccagcggggccagcaccucccaggagacguggaaccggcaggaccugcuggugaccuucaagaccgcccacgcgaagaagcaggagguggucgugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgugaugugcaccggguccuucaagcucgagaaggaggucgcggagacgcagcacggcaccgugcuggugcagaucaaguacgagggcaccgacgcccccugcaagauccccuucagcacccaggacgagaagggggucacgcagaacggccggcugaucaccgccaacccgaucgugaccgacaaggagaagcccgugaacaucgaggccgagccgcccuucggggaguccuacaucgucaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcguggggaagcugguccaccagaucuucggcaccgccuacgggguccuguucuccggcgugagcuggaccaugaagaucgggaucggcguccugcugacguggcucggccugaacucccgcagcaccucccugagcaugaccugcaucgccguggggcucgugacccuguaccugggcgucauggugcaggccgacuccgggugcgugaucaacuggaagggccgggagcucaagugcgggagcggcaucuucgucacgaacgaggugcacaccuggaccgagcaguacaaguuccaggcggacagcccgaagcgccuguccgccgccaucggcaaggccugggaggagggggugugcggcauccggagcgccacccgccuggagaacaucauguggaagcagaucuccaacgagcucaaccacauccugcuggagaacgggaugaaguucaccgucguggugggcgacgucguggggauccucgcgcagggcaagaagaugauccggccccagcccauggagcacaaguacagcuggaaguccuggggcaaggccaagaucaucggggccgacgugcagaacacgaccuucaucaucgacggccccaacaccccggagugccccgacgaccagcgcgccuggaacaucugggaggucgaggacuacggguucggcaucuucaccacgaacaucuggcugaagcugcgggacagcuacacccaggugugcgaccaccgccucauguccgcggccaucaaggacagcaaggccgugcacgccgacaugggcuacuggaucgaguccgagaagaacgagaccuggaagcuggcccgggcgagcuucaucgaggucaagaccugcaucuggcccaagucccacacgcuguggagcaacggggugcucgaguccgagaugaucauccccaagaucuacggcgggccgaucagccagcacaacuaccgccccggcuacuucacccagaccgccgggcccuggcaccugggcaagcuggagcucgacuucgaccugugcgagggcaccacgguggucguggacgagcacugcgggaaccggggcccgucccugcgcaccaccaccgugacggggaagaucauccacgaguggugcugccggagcugcacccugccgccccuccgcuucaagggcgaggacgggugcugguacggcauggagauccggcccgucaaggagaaggaggagaaccuggugaaguccauggugagcgccggcagcggggaggucgacuccuucagccucggccugcugugcaccuccaucaugaucgaggaggugaugcgcagccgguggucccgcaagaugcucaugaccgggacgcuggccguguuccugcuccugaucaugggccagcugaccuggaacgaccucauccggcugugcaucauggucggggccaacgcgagcgaccgcaugggcaugggcaccaccuaccuggcccucauggccacguucaagaugcgcccgauguucgccguggggcugcuguuccggcgccucaccucccgggaggugcugcugcucaccaucgggcugagccuggucgccuccguggagcuccccaacagccuggaggagcugggggacggccucgcgaugggcaucaugauccugaagcugcucaccgacuuccagucccaccagcugugggccacgcugcucagccugaccuucaucaagaccacccugucccuccacuacgccuggaagacgauggccaugguccugagcaucgugucccuguucccccucugccugagcaccaccucccagaagaccacguggcugcccgugcuccuggggagccugggcugcaagccgcucaccauguuccugaucgcggagaacaagaucugggggcgccgguccuggccccugaacgagggcaucauggccgucgggguggugagcauccuccugagcucccugcucaagaacgacgucccccuggccggcccccugaucgccggcgggaugcucaucgccugcuacgugaucagcggcuccagcgcggaccugucccuggagaaggccgccgaggugagcugggaggaggaggccgagcacuccggggccagccacaacauccucgucgaggugcaggacgacggcaccaugaagaucaaggacgaggagcgcgacgacacccugaccauccugcucaaggcgacgcugcuggccguguccggggucuacccgcucagcauccccgccacccuguucgugugguacuucuggcagaagaagaagcagcgguccggcgugcugugggacacccccagcccgcccgaggucgagcgcgccgugcuggacgacggcaucuaccggaucaugcagcgcgggcuccugggccggucccaggugggggucggcguguuccaggagaacguguuccacaccauguggcacgucacgcgcggggccgugcugauguaccagggcaagcggcucgagcccagcugggcguccgugaagaaggaccugaucagcuacggcgggggcuggcgccugcagggguccuggaacaccggcgaggagguccaggugaucgccguggagcccgggaagaaccccaagaacguccagaccgcccccggcaccuucaagacgcccgagggcgaggugggggccaucgcccucgacuucaagcccggcaccagcgggucccccaucgugaaccgggagggcaagaucgucggccuguacgggaacggcguggugaccaccagcgggacguacgucagcgcgaucgcccaggccaaggccucccaggagggcccgcugcccgagaucgaggacgagguguuccgcaagcggaaccucaccaucauggaccugcaccccgggagcggcaagacccgccgguaccugccggcgaucgugcgcgaggccaucaagcggaagcuccgcacccugauccuggcccccacgcgcgucguggccuccgagauggccgaggcgcucaagggcaugcccauccgguaccagaccaccgccgucaagagcgagcacaccgggaaggagaucgucgaccugaugugccacgccacguucaccaugcgccugcucucccccgugcgggugccgaacuacaacaugaucaucauggacgaggcccacuucaccgaccccagcuccaucgccgcgcgcggcuacaucagcacccgggucgggaugggcgaggccgccgccaucuucaugacggccacgccgcccggguccguggaggcguucccgcagagcaacgccgugauccaggacgaggagcgcgacauccccgagcgguccuggaacagcggcuacgaguggaucaccgacuuccccggcaagaccgucugguucgugcccuccaucaagagcgggaacgacaucgccaacugccugcgcaagaacggcaagcgggugauccagcugucccgcaagacguucgacaccgaguaccagaagaccaagaacaacgacugggacuacgucgugaccacggacaucagcgagaugggggccaacuuccgggcggaccgcgugaucgacccgcggcgcugccucaagcccgucauccugaaggacggccccgagcgggugauccuggccgggcccaugccggucaccguggccuccgccgcccagcgccggggccgcaucggccggaaccacaacaaggagggggaccaguacaucuacaugggccagccccucaacaacgacgaggaccacgcgcacuggaccgaggccaagaugcugcuggacaacaucaacacccccgaggggaucauccccgcccucuucgagccggagcgcgagaaguccgccgccaucgacggcgaguaccgccugcgcggggaggcgcgcaagacguucguggagcugaugcggcgcggcgaccuccccgucuggcuguccuacaagguggccagcgagggcuuccaguacagcgaccggcgcuggugcuucgacggggagcggaacaaccaggugcuggaggagaacauggacgucgagaucuggaccaaggagggcgagcgcaagaagcuccggccccgcuggcuggacgcccggaccuacuccgacccccuggcccuccgcgaguucaaggaguucgccgcggggcggcgcagcguguccggcgaccugauccuggagaucggcaagcucccgcagcaccugacccagcgggcccagaacgcccuggacaaccucgugaugcugcacaacagcgagcagggcgggcgcgccuaccggcacgcgauggaggagcugcccgacacgaucgagacccucaugcugcuggcccucaucgccguccugaccgggggcgugacccuguucuuccucuccgggcgcggccugggcaagaccagcaucgggcugcucugcgugauggccuccagcguccugcuguggauggccuccguggagccccacuggaucgcggccagcaucauccucgaguucuuccugauggugcugcucauccccgagccggaccggcagcgcacgccccaggacaaccagcuggccuacgucgugaucggccuccucuucaugauccugaccguggccgccaacgagauggggcugcucgagaccaccaagaaggaccugggcaucgggcacgucgcgguggagaaccaccaccacgccacgaugcuggacguggaccuccaccccgccuccgccuggacccuguacgccgucgcgaccaccaucaucacgccgaugaugcggcacaccaucgagaacaccaccgccaacaucagccugacggccaucgccaaccaggccgcgauccucaugggccuggacaagggcuggcccaucuccaagauggacaucggggugccccugcucgcccugggcugcuacagccaggugaacccccugacccucaccgccgccguccugaugcugguggcgcacuacgccaucaucgggccgggccuccaggccaaggccacccgcgaggcccagaagcgcacggcggccgggaucaugaagaaccccaccguggacggcaucgucgccaucgaccuggaccccgugguguacgacgccaaguucgagaagcagcugggccagaucaugcuccugauccugugcaccucccagauccuccugaugcggaccacgugggcccugugcgagagcaucacccucgcgaccgggccccugaccacgcugugggagggcuccccggggaaguucuggaacaccaccaucgccgucagcauggccaacaucuuccgcggcuccuaccucgccggcgccgggcuggcguucagccugaugaagucccucggcgggggccggcgcgggaccggcgcccagggcgagacgcugggggagaaguggaagcggcagcugaaccagcucuccaagagcgaguucaacaucuacaagcgcuccggcaucauggagguggaccggagcgaggccaaggaggggcugaagcgcggcgagaccacccggcacgccgugucccgcgggaccgcgaagcugcggugguucgucgagcgcaaccuggugaagcccgagggcaaggugaucgaccucggcugcgggcggggcggguggagcuacuacugcgccggccugaagaaggucacggaggugaagggguacaccaagggcggccccgggcacgaggagcccaucccgauggccaccuacggcuggaaccuggugaagcuccacuccgggaaggacgucuucuucacgccgcccgagaagugcgacacgcugcugugcgacaucggcgagagcucccccaacccgaccaucgaggaggggcgcacccuccgggugcugaagaugguggagcccuggcugcgcggcaaccaguucugcaucaagauccucaaccccuacaugcccagcgucguggagacccuggagcagaugcagcggaagcacggcgggaugcuggugcgcaacccgcucucccggaacagcacccacgagauguacugggucuccugcggcacggggaacaucgugagcgccgugaacaugaccucccgcaugcugcugaaccgcuucaccauggcccaccggaagcccaccuacgagcgcgacgucgaccucggcgcgggcacgcggcacguggccguggagcccgaggucgccaaccuggacaucaucgggcagcgcaucgagaacaucaagcacgagcacaagagcaccuggcacuacgacgaggacaaccccuacaagaccugggccuaccacggcuccuacgaggugaagccgagcggguccgccagcagcauggucaacggcguggugaagcugcucaccaagcccugggacgucauccccauggugacgcagaucgcgaugaccgacaccacccccuucgggcagcagcggguguucaaggagaaggucgacacgcgcaccccgaaggccaagcggggcaccgcccagaucauggaggugaccgcccgcuggcuguggggcuuccugucccggaacaagaagccccgcaucugcacgcgggaggaguucacccgcaaggugcggagcaacgccgcgaucggggccgucuucguggacgagaaccaguggaacuccgccaaggaggccguggaggacgagcgcuucugggaccucguccagaaggagcgggagcugcacaagcagggcaagugcgcgaccugcguguacaacaugauggggaagcgcgagaagaagcugggcgaguucgggaaggccaagggcagccgggccaucugguacauguggcucggcgcccgcuuccuggaguucgaggcccugggguucaugaacgaggaccacugguucucccgggagaacagccucuccggcguggagggggagggccugcacaagcugggguacauccuccgcgacaucagcaagauccccggcggcaacauguacgcggacgacaccgccgggugggacacgcggaucaccgaggacgaccugcagaacgaggccaagaucaccgacaucauggagccggagcacgcccugcucgccaccuccaucuucaagcugacguaccagaacaaggucgugcgcgugcagcgccccgcgaagaacggcaccgucauggacgugaucagccggcgcgaccagcggggguccggccaggugggcaccuacgggcugaacaccuucacgaacauggaggcccagcucauccgccagauggagagcgagggcaucuuccugcccuccgagcuggagacccccaaccucgccgagcggguccuggacuggcuggagaaguacgggguggagcgccucaagcggauggccaucagcggcgacgacugcguggucaagccgaucgacgaccgcuucgccaccgcgcugaccgcccugaacgacauggggaaggugcggaaggacaucccccagugggagcccuccaagggcuggaacgacuggcagcagguccccuucugcagccaccacuuccaccagcucaucaugaaggacggccgcgagaucgucgugccgugccggaaccaggacgagcugguggggcgcgcccgggucucccagggcgccggguggagccugcgcgagacggccugccucggcaagagcuacgcgcagauguggcagcugauguacuuccaccggcgcgaccugcggcucgccgccaacgccaucugcuccgcggugcccguggacuggguccccaccagccgcaccaccugguccauccacgcccaccaccaguggaugacgaccgaggacaugcugagcguguggaaccggguguggaucgaggagaaccccuggauggaggacaagacccacgucuccagcuggggcgacgugccguaccugggcaagcgcgaggaccaguggugcggcucccucaucgggcugaccgcccgcgccaccugggccagcaacauccagguggcgaucaaccagguccggcgccugaucggcaacgagaacuaccucgacuacaugacguccaugaagcgguucaagaacgagggggaccccgagggcgcccugugguga

SEQ ID NO: 8549 - RNA, 9879 nt, Artificial Sequence
  derived and/or modified CDS sequence (opt1) from DENV-1__GQ199833__SS-prME
agcgugaccaugcugcucaugcugaugcccaccgcccuggccuuccaccucaccacccgcggcggggagccccacaugaucgugaccaagcaggagcggggcaagagccugcuguucaagaccagcgcgggggugaacaugugcacccucaucgccauggaccugggcgagcugugcgaggacaccaugaccuacaagugcccccggaucaccgaggccgagcccgacgacguggacugcuggugcaacgccaccgacaccugggugaccuacgggaccugcagccagacgggcgagcaccggcgcgaccggcgcagcguggcccucgcgccccacgugggccuggggcuggagacccggaccgagaccuggauguccagcgagggcgccuggaagcagauccagcgcguggagacgugggcccuccggcaccccggguucaccgugaucgcccuguuccuggcgcacgccaucggcaccuccaucacccagaaggggaucaucuucauccuccugaugcuggugacgcccagcauggccaugcgcugcgucggcaucggcucccgggacuucguggaggggcucagcggcgccaccuggguggacgucgugcuggagcacggguccugcgugaccaccauggccaaggacaagcccacgcuggacaucgagcuccugaagaccgaggucaccaaccccgcggugcugcgcaagcucugcaucgaggccaagaucagcaacaccacgaccgacucccggugccccacccagggcgaggccacccugauggaggagcaggacgccaacuucgugugccgccggacguucgucgaccgcggcugggggaacggcugcgggcuguucggcaaggggagccucaucacgugcgccaaguucaagugcgugaccaagcuggagggcaagaucgugcaguacgagaaccugaaguacuccgucaucgugaccgugcacacgggcgaccagcaccaggucgggaacgagagcaccgagcacggcaccaccgcgaccaucacgccccaggcccccaccuccgagauccagcucaccgacuacggggcccugacccuggacugcagcccccggacgggccucgacuucaacgagauggugcugcugaccaugaaggggaaguccuggcucguccacaagcagugguuccuggaccugccgcuccccuggaccagcggcgccagcaccucccaggagacguggaaccgccaggaccugcuggugaccuucaagaccgcccacgcgaagaagcaggagguggucgugcucggcagccaggagggggccaugcacaccgcccugacgggcgccaccgagauccagaccuccgggaccacgaccaucuucgccggccaccugaagugccggcucaagauggacaagcugacccugaaggggaugagcuacgugaugugcaccggcuccuucaagcucgagaaggaggucgcggagacgcagcacggcaccgugcuggugcagaucaaguacgaggggaccgacgcccccugcaagauccccuucagcacccaggacgagaagggcgucacgcagaacgggcgccugaucaccgccaacccgaucgugaccgacaaggagaagcccgugaacaucgaggccgagccgcccuucggcgaguccuacaucgucaucggcgcgggggagaaggcccugaagcucagcugguucaagaagggcuccagcaucgggaagauguucgaggccaccgcccggggcgcccgccgcauggcgauccugggggacacggccugggacuucggcuccaucggcgggguguucaccagcgugggcaagcugguccaccagaucuucgggaccgccuacggcguccuguucuccggggugagcuggaccaugaagaucggcaucggcguccugcugacguggcucgggcugaacucccggagcaccucccugagcaugaccugcaucgccgugggccucgugacccuguaccugggggucauggugcaggccgacuccggcugcgugaucaacuggaaggggcgcgagcucaagugcggcagcggcaucuucgucacgaacgaggugcacaccuggaccgagcaguacaaguuccaggcggacagcccgaagcggcuguccgccgccaucgggaaggccugggaggagggcgugugcgggauccgcagcgccacccggcuggagaacaucauguggaagcagaucuccaacgagcucaaccacauccugcuggagaacggcaugaaguucaccgucguggugggggacgucgugggcauccucgcgcagggcaagaagaugauccgcccccagcccauggagcacaaguacagcuggaaguccugggggaaggccaagaucaucggcgccgacgugcagaacacgaccuucaucaucgacgggcccaacaccccggagugccccgacgaccagcgggccuggaacaucugggaggucgaggacuacggcuucggcaucuucaccacgaacaucuggcugaagcugcgcgacagcuacacccaggugugcgaccaccggcucauguccgcggccaucaaggacagcaaggccgugcacgccgacaugggguacuggaucgaguccgagaagaacgagaccuggaagcuggcccgcgcgagcuucaucgaggucaagaccugcaucuggcccaagucccacacgcuguggagcaacggcgugcucgaguccgagaugaucauccccaagaucuacgggggcccgaucagccagcacaacuaccggcccggguacuucacccagaccgccggccccuggcaccugggcaagcuggagcucgacuucgaccugugcgaggggaccacgguggucguggacgagcacugcggcaaccgcgggccgucccugcggaccaccaccgugacgggcaagaucauccacgaguggugcugccgcagcugcacccugccgccccuccgguucaagggggaggacggcugcugguacggcauggagauccgccccgucaaggagaaggaggagaaccuggugaaguccauggugagcgccgggagcggcgaggucgacuccuucagccucgggcugcugugcaucuccaucaugaucgaggaggugaugcggagccgcuggucccggaagaugcucaugaccggcacccuggccguguuccugcuccugaucauggggcagcugacguggaacgaccucauccgccugugcaucauggucggcgccaacgcgagcgaccgcaugggcauggggaccaccuaccuggcccucauggccaccuucaagaugcggccgauguucgccgugggccugcuguuccgccggcucacgucccgcgaggugcugcugcucaccaucgggcugagccuggucgccuccguggagcuccccaacagccuggaggagcugggcgacggccucgcgauggggaucaugauccugaagcugcucaccgacuuccagucccaccagcugugggccacccugcucagccugacguucaucaagaccacccugucccuccacuacgccuggaagaccauggccaugguccugagcaucgugucccuguucccccucugccugagcacgaccucccagaagaccaccuggcugcccgugcuccugggcagccuggggugcaagccgcucacgauguuccugaucgcggagaacaagaucuggggccggaaguccuggccccugaacgaggggaucauggccgucggcguggugagcauccuccugagcucccugcucaagaacgacgucccccuggccggcccccugaucgccgggggcaugcucaucgccugcuacgugaucagcggguccagcgcggaccugucccuggagaaggccgccgaggugagcugggaggaggaggccgagcacuccggcgccagccacaacauccucgucgaggugcaggacgacgggaccaugaagaucaaggacgaggagcgcgacgacacccugaccauccugcucaaggcgacccugcuggccguguccggcgucuacccgcucagcauccccgccacgcuguucgugugguacuucuggcagaagaagaagcagcgguccggcgugcugugggacacccccagcccgcccgaggucgagcgcgccgugcuggacgacgggaucuaccggaucaugcagcgcggccuccuggggcggucccaggugggcgucgggguguuccaggagaacguguuccacaccauguggcacgucacccgcggcgccgugcugauguaccagggcaagcggcucgagcccagcugggcguccgugaagaaggaccugaucagcuacgggggcggguggcgccugcagggcuccuggaacacgggggaggagguccaggugaucgccguggagcccggcaagaaccccaagaacguccagaccgcccccggcaccuucaagacccccgagggggaggugggcgccaucgcccucgacuucaagcccgggacgagcggcucccccaucgugaaccgggagggcaagaucgucgggcuguacggcaacgggguggugaccaccagcggcaccuacgucagcgcgaucgcccaggccaaggccucccaggaggggccgcugcccgagaucgaggacgagguguuccgcaagcggaaccucacgaucauggaccugcaccccggcagcggcaagacccgccgguaccugccggcgaucgugcgcgaggccaucaagcggaagcuccgcacccugauccuggcccccacccgcgucguggccuccgagauggccgaggcgcucaaggggaugcccauccgguaccagacgaccgccgucaagagcgagcacaccggcaaggagaucgucgaccugaugugccacgccaccuucacgaugcgccugcucucccccgugcgggugccgaacuacaacaugaucaucauggacgaggcccacuucaccgaccccagcuccaucgccgcgcgcggguacaucagcacccgggucggcaugggggaggccgccgccaucuucaugaccgccacgccgcccggcuccguggaggcguucccgcagagcaacgccgugauccaggacgaggagcgcgacauccccgagcgguccuggaacagcggcuacgaguggaucaccgacuuccccgggaagaccgucugguucgugcccuccaucaagagcggcaacgacaucgccaacugccugcgcaagaacgggaagcgggugauccagcugucccgcaagaccuucgacacggaguaccagaagaccaagaacaacgacugggacuacgucgugaccaccgacaucagcgagaugggcgccaacuuccgggcggaccgcgugaucgacccgcggcgcugccucaagcccgucauccugaaggacgggcccgagcgggugauccuggccggccccaugccggucacgguggccuccgccgcccagcgccggggccgcaucgggcggaaccacaacaaggagggcgaccaguacaucuacauggggcagccccucaacaacgacgaggaccacgcgcacuggaccgaggccaagaugcugcuggacaacaucaacacccccgagggcaucauccccgcccucuucgagccggagcgcgagaaguccgccgccaucgacggggaguaccgccugcggggcgaggcgcgcaagaccuucguggagcugaugcggcgcggcgaccuccccgucuggcuguccuacaagguggccagcgagggguuccaguacagcgaccggcgcuggugcuucgacggcgagcggaacaaccaggugcuggaggagaacauggacgucgagaucuggacgaaggagggggagcgcaagaagcuccggccccgcuggcuggacgcccggaccuacuccgacccccuggcccuccgcgaguucaaggaguucgccgcgggccggcgcagcguguccggcgaccugauccuggagaucgggaagcucccgcagcaccugacccagcgggcccagaacgcccuggacaaccucgugaugcugcacaacagcgagcagggcgggcgcgccuaccggcacgcgauggaggagcugcccgacaccaucgagacgcucaugcugcuggcccucaucgccguccugaccggcggggugacccuguucuuccucuccggccgcggccuggggaagaccagcaucggccugcucugcgugauggccuccagcguccugcuguggauggccuccguggagccccacuggaucgcggccagcaucauccucgaguucuuccugauggugcugcucauccccgagccggaccggcagcgcacgccccaggacaaccagcuggccuacgucgugaucgggcuccucuucaugauccugacgguggccgccaacgagaugggccugcucgagaccaccaagaaggaccuggggaucggccacgucgcgguggagaaccaccaccacgccaccaugcuggacguggaccuccaccccgccuccgccuggacgcuguacgccgucgcgaccaccaucaucaccccgaugaugcggcacacgaucgagaacaccaccgccaacaucagccugaccgccaucgccaaccaggccgcgauccucaugggccuggacaagggguggcccaucuccaagauggacaucggcgugccccugcucgcccuggggugcuacagccaggugaacccccugacgcucaccgccgccguccugaugcugguggcgcacuacgccaucaucggcccggggcuccaggccaaggccacccgcgaggcccagaagcgcaccgcggccggcaucaugaagaaccccacgguggacggcaucgucgccaucgaccuggaccccgugguguacgacgccaaguucgagaagcagcuggggcagaucaugcuccugauccugugcaccucccagauccuccugaugcggaccaccugggcccugugcgagagcaucacgcucgcgaccggcccccugaccacccugugggagggguccccgggcaaguucuggaacacgaccaucgccgucagcauggccaacaucuuccgcggcuccuaccucgccggggccggccuggcguucagccugaugaagucccucgggggcgggcggcgcggcaccggcgcccagggggagacccugggcgagaaguggaagcggcagcugaaccagcucuccaagagcgaguucaacaucuacaagcgcuccgggaucauggagguggaccggagcgaggccaaggagggccugaagcgcggggagacgacccggcacgccgugucccgcggcaccgcgaagcugcggugguucgucgagcgcaaccuggugaagcccgagggcaaggugaucgaccucgggugcggccgcggcggguggagcuacuacugcgccgggcugaagaaggucaccgaggugaagggguacacgaagggcgggcccggccacgaggagcccaucccgauggccaccuacggguggaaccuggugaagcuccacuccggcaaggacgucuucuucacgccgcccgagaagugcgacacccugcugugcgacaucggggagagcucccccaacccgacgaucgaggagggccgcacccuccgggugcugaagaugguggagcccuggcugcgcggcaaccaguucugcaucaagauccucaaccccuacaugcccagcgucguggagacccuggagcagaugcagcggaagcacgggggcaugcuggugcgcaacccgcucucccggaacagcacccacgagauguacugggucuccugcgggaccggcaacaucgugagcgccgugaacaugacgucccgcaugcugcugaaccgcuucaccauggcccaccggaagcccaccuacgagcgcgacgucgaccucggcgcggggacccggcacguggccguggagcccgaggucgccaaccuggacaucaucggccagcgcaucgagaacaucaagcacgagcacaagagcacguggcacuacgacgaggacaaccccuacaagaccugggccuaccacggguccuacgaggugaagccgagcggcuccgccagcagcauggucaacgggguggugaagcugcucaccaagcccugggacgucauccccauggugacccagaucgcgaugacggacaccacccccuucggccagcagcggguguucaaggagaaggucgacacccgcacgccgaaggccaagcggggcaccgcccagaucauggaggugaccgcccgcuggcuguggggguuccugucccggaacaagaagccccgcaucugcacccgggaggaguucacgcgcaaggugcggagcaacgccgcgaucggcgccgucuucguggacgagaaccaguggaacuccgccaaggaggccguggaggacgagcgcuucugggaccucguccagaaggagcgggagcugcacaagcaggggaagugcgcgaccugcguguacaacaugaugggcaagcgcgagaagaagcugggggaguucggcaaggccaagggcagccgggccaucugguacauguggcucggggcccgcuuccuggaguucgaggcccugggcuucaugaacgaggaccacugguucucccgggagaacagccucuccgggguggagggcgaggggcugcacaagcugggcuacauccuccgcgacaucagcaagauccccggcgggaacauguacgcggacgacaccgccggcugggacacccggaucacggaggacgaccugcagaacgaggccaagaucaccgacaucauggagccggagcacgcccugcucgccaccuccaucuucaagcugaccuaccagaacaaggucgugcgcgugcagcgccccgcgaagaacgggacggucauggacgugaucagccggcgcgaccagcggggcuccggccagguggggaccuacggccugaacaccuucaccaacauggaggcccagcucauccgccagauggagagcgaggggaucuuccugcccuccgagcuggagacgcccaaccucgccgagcggguccuggacuggcuggagaaguacggcguggagcgccucaagcggauggccaucagcggggacgacugcguggucaagccgaucgacgaccgcuucgccaccgcgcugaccgcccugaacgacaugggcaaggugcggaaggacaucccccagugggagcccuccaagggcuggaacgacuggcagcagguccccuucugcagccaccacuuccaccagcucaucaugaaggacgggcgcgagaucgucgugccgugccggaaccaggacgagcuggugggccgcgcccgggucucccagggggccggcuggagccugcgcgagaccgccugccucggcaagagcuacgcgcagauguggcagcugauguacuuccaccggcgcgaccugcggcucgccgccaacgccaucugcuccgcggugcccguggacuggguccccacgagccgcaccaccugguccauccacgcccaccaccaguggaugaccacggaggacaugcugagcguguggaaccggguguggaucgaggagaaccccuggauggaggacaagacccacgucuccagcuggggcgacgugccguaccugggcaagcgcgaggaccaguggugcgggucccucaucggccugaccgcccgcgccaccugggccagcaacauccagguggcgaucaaccagguccggcgccugaucgggaacgagaacuaccucgacuacaugaccuccaugaagcgguucaagaacgagggcgaccccgagggggcccugugguga

SEQ ID NO: 8550 - RNA, 9879 nt, Artificial Sequence
  derived and/or modified CDS sequence (opt1) from DENV-1__FJ882570__SS-prME
agcgugaccaugcugcucaugcugaugcccaccgcccuggccuuccaccucaccacccggggcggggagccccacaugaucgugaccaagcaggagcggggcaagagccugcuguucaagaccagcgccggggugaacaugugcacccucaucgccauggaccugggcgagcugugcgaggacaccaugaccuacaagugcccccgcaucaccgaggccgagcccgacgacguggacugcuggugcaacgccaccgacaccugggugaccuacgggaccugcagccagacgggcgagcaccggcgcgacaagcggagcguggcccucgcgccccacgugggccuggggcuggagacccgcaccgagaccuggauguccagcgagggcgccuggaagcagauccagcgggucgagacgugggcccuccgccaccccggguucaccgugaucgcccuguuccuggcgcacgccaucggcaccuccaucacccagaaggggaucaucuucauccuccugaugcuggugacgcccagcauggccaugcggugcgucggcaucggcucccgcgacuucguggaggggcucagcggcgccaccuggguggacgucgugcuggagcacggguccugcgugaccaccauggccaaggacaagcccacgcuggacaucgagcuccugaagaccgaggucaccaaccccgcggugcugcggaagcucugcaucgaggccaagaucagcaacaccacgaccgacucccgcugccccacccagggcgaggccacccugauggaggagcaggacgccaacuucgugugccggcgcacguucgucgaccggggcugggggaacggcugcgggcuguucggcaaggggagccucaucacgugcgccaaguucaagugcgugaccaagcuggagggcaagaucgugcaguacgagaaccugaaguacuccgucaucgugaccgugcacacgggcgaccagcaccaggucgggaacgagagcaccgagcacggcaccaccgcgaccaucacgccccaggcccccaccuccgagauccagcucaccgacuacggggcccugacccuggacugcagcccccgcacgggccucgacuucaacgagauggugcugcugaccaugaaggagaaguccuggcucguccacaagcagugguuccuggaccugccgcuccccuggaccagcggggccagcaccucccaggagacguggaaccggcaggaccugcuggugaccuucaagaccgcccacgcgaagaagcaggagguggucgugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgugaugugcaccggguccuucaagcucgagaaggaggucgcggagacgcagcacggcaccgugcuggugcagaucaaguacgagggcaccgacgcccccugcaagauccccuucagcacccaggacgggaagggcgucacgcagaacgggcggcugaucaccgccaacccgaucgugaccgacaaggagaagcccgugaacaucgaggccgagccgcccuucggcgaguccuacaucgucaucggcgcgggggagaaggcccugaagcucagcugguucaagaagggcuccagcaucgggaagauguucgaggccaccgcccgcggcgcccggcgcauggcgauccugggggacacggccugggacuucggcuccaucggcgggguguucaccagcgugggcaagcugguccaccagaucuucgggaccgccuacggcgugcuguucuccggggugagcuggaccaugaagaucggcaucggcguccugcugacguggcucgggcugaacucccgcagcaccucccugagcaugaccugcaucgccgugggccucgugacccuguaccugggggucauggugcaggccgacuccggcugcgugaucaacuggaaggggcgggagcucaagugcggcagcggcaucuucgucacgaacgaggugcacaccuggaccgagcaguacaaguuccaggcggacagcccgaagcgccuguccgccgccaucgggaaggccugggaggagggcgugugcgggauccggagcgccacccgccuggagaacaucauguggaagcagaucuccaacgagcucaaccacauccugcuggagaacggcaugaaguucaccgucguggugggggacgucgugggcauccucgcgcagggcaagaagaugauccggccccagcccauggagcacaaguacagcuggaaguccugggggaaggccaagaucaucggcgccgacgugcagaacacgaccuucaucaucgacgggcccaacaccccggagugccccgacgaccagcgcgccuggaacaucugggaggucgaggacuacggcuucggcaucuucaccacgaacaucuggcugaagcugcgggacagcuacacccaggugugcgaccaccgccucauguccgcggccaucaaggacagcaaggccgugcacgccgacaugggguacuggaucgaguccgagaagaacgagaccuggaagcuggcccgggcgagcuucaucgaggucaagaccugcaucuggcccaagucccacacgcuguggagcaacggcgugcucgaguccgagaugaucauccccaagaucuacgggggcccgaucagccagcacaacuaccgccccggguacuucacccagaccgccggccccuggcaccugggcaagcuggagcucgacuucgaccugugcgaggggaccacgguggucguggacgagcacugcggcaaccgggggccgucccugcgcaccaccaccgugacgggcaagaucauccacgaguggugcugccggagcugcacccugccgccccuccgcuucaagggggaggacggcugcugguacggcauggagauccggcccgucaaggagaaggaggagaaccuggugaaguccauggugagcgccgggagcggcgaggucgacuccuucagccucgggcugcugugcaccuccaucaugaucgaggaggugaugcgcagccgguggucccgcaagaugcucaugaccggcacgcuggccguguuccugcuccugaucauggggcagcugaccuggaacgaccucauccggcugugcaucauggucggcgccaacgcgagcgaccgcaugggcauggggaccaccuaccuggcccucauggccacguucaagaugcgcccgauguucgccgugggccugcuguuccggcgccucaccucccgggaggugcugcugcucaccaucgggcugagccuggucgccuccguggagcuccccaacagccuggaggagcugggcgacggccucgcgauggggaucaugauccugaagcugcucaccgacuuccagucccaccagcugugggccacgcugcucagccugaccuucaucaagaccacccugucccuccacuacgccuggaagacgauggccaugguccugagcaucgugucccuguucccccucugccugagcaccaccucccagaagaccacguggcugcccgugcuccugggcagccuggggugcaagccgcucaccauguuccugaucgcggagaacaagaucuggggccgcaaguccuggccccugaacgaggggaucauggccgucggcguggugagcauccuccugagcucccugcucaagaacgacgucccccuggccggcccccugaucgccgggggcaugcucaucgccugcuacgugaucagcggguccagcgcggaccugucccuggagaaggccgccgaggugagcugggaggaggaggccgagcacuccggcgccagccacaacaucuucgucgaggugcaggacgacgggaccaugaagaucaaggacgaggagcgggacgacacccucaccauccugcugaaggcgacgcuccuggccguguccggcgucuacccgcugagcauccccgccacccucuucgugugguacuucuggcagaagaagaagcagcgcuccggcgugcugugggacacccccagcccgcccgaggucgagcgggccgcccuggacgacgggaucuaccgcaucaugcagcggggccugcucgggcgcucccaggugggcgugggggucuuccaggagaacguguuccacaccauguggcacgugacgcggggcgcgguccugauguaccagggcaagcgccuggagcccagcugggccuccgugaagaaggaccucaucagcuacgggggcggguggcggcugcagggcuccuggaacaccggggaggaggugcaggucaucgccguggagcccggcaagaaccccaagaacgugcagaccgcccccggcaccuucaagacgcccgagggggaggucggcgccaucgcgcuggacuucaagcccgggaccagcggcucccccaucgugaaccgcgagggcaagaucguggggcucuacggcaacggggucgugaccaccagcggcacguacgugagcgccaucgcccaggccaaggcgucccaggaggggccgcugcccgagaucgaggacgaggucuuccggaagcgcaaccugaccaucauggaccuccaccccggcagcggcaagacccggcgcuaccugccggccaucgugcgggaggccaucaagcgcaagcugcggacccucauccuggcccccacgcgcguggucgccuccgagauggcggaggcccugaaggggaugcccauccgcuaccagaccaccgccgucaagagcgagcacaccggcaaggagaucguggaccucaugugccacgccacguucaccaugcggcugcugucccccguccgcgugccgaacuacaacaugaucaucauggacgaggcccacuucaccgaccccagcuccaucgcggcccggggguacaucagcacccgcgugggcaugggggaggccgccgccaucuucaugacggcgacgccgcccggcuccgucgaggccuucccgcagagcaacgccgugauccaggacgaggagcgggacauccccgagcgcuccuggaacagcggcuacgaguggaucaccgacuuccccgggaagaccgugugguucguccccuccaucaagagcggcaacgacaucgccaacugccuccggaagaacgggaagcgcgugauccagcugucccggaagacguucgacaccgaguaccagaagaccaagaacaacgacugggacuacguggucaccacggacaucagcgagaugggcgcgaacuuccgcgccgaccgggugaucgacccgcgccggugccugaagcccgugauccucaaggacgggcccgagcgcgucauccuggccggccccaugccggugaccgucgccuccgccgcgcagcggcgcggccggaucgggcgcaaccacaacaaggagggcgaccaguacaucuacauggggcagccccugaacaacgacgaggaccacgcccacuggaccgaggccaagaugcuccuggacaacaucaacacccccgagggcaucauccccgcccuguucgagccggagcgggagaaguccgccgcgaucgacggggaguaccgccuccgcggcgaggcccggaagacguucguggagcugaugcgccggggcgaccugcccguguggcucuccuacaaggucgccagcgagggguuccaguacagcgaccgccgguggugcuucgacggcgagcgcaacaaccaggugcuggaggagaacauggacguggagaucuggaccaaggagggggagcggaagaagcugcgcccccgguggcucgacgcccgcaccuacuccgacccccuggcccugcgggaguucaaggaguucgcggccggccgccggagcgucuccggcgaccucauccuggagaucgggaagcugccgcagcaccucacccagcgcgcccagaacgcccuggacaaccuggugaugcuccacaacagcgagcagggcgggcgggcguaccgccacgccauggaggagcugcccgacacgaucgagacccugaugcuccuggcccugaucgccgugcucaccggcggggucacccuguucuuccuguccggccggggccucgggaagaccagcaucggccugcugugcgugauggccuccagcgugcuccuguggauggcguccgucgagccccacuggaucgccgccagcaucauccuggaguucuuccucauggugcugcugauccccgagccggaccgccagcggacgccccaggacaaccagcucgccuacguggucaucgggcugcuguucaucauccucaccguggccgcgaacgagaugggccugcuggagaccaccaagaaggaccucgggaucggccacguggccgucgagaaccaccaccacgccacgaugcuggacguggaccugcaccccgccuccgccuggacccucuacgcgguggccaccaccaucaucacgccgaugaugcgccacaccaucgagaacaccaccgccaacaucagccugacggccaucgccaaccaggcggccauccugaugggccucgacaagggguggcccaucuccaagauggacaucggcgucccccugcuggcccucgggugcuacagccaggugaacccccugacccugaccgccgcggugcucaugcuggucgcccacuacgccaucaucggcccggggcugcaggccaaggccacccgggaggcgcagaagcgcacggccgccggcaucaugaagaaccccaccguggacggcaucguggccaucgaccucgaccccgucguguacgacgccaaguucgagaagcagcuggggcagaucaugcugcucauccugugcaccucccagauccugcucaugcgcaccacgugggcgcugugcgagagcaucacccuggccaccggcccccucaccacgcugugggagggguccccgggcaaguucuggaacaccaccaucgccgugagcauggccaacaucuuccggggcuccuaccuggccggggcgggccucgccuucagccugaugaagucccucgggggcgggcgccgggggaccggcgcccagggggagacgcucggcgagaaguggaagcgccagcugaaccagcuguccaagagcgaguucaacaucuacaagcgguccgggaucauggaggucgaccgcagcgaggccaaggagggccucaagcgcggggagaccacccgccacgcggugucccggggcaccgccaagcugcgcugguucguggagcggaaccuggucaagcccgagggcaaggugaucgaccuggggugcggccgcgggggcuggagcuacuacugcgccgggcucaagaaggugacggaggucaagggcuacaccaagggcgggcccggccacgaggagcccaucccgauggccaccuacggguggaaccuggugaagcugcacuccggcaaggacguguucuucacgccgcccgagaagugcgacacgcuccugugcgacaucggggagagcucccccaacccgaccaucgaggagggccggacccugcgcguccucaagaugguggagcccuggcugcggggcaaccaguucugcaucaagauccugaaccccuacaugcccagcguggucgagacccucgagcagaugcagcgcaagcacgggggcaugcuggugcggaacccgcugucccgcaacagcacccacgagauguacuggguguccugcgggacgggcaacaucgucagcgccgugaacaugaccucccggaugcuccugaaccgcuucaccauggcgcaccgcaagcccaccuacgagcgggacguggaccugggcgccgggacgcgccacgucgccguggagcccgagguggccaaccucgacaucaucggccagcggaucgagaacaucaagcacgagcacaagagcaccuggcacuacgacgaggacaaccccuacaagaccugggccuaccacggguccuacgaggucaagccgagcggcuccgcgagcagcauggugaacggggucgugaagcugcugaccaagcccugggacgugauccccauggucacgcagaucgccaugaccgacaccacccccuucggccagcagcgcguguucaaggagaagguggacacgcggaccccgaaggccaagcgcggcaccgcccagaucauggaggucaccgcccgguggcucuggggguuccugucccgcaacaagaagccccggaucugcacgcgcgaggaguucacccggaaggugcgcagcaacgcggccaucggcgccguguucgucgacgagaaccaguggaacuccgccaaggaggcgguggaggacgagcgguucugggaccuggugcagaaggagcgcgagcuccacaagcaggggaagugcgcgaccugcgucuacaacaugaugggcaagcgggagaagaagcugggggaguucggcaaggccaagggcagccgcgccaucugguacauguggcugggggcccgguuccucgaguucgaggcgcugggcuucaugaacgaggaccacugguucucccgcgagaacagccuguccgggguggagggcgaggggcuccacaagcugggcuacauccugcgggacaucagcaagauccccggcgggaacauguacgccgacgacaccgccggcugggacacgcgcaucaccgaggacgaccuccagaacgaggccaagaucaccgacaucauggagccggagcacgcccugcuggcgaccuccaucuucaagcucacguaccagaacaaggugguccgggugcagcgccccgccaagaacgggaccgugauggacgucaucagccgccgggaccagcgcggcuccggccagguggggaccuacggccugaacaccuucacgaacauggaggcccagcugauccggcagauggagagcgaggggaucuuccuccccuccgagcuggagacccccaaccuggccgagcgcgugcucgacuggcuggagaaguacggcgucgagcggcugaagcgcauggccaucagcggggacgacugcguggugaagccgaucgacgaccgguucgcgaccgcccucaccgcccugaacgacaugggcaagguccgcaaggacaucccccagugggagcccuccaagggcuggaacgacuggcagcagguccccuucugcagccaccacuuccaccagcugaucaugaaggacgggcgggagaucguggucccgugccgcaaccaggacgagcucgugggccgggcccgcgugucccagggggccggcuggagccugcgggagacggcgugccugggcaagagcuacgcccagauguggcagcucauguacuuccaccgccgggaccugcgccuggccgccaacgcgaucugcuccgccguccccguggacugggugcccaccagccggaccaccugguccauccacgcccaccaccaguggaugacgaccgaggacaugcucagcgucuggaaccgcguguggaucgaggagaaccccuggauggaggacaagacccacguguccagcuggggcgacgucccguaccugggcaagcgggaggaccaguggugcgggucccugaucggccucaccgcccgcgccaccugggcgagcaacauccagguggccaucaaccaggugcgccggcugaucgggaacgagaacuaccuggacuacaugacguccaugaagcgcuucaagaacgagggcgaccccgagggggcccucugguga

SEQ ID NO: 8551 - RNA, 9879 nt, Artificial Sequence
  derived and/or modified CDS sequence (opt1) from DENV-1__GQ199834__SS-prME
agcgugaccaugcugcucaugcugaugcccaccgcccuggccuuccaccucaccacccggggcggggagccccacaugaucgugaccaagcaggagcggggcaagagccugcuguucaagaccagcgcgggggugaacaugugcacccucaucgccauggaccugggcgagcugugcgaggacaccaugaccuacaagugcccccgcaucaccgaggccgagcccgacgacguggacugcuggugcaacgccaccgacaccugggucaccuacgggaccugcagccagacgggcgagcaccggcgcgacaagcggagcguggcccucgcgccccacgugggccuggggcuggagacccgcaccgagaccuggauguccagcgagggcgccuggaagcagauccagcgggucgagacgugggcccuccgccaccccggguucaccgugaucgcccuguuccuggcgcacgccaucggcaccuccaucacccagaaggggaucaucuucauccuccugaugcuggugacgcccagcauggccaugcggugcgucggcaucggcucccgcgacuucguggaggggcucagcggcgccaccuggguggacgucgugcuggagcacggguccugcgugaccaccauggccaaggacaagcccacgcuggacaucgagcuccugaagaccgaggucaccaaccccgcggugcugcggaagcucugcaucgaggccaagaucagcaacaccacgaccgacucccgcugccccacccagggcgaggccacccugauggaggagcaggacgccaacuucgugugccggcgcacguucgucgaccggggcugggggaacggcugcgggcuguucggcaaggggagccucaucacgugcgccaaguucaagugcgugaccaagcuggagggcaagaucgugcaguacgagaaccugaaguacuccgucaucgugaccgugcacacgggcgaccagcaccaggucgggaacgagagcaccgagcacggcaccaccgcgaccaucacgccccaggcccccaccuccgagauccagcucaccgacuacggggcccugacccuggacugcagcccccgcacgggccucgacuucaacgagauggugcugcugaccaugaaggagaaguccuggcucguccacaagcagugguuccuggaccugccgcuccccuggaccagcggggccagcaccucccaggagacguggaaccggcaggaccugcuggugaccuucaagaccgcccacgcgaagaagcaggagguggucgugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgugaugugcaccggguccuucaagcucgagaaggagcuggcggagacgcagcacggcaccguccuggugcagaucaaguacgagggcaccgacgcccccugcaagauccccuucagcacccaggacgagaagggggugacgcagaacggccggcugaucaccgccaacccgaucgucaccgacaaggagaagcccgugaacaucgaggccgagccgcccuucggggaguccuacaucgugaucggcgcgggcgagaaggcccucaagcugagcugguucaagaagggguccagcaucggcaagauguucgaggccaccgcccgcggggcccggcgcauggcgauccugggcgacacggccugggacuucggguccaucggcggcgucuucaccagcguggggaagcucgugcaccagaucuucggcaccgccuacgggguccuguucuccggcgugagcuggaccaugaagaucgggaucggcgugcugcucacguggcugggccugaacucccgcagcaccucccucagcaugaccugcaucgccgucgggcuggugacccuguaccucggcgugaugguccaggccgacuccgggugcgugaucaacuggaagggccgggagcugaagugcgggagcggcaucuucgugacgaacgagguccacaccuggaccgagcaguacaaguuccaggcggacagcccgaagcgccuguccgccgccaucggcaaggccugggaggagggggugugcggcauccggagcgccacccgccucgagaacaucauguggaagcagaucuccaacgagcugaaccacauccugcucgagaacgggaugaaguucaccguggucgugggcgacguggacgggauccuggcgcagggcaagaagaugauccggccccagcccauggagcacaaguacagcuggaaguccuggggcaaggccaagaucaucggggccgacguccagaacacgaccuucaucaucgacggccccaacaccccggagugccccgacgaccagcgcgccuggaacaucugggagguggaggacuacggguucggcaucuucaccacgaacaucuggcugaagcuccgggacagcuacacccaggugugcgaccaccgccugauguccgcggccaucaaggacagcaaggccguccacgccgacaugggcuacuggaucgaguccgagaagaacgagaccuggaagcuggcccgggcgagcuucaucgaggugaagaccugcaucuggcccaagucccacacgcucuggagcaacggggugcuggaguccgagaugaucauccccaagaucuacggcgggccgaucagccagcacaacuaccgccccggcuacuucacccagaccgccgggcccuggcaccugggcaagcucgagcuggacuucgaccugugcgagggcaccacggucgugguggacgagcacugcgggaaccggggcccgucccuccgcaccaccaccgucacggggaagaucauccacgaguggugcugccggagcugcacccugccgccccugcgcuucaagggcgaggacgggugcugguacggcauggagauccggcccgugaaggagaaggaggagaaccucgugaaguccauggucagcgccggcagcggggagguggacuccuucagccugggccugcucugcaucuccaucaugaucgaggaggugaugcgcagccgguggucccgcaagaugcugaugaccgggacccuggccgucuuccuccugcugaucaugggccagcucacguggaacgaccugauccggcugugcaucauggugggggccaacgcgagcgaccgcaugggcaugggcaccaccuaccucgcccugauggccaccuucaagaugcgcccgauguucgccguggggcuccuguuccggcgccugacgucccgggagguccugcuccugaccaucgggcugagccucguggccuccguggagcugcccaacagccuggaggagcucggggacggccuggcgaugggcaucaugauccugaagcuccugaccgacuuccagucccaccagcugugggccacccuccugagccugacguucaucaagaccacccucucccugcacuacgccuggaagaccauggccaugguccugagcaucgugucccucuucccccugugccugagcacgaccucccagaagaccaccuggcuccccguccugcuggggagccucggcugcaagccgcugacgauguuccugaucgcggagaacaagaucugggggcgcaaguccuggccccucaacgagggcaucauggccguggggguggucagcauccugcugagcucccuccugaagaacgacgugccccuggccggcccccucaucgccggcgggaugcugaucgccugcuacgugaucagcggcuccagcgcggaccugucccucgagaaggccgccgaggucagcugggaggaggaggccgagcacuccggggccagccacaacauccugguggaggugcaggacgacggcaccaugaagaucaaggacgaggagcgggacgacacccugaccauccuccugaaggcgacccugcucgccgucuccgggguguacccgcugagcauccccgccacgcuguucgugugguacuucuggcagaagaagaagcagcgcuccggcguccugugggacacccccagcccgcccgagguggagcgggccgugcucgacgacggcaucuaccgcaucaugcagcgggggcugcugggccgcucccaggucggggugggcguguuccaggagaacgucuuccacaccauguggcacgugacccgcggggccgugcucauguaccagggcaagcgccuggagcccagcugggcguccgucaagaaggaccugaucagcuacggcgggggcuggcggcuccagggguccuggaacacgggcgaggagguccaggugaucgccgucgagcccgggaagaaccccaagaacgugcagaccgcccccggcaccuucaagacccccgagggcgaggugggggccaucgcccuggacuucaagcccggcacgagcgggucccccaucgucaaccgcgagggcaagaucgugggccuguacgggaacggcguggucaccaccagcgggaccuacgugagcgcgaucgcccaggccaaggccucccaggagggcccgcuccccgagaucgaggacgagguguuccggaagcgcaaccugacgaucauggaccugcaccccgggagcggcaagacccggcgcuaccucccggcgaucguccgggaggccaucaagcgcaagcugcggacccugauccucgcccccacccgcgugguggccuccgagauggccgaggcgcugaagggcaugcccauccgcuaccagacgaccgccgucaagagcgagcacaccgggaaggagaucguggaccugaugugccacgccaccuucacgaugcggcuccugucccccgugcgcgucccgaacuacaacaugaucaucauggacgaggcccacuucaccgaccccagcuccaucgccgcgcggggcuacaucagcacccgcguggggaugggcgaggccgccgccaucuucaugaccgccacgccgcccggguccguggaggcguucccgcagagcaacgccgucauccaggacgaggagcgggacauccccgagcgcuccuggaacagcggcuacgaguggaucaccgacuuccccggcaagaccgugugguucgugcccuccaucaagagcgggaacgacaucgccaacugccugcggaagaacggcaagcgcgucauccagcucucccggaagaccuucgacacggaguaccagaagaccaagaacaacgacugggacuacguggugaccaccgacaucagcgagaugggggccaacuuccgcgcggaccgggucaucgacccgcgccggugccugaagcccgugauccugaaggacggccccgagcgcgugauccucgccgggcccaugccggucacgguggccuccgccgcccagcggcgcggccggaucggccgcaaccacaacaaggagggggaccaguacaucuacaugggccagccccugaacaacgacgaggaccacgcgcacuggaccgaggccaagaugcugcucgacaacaucaacacccccgaggggaucauccccgcccuguucgagccggagcgggagaaguccgccgccaucgacggcgaguaccgccugcgcggggaggcgcggaagaccuucgucgagcucaugcgccggggcgaccugcccguguggcuguccuacaagguggccagcgagggcuuccaguacagcgaccgccgguggugcuucgacggggagcgcaacaaccagguccucgaggagaacauggacguggagaucuggacgaaggagggcgagcggaagaagcugcgcccccgguggcuggacgcccgcaccuacuccgacccccucgcccugcgggaguucaaggaguucgccgcggggcgccggagcguguccggcgaccugauccucgagaucggcaagcugccgcagcaccugacccagcgcgcccagaacgcccucgacaaccuggucaugcugcacaacagcgagcagggcgggcgggccuaccgccacgcgauggaggagcuccccgacaccaucgagacgcugaugcugcucgcccugaucgccgugcugaccgggggcgugacccucuucuuccuguccgggcggggccugggcaagaccagcaucgggcuccugugcgucauggccuccagcgugcugcucuggauggccuccguggagccccacuggaucgcggccagcaucauccuggaguucuuccugaugguccuccugauccccgagccggaccgccagcggacgccccaggacaaccagcuggccuacguggugaucggccuccuguucaugauccugacggucgccgccaacgagauggggcuccuggagaccaccaagaaggaccugggcaucgggcacguggcgguggagaaccaccaccacgccaccaugcucgacgucgaccugcaccccgccuccgccuggacgcuguacgccguggcgaccaccaucaucaccccgaugaugcgccacacgaucgagaacaccaccgccaacaucagccucaccgccaucgccaaccaggccgcgauccugaugggccuggacaagggcuggcccaucuccaagauggacaucggggugccccuccuggcccugggcugcuacagccaggucaacccccucacgcugaccgccgccgugcugaugcucguggcgcacuacgccaucaucgggccgggccugcaggccaaggccacccgggaggcccagaagcgcaccgcggccgggaucaugaagaaccccacggucgacggcaucguggccaucgaccuggaccccguggucuacgacgccaaguucgagaagcagcucggccagaucaugcugcugauccucugcaccucccagauccugcugaugcgcaccaccugggcccucugcgagagcaucacgcuggcgaccgggccccugaccacccucugggagggcuccccggggaaguucuggaacacgaccaucgccgugagcauggccaacaucuuccggggcuccuaccuggccggcgccgggcuggcguucagccucaugaagucccugggcgggggccgccgggggaccggcgcccagggcgagacccugggggagaaguggaagcgccagcucaaccagcuguccaagagcgaguucaacaucuacaagcgguccggcaucauggagguggaccgcagcgaggccaaggaggggcugaagcggggcgagacgacccgccacgccgucucccgggggaccgcgaagcugcgcugguucguggagcggaaccucgugaagcccgagggcaaggucaucgaccugggcugcgggcgcggcggguggagcuacuacugcgccggccugaagaaggugaccgaggugaagggguacacgaagggcggccccgggcacgaggagcccaucccgauggccaccuacggcuggaaccucgucaagcugcacuccgggaaggacguguucuucacgccgcccgagaagugcgacacccugcucugcgacaucggcgagagcucccccaacccgacgaucgaggaggggcggacccugcgcgugcugaagauggucgagcccuggcuccggggcaaccaguucugcaucaagauccugaaccccuacaugcccagcgugguggagacccuggagcagaugcagcgcaagcacggcgggaugcucguccggaacccgcugucccgcaacagcacccacgagauguacuggguguccugcggcaccgggaacaucgugagcgccgucaacaugacgucccggaugcugcucaaccgcuucaccauggcccaccgcaagcccaccuacgagcgggacguggaccugggcgcgggcacccgccacguggccgucgagcccgagguggccaaccuggacaucaucgggcagcggaucgagaacaucaagcacgagcacaagagcacguggcacuacgacgaggacaaccccuacaagaccugggccuaccacggcuccuacgaggugaagccgagcggguccgccagcagcauggucaacggcguggucaagcuccugaccaagcccugggacgugauccccauggugacccagaucgcgaugacggacaccacccccuucgggcagcagcgcgucuucaaggagaagguggacacccggacgccgaaggccaagcgcggcaccgcccagaucauggaggugaccgcccgguggcuguggggcuuccucucccgcaacaagaagccccggaucugcacccgcgaggaguucacgcggaagguccgcagcaacgccgcgaucggggccguguucguggacgagaaccaguggaacuccgccaaggaggccgucgaggacgagcgguucugggaccuggugcagaaggagcgcgagcugcacaagcagggcaagugcgcgaccugcguguacaacaugauggggaagcgggagaagaagcucggcgaguucgggaaggccaagggcagccgcgccaucugguacauguggcugggcgcccgguuccuggaguucgaggcccucggguucaugaacgaggaccacugguucucccgcgagaacagccuguccggcgucgagggggagggccugcacaagcucggguacauccugcgggacaucagcaagauccccggcggcaacauguacgcggacgacaccgccgggugggacacccgcaucacggaggacgaccugcagaacgaggccaagaucaccgacaucauggagccggagcacgcccuccuggccaccuccaucuucaagcugaccuaccagaacaagguggugcggguccagcgccccgcgaagaacggcacggugauggacgugaucagccgccgggaccagcgcggguccggccaggucggcaccuacgggcucaacaccuucaccaacauggaggcccagcugauccggcagauggagagcgagggcaucuuccugcccuccgagcucgagacgcccaaccuggccgagcgcgugcuggacuggcucgagaaguacgggguggagcggcugaagcgcauggccaucagcggcgacgacugcgucgugaagccgaucgacgaccgguucgccaccgcgcugaccgcccucaacgacauggggaaggugcgcaaggacaucccccagugggagcccuccaagggcuggaacgacuggcagcagguccccuucugcagccaccacuuccaccagcugaucaugaaggacggccgggagaucguggugccgugccgcaaccaggacgagcuggucgggcgggcccgcgugucccagggcgccggguggagccuccgggagaccgccugccugggcaagagcuacgcgcagauguggcagcugauguacuuccaccgccgggaccuccgccuggccgccaacgccaucugcuccgcggugcccgucgacugggugcccacgagccggaccaccugguccauccacgcccaccaccaguggaugaccacggaggacaugcugagcguguggaaccgcgucuggaucgaggagaaccccuggauggaggacaagacccacguguccagcuggggcgacgugccguaccucggcaagcgggaggaccaguggugcggcucccugaucgggcugaccgcccgcgccaccugggccagcaacauccaggucgcgaucaaccaggugcgccggcucaucggcaacgagaacuaccuggacuacaugaccuccaugaagcgcuucaagaacgagggggaccccgagggcgcccugugguga

SEQ ID NO: 8552 - RNA, 9879 nt, Artificial Sequence
  derived and/or modified CDS sequence (opt1) from DENV-1__GQ199835__SS-prME
agcgugaccaugcugcucaugcugaugcccaccgcccuggccuuccaccucaccacccggggcggggagccccacaugaucgugaccaagcaggagcggggcaagagccugcuguucaagaccagcgccggggugaacaugugcacccucaucgccauggaccugggcgagcugugcgaggacaccaugaccuacaagugcccccggaucaccgaggccgagcccgacgacguggacugcuggugcaacgccaccgacaccugggugaccuacgggaccugcagccagacgggcgagcaccggcgcgacaagcggagcguggcccucgcgccccacgugggccuggggcuggagacccgcaccgagaccuggauguccagcgagggcgccuggaagcagauccagcgggucgagacgugggcccuccgccaccccggguucaccgugaucgcccuguuccuggcgcacgccaucggcaccuccaucacccagaaggggaucaucuucauccuccugaugcuggugacgcccagcauggccaugcggugcgucggcaucggcucccgcgacuucguggaggggcucagcggcgccaccuggguggacgucgugcuggagcacggguccugcgugaccaccauggccaaggacaagcccacgcuggacaucgagcuccugaagaccgaggucaccaaccccgcggugcugcggaagcucugcaucgaggccaagaucagcaacaccacgaccgacucccgcugccccacccagggcgaggccacccugauggaggagcaggacgccaacuucgugugccggcgcacguucgucgaccggggcugggggaacggcugcgggcuguucggcaaggggagccucaucacgugcgccaaguucaagugcgugaccaagcuggagggcaagaucgugcaguacgagaaccugaaguacuccgucaucgugaccgugcacacgggcgaccagcaccaggucgggaacgagagcaccgagcacggcaccaccgcgaccaucacgccccaggcccccaccuccgagauccagcucaccgacuacggggcccugacccuggacugcagcccccgcacgggccucgacuucaacgagauggugcugcugaccaugaaggagaaguccuggcucguccacaagcagugguuccuggaccugccgcuccccuggaccagcggggccagcaccucccaggagacguggaaccggcaggaccugcuggugaccuucaagaccgcccacgcgaagaagcaggagguggucgugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgugaugugcaccggguccuucaagcucgagaaggaggucgcggagacgcagcacggcaccgugcuggugcagaucaaguacgagggcaccgacgcccccugcaagauccccuucagcacccaggacgagaagggggucacgcagaacggccggcugaucaccgccaacccgaucgugaccgacaaggagaagcccgugaacaucgaggccgagccgcccuucggggaguccuacaucgucaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcguggggaagcugguccaccagaucuucggcaccgccuacggggugcuguucuccggcgugagcuggaccaugaagaucgggaucggcguccugcugacguggcucggccugaacucccgcagcaccucccugagcaugaccugcaucgccguggggcucgugacccuguaccugggcgucauggugcaggccgacuccgggugcgugaucaacuggaagggccgggagcucaagugcgggagcggcaucuucgucacgaacgaggugcacaccuggaccgagcaguacaaguuccaggcggacagcccgaagcgccuguccgccgccaucggcaaggccugggaggagggggugugcggcauccggagcgccacccgccuggagaacaucauguggaagcagaucuccaacgagcucaaccacauccugcuggagaacgacaugaaguucaccgucguggugggggacgucgugggcauccucgcgcaggggaagaagaugauccggccccagcccauggagcacaaguacagcuggaaguccuggggcaaggccaagaucaucggcgccgacgugcagaacacgaccuucaucaucgacgggcccaacaccccggagugccccgacgaccagcgcgccuggaacaucugggaggucgaggacuacggcuucgggaucuucaccacgaacaucuggcugaagcugcgggacagcuacacccaggugugcgaccaccgccucauguccgcggccaucaaggacagcaaggccgugcacgccgacaugggcuacuggaucgaguccgagaagaacgagaccuggaagcuggcccgggcgagcuucaucgaggucaagaccugcaucuggcccaagucccacacgcuguggagcaacggcgugcucgaguccgagaugaucauccccaagaucuacgggggcccgaucagccagcacaacuaccgccccggguacuucacccagaccgccggccccuggcaccuggggaagcuggagcucgacuucgaccugugcgagggcaccacgguggucguggacgagcacugcggcaaccgggggccgucccugcgcaccaccaccgugacgggcaagaucauccacgaguggugcugccggagcugcacccugccgccccuccgcuucaagggggaggacggcugcugguacgggauggagauccggcccgucaaggagaaggaggagaaccuggugaaguccauggugagcgccggcagcggcgaggucgacuccuucagccucgggcugcugugcaucuccaucaugaucgaggaggugaugcgcagccgguggucccgcaagaugcucaugaccggcacccuggccguguuccugcuccugaucauggggcagcugacguggaacgaccucauccggcugugcaucauggucggcgccaacgcgagcgaccgcauggggaugggcaccaccuaccugacccucauggccacguucaagaugcgcccgauguucgccguggggcugcugcuccggcgccugaccucccgggaggugcugcuccugaccaucgggcugagccucgucgccuccguggagcugcccaacagccuggaggagcucggcgacgggcuggccaugggcaucaugauccugaagcuccugaccgacuuccagucccaccagcugugggcgacgcuccugagccugaccuucaucaagaccacccucucccugcacuacgccuggaagacgauggccaugguccugagcaucgugucccucuucccccugugccugagcaccaccucccagaagaccacguggcuccccgugcugcugggcagccucgggugcaagccgcugaccauguuccugaucgccgagaacaagaucuggggccgcaaguccuggccccucaacgaggggaucauggcggucggcguggugagcauccugcugagcucccuccugaagaacgacgucccccuggccgggccccucaucgccggcggcaugcugaucgccugcuacgugaucagcggguccagcgccgaccugucccucgagaaggcggccgaggugagcugggaggaggaggccgagcacuccggcgccagccacaacauccuggucgaggugcaggacgacgggaccaugaagaucaaggacgaggagcgggacgacacccugaccauccuccugaaggccacgcugcucgcgguguccggcgucuacccgcugagcauccccgccacccuguucgugugguacuucuggcagaagaagaagcagcgcuccggggugcugugggacacccccagcccgcccgaggucgagcgggccgugcucgacgacggcaucuaccgcaucaugcagcggggccugcuggggcgcucccaggugggcgucgggguguuccaggagaacguguuccacaccauguggcacgucacgcggggcgccgugcucauguaccaggggaagcgccuggagcccagcugggccuccgugaagaaggaccugaucagcuacggcggcggguggcggcuccagggcuccuggaacaccggggaggagguccaggugaucgcgguggagcccggcaagaaccccaagaacguccagaccgcccccgggaccuucaagacgcccgagggcgaggugggcgccaucgcccuggacuucaagcccgggaccagcggcucccccaucgugaaccgcgaggggaagaucgucggccuguacggcaacgggguggugaccaccagcggcacguacgucagcgccaucgcgcaggccaaggccucccaggaggggccgcuccccgagaucgaggacgagguguuccggaagcgcaaccugaccaucauggaccugcaccccggcagcgggaagacccggcgcuaccucccggccaucgugcgggaggcgaucaagcgcaagcugcggacccugauccucgcccccacgcgcgucguggccuccgagauggccgaggcccugaagggcaugcccauccgcuaccagaccaccgcggucaagagcgagcacaccggcaaggagaucgucgaccugaugugccacgccacguucaccaugcggcuccugucccccgugcgcgugccgaacuacaacaugaucaucauggacgaggcccacuucaccgaccccagcuccaucgccgcccggggguacaucagcacccgcgucggcaugggggaggcggccgccaucuucaugacggccacgccgcccggcuccguggaggccuucccgcagagcaacgcggugauccaggacgaggagcgggacauccccgagcgcuccuggaacagcggguacgaguggaucaccgacuuccccggcaagaccgucugguucgugcccuccaucaagagcggcaacgacaucgccaacugccugcggaagaacgggaagcgcgugauccagcucucccggaagacguucgacaccgaguaccagaagaccaagaacaacgacugggacuacgucgugaccacggacaucagcgagaugggcgccaacuuccgcgccgaccgggugaucgacccgcgccggugccugaagcccgucauccugaaggacgggcccgagcgcgugauccucgcgggccccaugccggucaccguggccuccgccgcccagcggcgcgggcggaucggccgcaaccacaacaaggagggcgaccaguacaucuacauggggcagccccugaacaacgacgaggaccacgcccacuggaccgaggcgaagaugcugcucgacaacaucaacacccccgagggcaucauccccgcccuguucgagccggagcgggagaaguccgccgccaucgacggggaguaccgccugcgcggcgaggcccggaagacguucguggagcucaugcgccgcggggaccugcccgucuggcuguccuacaagguggcgagcgagggcuuccaguacagcgaccgccgguggugcuucgacggcgagcgcaacaaccaggugcucgaggagaacauggacgucgagaucuggaccaaggagggggagcggaagaagcugcgcccccgguggcuggacgcccgcaccuacuccgacccccucgcccugcgggaguucaaggaguucgccgccggccgccggagcguguccggggaccugauccucgagaucggcaagcugccgcagcaccugacccagcgcgcgcagaacgcccucgacaaccuggugaugcugcacaacagcgagcagggcgggcgggccuaccgccacgccauggaggagcuccccgacacgaucgagacccugaugcugcucgcgcugaucgccguccugaccggcggggugacccucuucuuccuguccggccgggggcugggcaagaccagcaucggccuccugugcgugauggccuccagcguccugcucuggauggccuccguggagccccacuggaucgccgcgagcaucauccuggaguucuuccugauggugcuccugauccccgagccggaccgccagcggacgccccaggacaaccagcuggccuacgucgugaucgggcuccuguucaugauccugaccguggccgccaacgagaugggccuccuggagaccaccaagaaggaccuggggaucggccacgucgccguggagaaccaccaccacgcgacgaugcucgacguggaccugcaccccgccuccgccuggacccuguacgccgucgccaccaccaucaucacgccgaugaugcgccacaccaucgagaacaccaccgcgaacaucagccucacggccaucgccaaccaggccgccauccugauggggcuggacaagggcuggcccaucuccaagauggacaucggcgugccccuccuggcgcuggggugcuacagccaggugaacccccucacccugaccgccgccguccugaugcucguggcccacuacgcgaucaucggcccggggcugcaggccaaggccacccgggaggcccagaagcgcacggccgcgggcaucaugaagaaccccaccguggacgggaucgucgccaucgaccuggaccccgugguguacgacgccaaguucgagaagcagcucggccagaucaugcugcugauccucugcaccucccagauccugcugaugcgcaccacgugggcccucugcgagagcaucacccuggccaccggcccccugaccacgcucugggagggguccccgggcaaguucuggaacaccaccaucgcggucagcauggccaacaucuuccggggguccuaccuggccggcgccggccuggccuucagccucaugaagucccucgggggcgggcgccgggggaccggggcgcagggcgagacgcugggcgagaaguggaagcgccagcucaaccagcuguccaagagcgaguucaacaucuacaagcgguccgggaucauggagguggaccgcagcgaggccaaggagggccugaagcgcggggagaccacccgccacgccgugucccggggcaccgccaagcugcgcugguucgucgagcggaaccucgugaagcccgaggggaaggugaucgaccugggcugcggccgcgggggcuggagcuacuacugcgcggggcugaagaaggucacggaggugaagggcuacaccaagggcgggcccggccacgaggagcccaucccgauggccaccuacggguggaaccucgugaagcugcacuccggcaaggacgucuucuucacgccgcccgagaagugcgacacgcugcucugcgacaucggggagagcucccccaacccgaccaucgaggagggccggacccugcgcgugcugaagaugguggagcccuggcuccgggggaaccaguucugcaucaagauccugaaccccuacaugcccagcgucguggagacccuggagcagaugcagcgcaagcacggcggcaugcucgugcggaacccgcugucccgcaacagcacccacgagauguacugggucuccugcgggacgggcaacaucgugagcgccgugaacaugaccucccggaugcugcucaaccgcuucaccauggcccaccgcaagcccaccuacgagcgggacgucgaccugggggccggcacgcgccacguggcgguggagcccgaggucgccaaccuggacaucaucggccagcggaucgagaacaucaagcacgagcacaagagcaccuggcacuacgacgaggacaaccccuacaagaccugggccuaccacggguccuacgaggugaagccgagcggcuccgccagcagcauggucaacgggguggugaagcuccugaccaagcccugggacgucauccccauggugacgcagaucgccaugaccgacaccacccccuucggccagcagcgcguguucaaggagaaggucgacacgcggaccccgaaggcgaagcgcgggaccgcccagaucauggaggugaccgcccgguggcuguggggcuuccucucccgcaacaagaagccccggaucugcacgcgcgaggaguucacccggaaggugcgcagcaacgccgccaucggcgcggucuucguggacgagaaccaguggaacuccgccaaggaggccguggaggacgagcgguucugggaccugguccagaaggagcgcgagcugcacaagcaggggaagugcgcgaccugcguguacaacaugaugggcaagcgggagaagaagcucggggaguucggcaaggcgaaggggagccgcgccaucugguacauguggcugggcgcccgguuccuggaguucgaggcccucggcuucaugaacgaggaccacugguucucccgcgagaacagccuguccgggguggagggcgaggggcugcacaagcucggcuacauccugcgggacaucagcaagauccccgggggcaacauguacgccgacgacaccgcgggcugggacacgcgcaucaccgaggacgaccugcagaacgaggccaagaucaccgacaucauggagccggagcacgcccuccuggccaccuccaucuucaagcugacguaccagaacaaggucgugcgggugcagcgccccgccaagaacgggaccgucauggacgugaucagccgccgggaccagcgcggcuccggccaggugggcaccuacggccucaacaccuucacgaacauggaggcgcagcugauccggcagauggagagcgaggggaucuuccugcccuccgagcucgagacccccaaccuggccgagcgcguccuggacuggcucgagaaguacggcguggagcggcugaagcgcauggccaucagcggggacgacugcguggucaagccgaucgacgaccgguucgccaccgcccugaccgcgcucaacgacaugggcaaggugcgcaaggacaucccccagugggagcccuccaagggguggaacgacuggcagcagguccccuucugcagccaccacuuccaccagcugaucaugaaggacggccgggagaucgucgugccgugccgcaaccaggacgagcuggugggccgggcccgcgucucccagggggccggcuggagccuccgggagacggccugccugggcaagagcuacgcccagauguggcagcugauguacuuccaccgccgggaccuccgccuggcggccaacgccaucugcuccgccgugcccguggacuggguccccaccagccggaccaccugguccauccacgcgcaccaccaguggaugacgaccgaggacaugcugagcguguggaaccgcguguggaucgaggagaaccccuggauggaggacaagacccacgucuccagcuggggcgacgugccguaccucgggaagcgggaggaccaguggugcggcucccugaucggccugaccgcccgcgccaccugggccagcaacauccagguggccaucaaccagguccgccggcucaucgggaacgagaacuaccuggacuacaugacguccaugaagcgcuucaagaacgagggcgaccccgagggggcgcugugguga

SEQ ID NO: 8553 - RNA, 9879 nt, Artificial Sequence
  derived and/or modified CDS sequence (opt1) from DENV-1__FJ898386__SS-prME
agcgugaccaugcugcucaugcugaugcccaccgcccuggccuuccaccucaccacccggggcggggagccccacaugaucgugaccaagcaggagcggggcaagagccugcuguucaagaccagcgcgggggugaacaugugcacccucaucgccauggaccugggggagcugugcgaggacaccaugaccuacaagugcccccggaucaccgaggccgagcccgacgacguggacugcuggugcaacgccaccgacaccugggugaccuacgggaccugcagccagacgggggagcaccggcgcgacaagcggagcguggcccucgcgccccacgugggccuggggcuggagacccgcaccgagaccuggauguccagcgagggcgccuggaagcagauccagcggguggagacgugggcccuccgccaccccggguucaccgugaucgcccuguuccuggcgcacgccaucggcaccuccaucacccagaaggggaucaucuucauccuccugaugcuggugacgcccagcauggccaugcggugcgucggcaucggcucccgcgacuucguggaggggcucagcggcgccaccuggguggacgucgugcuggagcacggguccugcgugaccaccauggccaaggacaagcccacgcuggacaucgagcuccugaagaccgaggucaccaaccccgcggugcugcggaagcucugcaucgaggccaagaucagcaacaccacgaccgacucccgcugccccacccagggcgaggccacccugauggaggagcaggacgccaacuucgugugccggcgcacguucgucgaccggggcugggggaacggcugcgggcuguucggcaaggggagccucaucacgugcgccaaguucaagugcgugaccaagcuggagggcaagaucgugcaguacgagaaccugaaguacuccgucaucgugaccgugcacacgggcgaccagcaccaggucgggaacgagagcaccgagcacggcaccaccgcgaccaucacgccccaggcccccaccuccgagauccagcucaccgacuacggggcccugacccuggacugcagcccccgcacgggccucgacuucaacgagauggugcugcugaccaugaaggagaaguccuggcucguccacaagcagugguuccuggaccugccgcuccccuggaccagcggggccagcaccucccaggagacguggaaccggcaggaccugcuggugaccuucaagaccgcccacgcgaagaagcaggagguggucgugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgugaugugcaccggguccuucaagcucgagaaggaggucgcggagacgcagcacggcaccgugcuggugcagaucaaguacgagggcaccgacgcccccugcaagauccccuucagcacccaggacgagaagggggucacgcagaacggccggcugaucaccgccaacccgaucgugaccgacaaggagaagcccgugaacaucgaggccgagccgcccuucggggaguccuacaucgucaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcguggggaagcugguccaccagaucuucggcaccgccuacgggguccuguucuccggcgugagcuggaccaugaagaucgggaucggcguccugcugacguggcucggccugaacucccgcagcaccucccugagcaugaccugcaucgccguggggcucgugacccuguaccugggcgucauggugcaggccgacuccgggugcgugaucaacuggaagggccgggagcucaagugcgggagcggcaucuucgucacgaacgaggugcacaccuggaccgagcaguacaaguuccaggcggacagcccgaagcgccuguccgccgccaucggcaaggccugggaggagggggugugcggcauccggagcgccacccgccuggagaacaucauguggaagcagaucuccaacgagcucaaccacauccugcuggagaacgacaugaaguucaccgucguggugggggacgucgugggcauccucgcgcaggggaagaagaugauccggccccagcccauggagcacaaguacagcuggaaguccuggggcaaggccaagaucaucggcgccgacgugcagaacacgaccuucaucaucgacgggcccaacaccccggagugccccgacgaccagcgcgccuggaacaucugggaggucgaggacuacggcuucgggaucuucaccacgaacaucuggcugaagcugcgggacagcuacacccaggugugcgaccaccgccucauguccgcggccaucaaggacagcaaggccgugcacgccgacaugggcuacuggaucgaguccgagaagaacgagaccuggaagcuggcccgggcgagcuucaucgaggucaagaccugcaucuggcccaagucccacacgcuguggagcaacggcgugcucgaguccgagaugaucauccccaagaucuacgggggcccgaucagccagcacaacuaccgccccggguacuucacccagaccgccggccccuggcaccuggggaagcuggagcucgacuucgaccugugcgagggcaccacgguggucguggacgagcacugcggcaaccgggggccgucccugcgcaccaccaccgugacgggcaagaucauccacgaguggugcugccggagcugcacccugccgccccuccgcuucaagggggaggacggcugcugguacgggauggagauccggcccgucaaggagaaggaggagaaccuggugaaguccauggugagcgccggcagcggcgaggucgacuccuucagccucgggcugcugugcaucuccaucaugaucgaggaggugaugcgcagccgguggucccgcaagaugcucaugaccggcacccuggccguguuccugcuccugaucauggggcagcugacguggaacgaccucauccggcugugcaucauggucggcgccaacgcgagcgaccgcauggggaugggcaccaccuaccuggcccucauggccaccuucaagaugcgcccgauguucgccgugggccugcuguuccggcgccucacgucccgggaggugcugcugcucaccaucgggcugagccuggucgccuccguggagcuccccaacagccuggaggagcugggcgacgggcucgcgaugggcaucaugauccugaagcugcucaccgacuuccagucccaccagcugugggccacccugcucagccugacguucaucaagaccacccugucccuccacuacgccuggaagaccauggccaugguccugagcaucgugucccuguucccccucugccugagcacgaccucccagaagaccaccuggcugcccgugcuccugggcagccuggggugcaagccgcucacgauguuccugaucgcggagaacaagaucuggggccgcaaguccuggccccugaacgaggggaucauggccgucggcguggugagcauccuccugagcucccugcucaagaacgacgucccccuggccgggccccugaucgccggcggcaugcucaucgccugcuacgugaucagcggguccagcgcggaccugucccuggagaaggccgccgaggugagcugggaggaggaggccgagcacuccggcgccagccacaacauccucgucgaggugcaggacgacgggaccaugaagaucaaggacgaggagcgggacgacacccugaccauccugcucaaggcgacccugcuggccguguccggcgucuacccgcucagcauccccgccacgcuguucgugugguacuucuggcagaagaagaagcagcgcuccggggugcugugggacacccccagcccgcccgaggucgagcgggccgugcuggacgacggcaucuaccgcaucaugcagcggggccuccuggggcgcucccaggugggcgucgggguguuccaggagaacguguuccacaccauguggcacgucacccggggcgccgugcugauguaccaggggaagcgccucgagcccagcugggcguccgugaagaaggaccugaucagcuacggcggcggguggcggcugcagggcuccuggaacacgggggaggagguccaggugaucgccguggagcccggcaagaaccccaagaacguccagaccgcccccgggaccuucaagacccccgagggcgaggugggcgccaucgcccucgacuucaagcccgggacgagcggcucccccaucgugaaccgcgaggggaagaucgucggccuguacggcaacgggguggugaccaccagcggcaccuacgucagcgcgaucgcccaggccaaggccucccaggaggggccgcugcccgagaucgaggacgagguguuccggaagcgcaaccucacgaucauggaccugcaccccggcagcgggaagacccggcgcuaccugccggcgaucgugcgggaggccaucaagcgcaagcuccggacccugauccuggcccccacccgcgucguggccuccgagauggccgaggcgcucaagggcaugcccauccgcuaccagacgaccgccgucaagagcgagcacaccggcaaggagaucgucgaccugaugugccacgccaccuucacgaugcggcugcucucccccgugcgcgugccgaacuacaacaugaucaucauggacgaggcccacuucaccgaccccagcuccaucgccgcgcggggguacaucagcacccgcgucggcaugggggaggccgccgccaucuucaugaccgccacgccgcccggcuccguggaggcguucccgcagagcaacgccgugauccaggacgaggagcgggacauccccgagcgcuccuggaacagcggguacgaguggaucaccgacuuccccggcaagaccgucugguucgugcccuccaucaagagcggcaacgacaucgccaacugccugcggaagaacgggaagcgcgugauccagcugucccggaagaccuucgacacggaguaccagaagaccaagaacaacgacugggacuacgucgugaccaccgacaucagcgagaugggcgccaacuuccgcgcggaccgggugaucgacccgcgccggugccucaagcccgucauccugaaggacgggcccgagcgcgugauccuggccggccccaugccggucacgguggccuccgccgcccagcggcgcgggcggaucggccgcaaccacaacaaggagggcgaccaguacaucuacauggggcagccccucaacaacgacgaggaccacgcgcacuggaccgaggccaagaugcugcuggacaacaucaacacccccgagggcaucauccccgcccucuucgagccggagcgggagaaguccgccgccaucgacggggaguaccgccugcgcggcgaggcgcggaagaccuucguggagcugaugcgccgcggggaccuccccgucuggcuguccuacaagguggccagcgagggcuuccaguacagcgaccgccgguggugcuucgacggcgagcgcaacaaccaggugcuggaggagaacauggacgucgagaucuggacgaaggagggggagcggaagaagcuccgcccccgguggcuggacgcccgcaccuacuccgacccccuggcccuccgggaguucaaggaguucgccgcgggccgccggagcguguccggggaccugauccuggagaucggcaagcucccgcagcaccugacccagcgcgcccagaacgcccuggacaaccucgugaugcugcacaacagcgagcagggcgggcgggccuaccgccacgcgauggaggagcugcccgacaccaucgagacgcucaugcugcuggcccucaucgccguccugaccggcggggugacccuguucuuccucuccggccgggggcugggcaagaccagcaucggccugcucugcgugauggccuccagcguccugcuguggauggccuccguggagccccacuggaucgcggccagcaucauccucgaguucuuccugauggugcugcucauccccgagccggaccgccagcggacgccccaggacaaccagcuggccuacgucgugaucgggcuccucuucaugauccugacgguggccgccaacgagaugggccugcucgagaccaccaagaaggaccuggggaucggccacgucgcgguggagaaccaccaccacgccaccaugcuggacguggaccuccaccccgccuccgccuggacgcuguacgccgucgcgaccaccaucaucaccccgaugaugcgccacacgaucgagaacaccaccgccaacaucagccugaccgccaucgccaaccaggccgcgauccucauggggcuggacaagggcuggcccaucuccaagauggacaucggcgugccccugcucgcccuggggugcuacagccaggugaacccccugacgcucaccgccgccguccugaugcugguggcgcacuacgccaucaucggcccggggcuccaggccaaggccacccgggaggcccagaagcgcaccgcggccggcaucaugaagaaccccacgguggacgggaucgucgccaucgaccuggaccccgugguguacgacgccaaguucgagaagcagcugggccagaucaugcuccugauccugugcaccucccagauccuccugaugcgcaccaccugggcccugugcgagagcaucacgcucgcgaccggcccccugaccacccugugggagggguccccgggcaaguucuggaacacgaccaucgccgucagcauggccaacaucuuccggggguccuaccucgccggcgccggccuggcguucagccugaugaagucccucgggggcgggcgccggggcaccggggcccagggcgagacccugggcgagaaguggaagcgccagcugaaccagcucuccaagagcgaguucaacaucuacaagcgguccgggaucauggagguggaccgcagcgaggccaaggagggccugaagcgcggggagacgacccgccacgccgugucccggggcaccgcgaagcugcgcugguucgucgagcggaaccuggugaagcccgaggggaaggugaucgaccucggcugcggccgcgggggcuggagcuacuacugcgccgggcugaagaaggucaccgaggugaagggcuacacgaagggcgggcccggccacgaggagcccaucccgauggccaccuacggguggaaccuggugaagcuccacuccggcaaggacgucuucuucacgccgcccgagaagugcgacacccugcugugcgacaucggggagagcucccccaacccgacgaucgaggagggccggacccuccgcgugcugaagaugguggagcccuggcugcgggggaaccaguucugcaucaagauccucaaccccuacaugcccagcgucguggagacccuggagcagaugcagcgcaagcacggcggcaugcuggugcggaacccgcucucccgcaacagcacccacgagauguacugggucuccugcgggaccggcaacaucgugagcgccgugaacaugacgucccggaugcugcugaaccgcuucaccauggcccaccgcaagcccaccuacgagcgggacgucgaccucggggcgggcacccgccacguggccguggagcccgaggucgccaaccuggacaucaucggccagcggaucgagaacaucaagcacgagcacaagagcacguggcacuacgacgaggacaaccccuacaagaccugggccuaccacggguccuacgaggugaagccgagcggcuccgccagcagcauggucaacgggguggugaagcugcucaccaagcccugggacgucauccccauggugacccagaucgcgaugacggacaccacccccuucggccagcagcgcguguucaaggagaaggucgacacccggacgccgaaggccaagcgcgggaccgcccagaucauggaggugaccgcccgguggcuguggggcuuccugucccgcaacaagaagccccggaucugcacccgcgaggaguucacgcggaaggugcgcagcaacgccgcgaucggcgccgucuucguggacgagaaccaguggaacuccgccaaggaggccguggaggacgagcgguucugggaccucguccagaaggagcgcgagcugcacaagcaggggaagugcgcgaccugcguguacaacaugaugggcaagcgggagaagaagcugggggaguucggcaaggccaaggggagccgcgccaucugguacauguggcucggcgcccgguuccuggaguucgaggcccugggcuucaugaacgaggaccacugguucucccgcgagaacagccucuccgggguggagggcgaggggcugcacaagcugggcuacauccuccgggacaucagcaagauccccgggggcaacauguacgcggacgacaccgccggcugggacacccgcaucacggaggacgaccugcagaacgaggccaagaucaccgacaucauggagccggagcacgcccugcucgccaccuccaucuucaagcugaccuaccagaacaaggucgugcgggugcagcgccccgcgaagaacgggacggucauggacgugaucagccgccgggaccagcgcggcuccggccaggugggcaccuacggccugaacaccuucaccaacauggaggcccagcucauccggcagauggagagcgaggggaucuuccugcccuccgagcuggagacgcccaaccucgccgagcgcguccuggacuggcuggagaaguacggcguggagcggcucaagcgcauggccaucagcggggacgacugcguggucaagccgaucgacgaccgguucgccaccgcgcugaccgcccugaacgacaugggcaaggugcgcaaggacaucccccagugggagcccuccaagggguggaacgacuggcagcagguccccuucugcagccaccacuuccaccagcucaucaugaaggacggccgggagaucgucgugccgugccgcaaccaggacgagcuggugggccgggcccgcgucucccagggggccggcuggagccugcgggagaccgccugccucggcaagagcuacgcgcagauguggcagcugauguacuuccaccgccgggaccugcgccucgccgccaacgccaucugcuccgcggugcccguggacuggguccccacgagccggaccaccugguccauccacgcccaccaccaguggaugaccacggaggacaugcugagcguguggaaccgcguguggaucgaggagaaccccuggauggaggacaagacccacgucuccagcugggaggacgugccguaccugggcaagcgggaggaccaguggugcgggucccucaucggccugaccgcccgcgccaccugggccagcaacauccagguggcgaucaaccagguccgccggcugaucggcaacgagaacuaccucgacuacaugaccuccaugaagcgcuucaagaacgagggggaccccgagggcgccuucugguga

SEQ ID NO: 8554 - RNA, 9879 nt, Artificial Sequence
  derived and/or modified CDS sequence (opt1) from DENV-1__FJ898387__SS-prME
agcgugaccaugcugcucaugcugaugcccaccgcccuggccuuccaccucacgacccggggcggggagccccacaugaucgugagcaagcaggagcggggcaagagccugcuguucaagaccagcgccggggugaacaugugcacccucaucgccauggaccugggcgaguucugcgaggacacgaugaccuacaagugcccccgcaucaccgaggccgagcccgacgacguggacugcuggugcaacgccaccgacacgugggugaccuacgggaccugcagccagaccggcgagcaccggcgggacaagcgguccguggcccuggcgccccacgugggccucgggcuggagacgcgcaccgagaccuggaugagcuccgagggcgccuggaagcagauccagcggguggagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugcccgacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaagaccguccaguacgagaaccugaaguacagcgugaucgugaccguccacacgggcgaccagcaccagguggggaacgaguccaccgagcacggcaccaccgcgaccaucacgccccaggcccccagcaccgagauccagcugaccgacuacggggcccucacccuggacugcagcccccggacgggccuggacuucaacgagaugguccuccugaccaugaaggagaaguccuggcuggugcacaagcagugguuccucgaccugccgcugcccuggaccagcggggccuccaccagccaggagacguggaaccggaaggaccuccuggugaccuucaagaccgcccacgcgaagaagcaggaggucguggugcugggcucccaggagggcgccaugcacaccgcccucacgggggccaccgagauccagaccagcggcaccacgaccaucuucgccgggcaccugaagugccgccugaagauggacaagcucacccugaagggcauguccuacgucaugugcaccgggagcuucaagcuggagaaggagguggcggagacgcagcacggcaccgugcucguccagaucaaguacgagggcaccgacgcccccugcaagauccccuucuccacccaggacgagaagggggugacgcagaacggccggcugaucaccgccaacccgaucgugaccgacaaggagaagcccgucaacaucgaggccgagccgcccuucggggagagcuacaucgugaucggcgcgggcgagaaggcccugaagcuguccugguucaagaaggggagcuccaucggcaagauguucgaggccaccgcccgcggggcccggcgcauggcgauccucggcgacacggccugggacuucgggagcaucggcggcguguucaccuccgucgggaagcuggugcaccagaucuucggcaccgccuacggggugcuguucagcggcgucuccuggaccaugaagaucgggaucggcgugcuccugacguggcugggccucaacagccgcuccaccagccuguccaugaccugcaucgccguggggcuggucacccucuaccugggcgugauggugcaggccgacagcgggugcgucaucaacuggaagggccgggagcugaagugcgggagcggcaucuucgugacgaacgaggugcacaccuggaccgagcaguacaaguuccaggcggacuccccgaagcgccucagcgccgccaucggcaaggccugggaggagggggucugcggcauccgguccgccacccgccuggagaacaucauguggaagcagaucagcaacgagcugaaccacauccuccuggagaacgacaugaaguucaccgugguggucggggacguggcgggcauccuggcccaggggaagaagaugauccggccccagcccauggaguacaaguacuccuggaaguccuggggcaaggccaagaucaucggcgccgacgugcagaacacgaccuucaucaucgacgggcccaacaccccggagugccccgacgaccagcgcgcguggaacaucugggaggucgaggacuacggcuucgggaucuucaccacgaacaucuggcucaagcugcgggacuccuacacccaggugugcgaccaccgccugaugagcgccgccaucaaggacuccaaggccgugcacgccgacaugggcuacuggaucgagagcgagaagaacgagaccuggaagcucgcgcgggccuccuucaucgaggucaagaccugcaucuggcccaagagccacacgcugugguccaacggcgugcuggagagcgagaugaucauccccaagaucuacgggggcccgaucucccagcacaacuaccgccccggguacuucacccagaccgccggccccuggcaccucgggaagcuggagcuggacuucgaccucugcgagggcaccacgguggucguggacgagcacugcggcaaccgggggccgagccugcgcaccaccaccgugacgggcaagaucauccacgaguggugcugccgguccugcacccugccgccccugcgcuucaagggggaggacggcugcugguacgggauggagauccggcccgucaaggagaaggaggagaaccuggucaagagcauggugagcgccggcuccggcgaggucgacagcuucucccuggggcuccugugcaucagcaucaugaucgaggaggugaugcgcucccgguggagccgcaagaugcugaugaccggcacccucgccguguucuuccugcugaucauggggcagcucacguggaacgaccugauccggcugugcaucauggucggcgcgaacgccuccgaccgcauggggaugggcaccaccuaccucgcccugauggccaccuucaagaugcgcccgauguucgccguggggcuccuguuccggcgccugacgagccgggaggugcugcuccugaccaucgggcugucccucgucgcgagcguggagcugcccaacucccuggaggagcucggcgacgggcuggccaugggcaucaugauccugaagcuccugaccgacuuccagagccaccagcugugggccacccuccugucccugacguucaucaagaccaccuucagccuccacuacgccuggaagaccauggcgaugguccuguccaucgugagccuguucccccucugccuguccacgaccagccagaagaccaccuggcugcccgugcuccugggcucccuggggugcaagccgcucacgauguuccugaucgccgagaacaagaucuggggccgcaagagcuggccccugaacgaggggaucauggccgucggcaucgugagcauccuccuguccagccugcucaagaacgacgugccccuggccgggccccugaucgccggcggcaugcucaucgcgugcuacgucaucuccgggagcuccgccgaccugagccuggagaaggccgccgagguguccugggaggaggaggccgagcacagcggcgcgucccacaacauccucguggagguccaggacgacgggaccaugaagaucaaggacgaggagcgggacgacacccugaccauccugcucaaggccacccugcuggccgugagcggcguguacccgcucuccauccccgccacgcuguucgucugguacuucuggcagaagaagaagcagcgcagcggggugcugugggacacccccagcccgcccgagguggagcgggccguccucgacgacggcaucuaccgcaucaugcagcggggccugcuggggcgcagccaggugggcgugggggucuuccaggagaacguguuccacaccauguggcacgugacccggggcgcgguccugauguaccaggggaagcgccucgagcccuccugggccagcgugaagaaggaccugaucuccuacggcggcggguggcggcugcagggcagcuggaacacgggggaggaggugcaggucaucgccguggagcccggcaagaaccccaagaacgugcagaccgcccccgggaccuucaagaccuccgagggcgaggucggcgccaucgcgcucgacuucaagcccgggacgagcggcagccccaucgugaaccgcgaggggaagaucgugggccuguacggcaacggggucgugaccaccuccggcaccuacgugagcgccaucgcccaggccaaggcgucccaggaggggccccugccggagaucgaggacgaggucuuccggaagcgcaaccucacgaucauggaccugcaccccggcagcgggaagacccggcgcuaccugcccgccaucgugcgggaggccaucaagcgcaagcuccggacccugauccuggccccgacccgcguggucgccuccgagauggcggaggcccucaagggcaugcccauccgcuaccagacgaccgccgucaagagcgagcacaccggcaaggagaucguggaccugaugugccacgccaccuucacgaugcggcugcucucccccguccgcgugcccaacuacaacaugaucaucauggacgaggcccacuucaccgacccgagcuccaucgcggcccggggguacaucagcacccgcgugggcaugggggaggccgccgccaucuucaugaccgcgacgccgcccggcuccgucgaggccuucccccagagcaacgccgugauccaggacgaggagcgggacaucccggagcgcuccuggaacagcggguacgaguggaucaccgacuuccccggcaagaccgugugguucguccccuccaucaagagcggcaacgacaucgccaacugccugcggaagaacgggaagcgcgugauccagcugucccggaagaccuucgacacggaguaccagaagaccaagaacaacgacugggacuacguggucaccaccgacaucagcgagaugggcgcgaacuuccgcgccgaccgggugaucgacccccgccggugccucaagccggugauccugaaggacgggcccgagcgcgucauccuggccggccccaugcccgugacggucgccuccgccgcgcagcggcgcgggcggaucggccgcaaccacaacaaggagggcgaccaguacaucuacauggggcagccgcucaacaacgacgaggaccacgcccacuggaccgaggccaagaugcugcuggacaacaucaacacccccgagggcaucauccccgcccucuucgagcccgagcgggagaaguccgccgcgaucgacggggaguaccgccugcgcggcgaggcccggaagaccuucguggagcugaugcgccgcggggaccucccgguguggcugagcuacaaggucgccuccgagggcuuccaguacagcgaccgccgguggugcuucgacggcgagcgcaacaaccaggugcuggaggagaacauggacguggagaucuggacgaaggagggggagcggaagaagcuccgcccccgguggcuggacgcccgcaccuacuccgacccccuggcccuccgggaguucaaggaguucgcggccggccgccggagcgucuccggggaccugauccuggagaucggcaagcucccccagcaccugacccagcgcgcccagaacgcccuggacaaccucgugaugcugcacaacagcgagcagggcgggcgggcguaccgccacgccauggaggagcugccggacaccaucgagacgcucaugcugcuggcccucaucgccgugcugaccggcggggucacccuguucuuccucuccggccgggggcugggcaagaccagcaucggccugcucugcgugauggccuccagcgugcugcuguggauggcguccgucgagccccacuggaucgccgccagcaucauccucgaguucuuccugauggugcugcucauccccgagcccgaccgccagcggaccccgcaggacaaccagcuggccuacguggucaucgggcuccucuucaugauccugacgguggccgcgaacgagaugggccugcucgagaccaccaagaaggaccuggggaucggccacguggccgucgagaaccaccaccacgccgccaugcuggacguggaccuccaccccgccuccgcguggacccuguacgccguggccacgaccaucaucacccccaugaugcgccacaccaucgagaacacgaccgccaacaucagccugaccgccaucgcgaaccaggccgccauccucauggggcuggacaagggcuggccgaucuccaagauggacaucggcgucccccugcucgcccuggggugcuacagccaggugaacccccugacccucacggcggccgugcugaugcuggucgcccacuacgccaucaucggccccgggcuccaggccaaggcgacccgggaggcccagaagcgcaccgccgccggcaucaugaagaacccgaccguggacgggaucguggccaucgaccuggaccccgucguguacgacacgaaguucgagaagcagcugggccagaucaugcuccugauccugugcaccucccagauccuccugaugcgcaccaccugggcgcugugcgagagcaucacgcucgccaccggcccccugaccacccugugggaggggucccccggcaaguucuggaacacgaccaucgccgugagcauggccaacaucuuccgggggagcuaccucgccggcgcgggccuggccuucucccugaugaagucccucgggggcgggcgccggggcaccggggcccagggcgagacccugggcgagaaguggaagcgccagcugaaccagcucuccaagagcgaguucaacacguacaagcgguccgggaucauggaggucgaccgcagcgaggccaaggagggccugaagcgcggggagaccaccaagcacgcggugucccgcggcaccgccaagcugcggugguucguggagcgcaaccucgucaagccggaggggaaggugaucgaccugggcugcggccgcggcggguggagcuacuacugcgccgggcugaagaaggugacggaggucaagggguacaccaagggcgggcccggccacgaggagcccauccccauggccaccuacggguggaaccuggugaagcuccacuccggcaaggacguguucuucaucccgcccgagaagugcgacacccugcugugcgacaucggggagagcucccccaaccccacgaucgaggagggccgcacccuccggguccugaagaugguggagccguggcugcgcgggaaccaguucugcaucaagauccucaaccccuacaugcccagcguggucgagacccuggagcagaugcagcggaagcacggcggcaugcuggugcgcaacccccucucccggaacagcacccacgagauguacuggguguccugcgggaccggcaacaucgucagcgccgugaacaugacgucccgcaugcugcugaaccgguucaccauggcgcaccgcaagccgaccuacgagcgcgacguggaccucggggccggcacccggcacgucgccguggagcccgagguggccaaccuggacaucaucggccagcgcaucgagaacaucaagcacgagcacaagagcacguggcacuacgacgaggacaaccccuacaagaccugggccuaccacggguccuacgaggucaagcccagcggcagcgcguccagcauggugaacggggucgugaagcugcucaccaagccgugggacgugauccccauggucacccagaucgccaugacggacaccacccccuucggccagcagcggguguucaaggagaagguggacacccgcacgcccaaggccaagcgggggaccgcccagaucauggaggucaccgccaaguggcuguggggcuuccugucccgcaacaagaagccgcggaucugcacccgcgaggaguucacgcggaaggugcgcagcaacgcggccaucggcgccguguucgucgacgagaaccaguggaacuccgccaaggaggcgguggaggacgagcgguucugggaccucgugcaccgcgagcgggagcugcacaagcaggggaagugcgcgaccugcgucuacaacaugaugggcaagcgcgagaagaagcugggggaguucggcaaggccaaggggagccgggccaucugguacauguggcucggcgcccgcuuccuggaguucgaggcgcugggcuucaugaacgaggaccacugguucucccgggagaacagccucuccgggguggagggcgaggggcugcacaagcugggcuacauccuccgcgacaucagcaagauccccgggggcaacauguacgccgacgacaccgccggcugggacacccggaucacggaggacgaccugcagaacgaggccaagaucaccgacaucauggagcccgagcacgcccugcucgcgaaguccaucuucaagcugaccuaccagaacaaggugguccgcgugcagcggccggccaagaacgggaccgugauggacgucaucagccgccgcgaccagcggggcuccggccaggugggcacguacggccugaacaccuucaccaacauggaggcccagcucauccgccagauggagagcgaggggaucuucucccccagcgagcuggagacccccaaccuggccggccgggugcucgacuggcuggagaagcacggggucgagcgccugaagcggauggccaucuccggcgacgacugcguggugaagcccaucgacgaccgcuucgcgacggcccucaccgcccugaacgacauggggaagguccggaaggacaucccgcagugggagcccagcaagggcuggaacgacuggcagcagguccccuucugcagccaccacuuccaccagcugaucaugaaggacggccgcgagaucgugguccccugccggaaccaggacgagcucguggggcgcgcccgggugucccagggcgccggguggagccugcgcgagaccgcgugccugggcaaguccuacgcccagauguggcagcucauguacuuccaccggcgcgaccugcggcuggccgccaacgcgaucugcagcgccgucccgguggacugggugcccaccucccgcacgaccuggagcauccacgcccaccaccaguggaugaccaccgaggacaugcucuccgucuggaaccggguguggaucgaggagaaccccuggauggaggacaagacgcacaucagcuccuggggcgacgugcccuaccugggcaagcgcgaggaccaguggugcggcagccugaucgggcucaccgcccgggccaccugggcgaccaacauccaggucgccaucaaccaggugcgccgccugaucggcaacgagaacuaccuggacuacaugaccuccaugaagcgguucaagaacgagagcgacccggagggggcccucugguga

SEQ ID NO: 8555 - RNA, 9879 nt, Artificial Sequence
  derived and/or modified CDS sequence (opt1) from DENV-1__FJ898389__SS-prME
agcgugaccaugcugcucaugcugaugcccaccgcccuggccuuccaccucaccacccggggcggggagccccacaugaucgugaccaagcaggagcggggcaagagccugcuguucaagaccagcgcgggggugaacaugugcacccucaucgccauggaccugggcgagcugugcgaggacaccaugaccuacaagugcccccggaucaccgaggccgagcccgacgacguggacugcuggugcaacgccaccgacaccugggugaccuacgggaccugcucccagaccggcgagcaccggcgcgacaagcggagcguggcccucgcgccccacgugggccuggggcuggagacccgcaccgagaccuggauguccagcgagggcgccuggaagcagauccagcgggucgagacgugggcccuccgccaccccggguucaccgugaucgcccuguuccuggcgcacgccaucggcaccuccaucacccagaaggggaucaucuucauccuccugaugcuggugacgcccagcauggccaugcggugcgucggcaucggcucccgcgacuucguggaggggcucagcggcgccaccuggguggacgucgugcuggagcacggguccugcgugaccaccauggccaaggacaagcccacgcuggacaucgagcuccugaagaccgaggucaccaaccccgcggugcugcggaagcucugcaucgaggccaagaucagcaacaccacgaccgacucccgcugccccacccagggcgaggccacccugauggaggagcaggacgccaacuucgugugccggcgcacguucgucgaccggggcugggggaacggcugcgggcuguucggcaaggggagccucaucacgugcgccaaguucaagugcgugaccaagcuggagggcaagaucgugcaguacgagaaccugaaguacuccgucaucgugaccgugcacacgggcgaccagcaccaggucgggaacgagagcaccgagcacggcaccaccgcgaccaucacgccccaggcccccaccuccgagauccagcucaccgacuacggggcccugacccuggacugcagcccccgcacgggccucgacuucaacgagauggugcugcugaccaugaaggagaaguccuggcucguccacaagcagugguuccuggaccugccgcuccccuggaccagcggggccagcaccucccaggagacguggaaccggcaggaccugcuggugaccuucaagaccgcccacgcgaagaagcaggagguggucgugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgugaugugcaccggguccuucaagcucgagaaggaggucgcggagacgcagcacggcaccgugcuggugcagaucaaguacgagggcaccgacgcccccugcaagauccccuucagcacccaggacgagaagggggucacgcagaacggccggcugaucaccgccaacccgaucgugaccgacaaggagaagcccgugaacaucgaggccgagccgcccuucggggaguccuacaucgucaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcguggggaagcugguccaccagaucuucggcaccgccuacggggugcuguucuccggcgugagcuggaccaugaagaucgggaucggcguccugcugacguggcucggccugaacucccgcagcaccucccugagcaugaccugcaucgccguggggcucgugacccuguaccugggcgucauggugcaggccgacuccgggugcgugaucaacuggaagggccgggagcucaagugcgggagcggcaucuucgucacgaacgaggugcacaccuggaccgagcaguacaaguuccaggcggacagcccgaagcgccuguccgccgccaucggcaaggccugggaggagggggugugcggcauccggagcgccacccgccuggagaacaucauguggaagcagaucuccaacgagcucaaccacauccugcuggagaacgacaugaaguucaccgucguggugggggacgucgugggcauccucgcgcaggggaagaagaugauccggccccagcccauggagcacaaguacagcuggaaguccuggggcaaggccaagaucaucggcgccgacgugcagaacacgaccuucaucaucgacgggcccaacaccccggagugccccgacgaccagcgcgccuggaacaucugggaggucgaggacuacggcuucgggaucuucaccacgaacaucuggcugaagcugcgggacagcuacacccaggugugcgaccaccgccucauguccgcggccaucaaggacagcaaggccgugcacgccgacaugggcuacuggaucgaguccgagaagaacgagaccuggaagcuggcccgggcgagcuucaucgaggucaagaccugcaucuggcccaagucccacacgcuguggagcaacggcgugcucgaguccgagaugaucauccccaagaucuacgggggcccgaucagccagcacaacuaccgccccggguacuucacccagaccgccggccccuggcaccuggggaagcuggagcucgacuucgaccugugcgagggcaccacgguggucguggacgagcacugcggcaaccgggggccgucccugcgcaccaccaccgugacgggcaagaucauccacgaguggugcugccggagcugcacccugccgccccuccgcuucaagggggaggacggcugcugguacgggauggagauccggcccgucaaggagaaggaggagaaccuggugaaguccauggugagcgccggcagcggcgaggucgacuccuucagccucgggcugcugugcaucuccaucaugaucgaggaggugaugcgcagccgguggucccgcaagaugcucaugaccggcacccuggccguguuccuguuccucaucauggggcagcugacguggaacgaccugauccggcucugcaucauggucggcgccaacgcgagcgaccgcauggggaugggcaccaccuaccuggcccugauggccaccuucaagaugcgcccgauguucgccguggggcuccuguuccggcgccugacgucccgggaggugcuccugcugaccaucgggcucagccuggucgccuccguggagcugcccaacagccucgaggagcugggcgacgggcuggcgaugggcaucaugauccucaagcugcugaccgacuuccagucccaccagcucugggccacccugcugagccucacguucaucaagaccacccugucccugcacuacgccuggaagaccauggccaugguccucagcaucgugucccuguucccccugugccucagcacgaccucccagaagaccaccuggcugcccgugcugcucggcagcuucgggugcaagccgcuggcgauguuccugaucgccgagaacaagaucuggggccgcaaguccuggccccucaacgaggggaucauggccgucggcguggugagcauccugcugagcucccuccugaagaacgacgucccccuggccgggccccucaucgccggcggcaugcugaucgcgugcuacgugaucagcggguccagcgccgaccugucccucgagaaggccgccgaggugagcugggaggaggaggccgagcacuccggcgcgagccacaacauccuggucgaggugcaggacgacgggacgaugaagaucaaggacgaggagcgggacgacacccugaccauccuccugaaggccacccugcucgccguguccggcgucuacccgcugagcauccccgccacccuguucgugugguacuucuggcagaagaagaagcagcgcuccggggugcucugggacacgcccagcccgcccgaggucgagcgggccgugcuggacgacggcaucuaccgcaucaugcagcggggccugcuggggcgcucccaggugggcgucgggguguuccaggagaacguguuccacaccauguggcacgucacccggggcgcggugcucauguaccaggggaagcgccuggagcccagcugggccuccgugaagaaggaccugaucagcuacggcggcggguggcggcuccagggcuccuggaacaccggggaggagguccaggugaucgccguggagcccggcaagaaccccaagaacguccagacggcccccgggaccuucaagacccccgagggcgaggugggcgccaucgcgcuggacuucaagcccgggaccagcggcucccccaucgugaaccgcgaggggaagaucgucggccuguacggcaacgggguggugacgaccagcggcaccuacgucagcgccaucgcccaggccaaggcgucccaggaggggccgcuccccgagaucgaggacgagguguuccggaagcgcaaccugaccaucauggaccugcaccccggcagcgggaagacgcggcgcuaccucccggccaucgugcgggaggccaucaagcgcaagcugcggacccugauccucgcccccacccgcgucguggccuccgagauggcggaggcccugaagggcaugcccauccgcuaccagaccacggccgucaagagcgagcacaccggcaaggagaucgucgaccugaugugccacgccaccuucaccaugcggcuccugucccccgugcgcgugccgaacuacaacaugaucaucauggacgaggcccacuucacggaccccuucagcaucgcggcccggggguacaucuccacccgcgucggcaugggggaggccgccgccaucuucaugaccgcgacgccgcccggcagcguggaggccuucccgcaguccaacgccgugauccaggacgaggagcgggacauccccgagcgcagcuggaacuccggguacgaguggaucacggacuuccccggcaagaccgucugguucgugcccagcaucaaguccggcaacgacaucgccaacugccugcggaagaacgggaagcgcgugauccagcucagccggaagaccuucgacaccgaguaccagaagacgaagaacaacgacugggacuacgucgugaccaccgacaucuccgagaugggcgcgaacuuccgcgccgaccgggugaucgacccgcgccggugccugaagcccgucauccugaaggacgggcccgagcgcgugauccucgccggccccaugccggucaccguggccagcgccgcgcagcggcgcgggcggaucggccgcaaccacaacaaggagggcgaccaguacaucuacauggggcagccccugaacaacgacgaggaccacgcccacuggacggaggccaagaugcugcucgacaacaucaacacccccgagggcaucauccccgcccuguucgagccggagcgggagaaguccgccgcgaucgacggggaguaccgccugcgcggcgaggcccggaagaccuucguggagcucaugcgccgcggggaccugcccgucuggcugagcuacaagguggccuccgagggcuuccaguacagcgaccgccgguggugcuucgacggcgagcgcaacaaccaggugcucgaggagaacauggacgucgagaucuggaccaaggagggggagcggaagaagcugcgcccccgguggcuggacgcccgcacguacagcgacccccucgcccugcgggaguucaaggaguucgcggccggccgccgguccgugagcggggaccugauccucgagaucggcaagcugccgcagcaccugacccagcgcgcccagaacgcccucgacaaccuggugaugcugcacaacuccgagcagggcgggcgggcguaccgccacgccauggaggagcuccccgacaccaucgagacccugaugcugcucgcccugaucgccguccugacgggcggggugacccucuucuuccugagcggccgggggcugggcaagaccuccaucggccuccugugcgugauggccagcuccguccugcucuggauggcgagcguggagccccacuggaucgccgccuccaucauccuggaguucuuccugauggugcuccugauccccgagccggaccgccagcggacgccccaggacaaccagcuggccuacgucgugaucgggcuccuguucaugauccugaccguggccgcgaacgagaugggccuccuggagacgaccaagaaggaccuggggaucggccacgucgccguggagaaccaccaccacgccaccaugcucgacguggaccugcaccccgccagcgccuggacccuguacgcggucgccacgaccaucaucaccccgaugaugcgccacaccaucgagaacacgaccgccaacaucucccucaccgccaucgccaaccaggcggccauccugauggggcuggacaagggcuggcccaucagcaagauggacaucggcgugccccuccuggcccuggggugcuacucccaggugaacccccucacccugacggccgcgguccugaugcucguggcccacuacgccaucaucggcccggggcugcaggccaaggccacccgggaggcgcagaagcgcaccgccgccggcaucaugaagaaccccaccguggacgggaucgucgccaucgaccuggaccccgugguguacgacgccaaguucgagaagcagcucggccagaucaugcugcugauccucugcacgagccagauccugcugaugcgcaccaccugggcgcucugcgaguccaucacccuggccacgggcccccugaccacccucugggaggggagcccgggcaaguucuggaacaccacgaucgccgucuccauggccaacaucuuccgggggagcuaccuggccggcgcgggccuggccuucucccucaugaagucccucgggggcgggcgccgggggaccggggcccagggcgagacccugggcgagaaguggaagcgccagcucaaccagcugagcaaguccgaguucaacaucuacaagcggagcgggaucauggagguggaccgcuccgaggccaaggagggccugaagcgcggggagaccacgcgccacgcggugagccggggcaccgccaagcuccgcugguucgucgagcggaaccuggugaagcccgaggggaaggugaucgaccugggcugcggccgcgggggcugguccuacuacugcgccgggcugaagaaggucaccgaggugaagggcuacaccaagggcgggcccggccacgaggagcccaucccgauggccacguacggguggaaccucgugaagcugcacagcggcaaggacgucuucuucacgccgcccgagaagugcgacacccugcucugcgacaucggggaguccagccccaacccgaccaucgaggagggccggacgcugcgcgugcugaagaugguggagcccuggcuccgggggaaccaguucugcaucaagauccugaaccccuacaugcccuccgucguggagacccuggagcagaugcagcgcaagcacggcggcaugcucgugcggaacccgcugagccgcaacuccacccacgagauguacugggucagcugcgggaccggcaacaucguguccgccgugaacaugaccagccggaugcugcucaaccgcuucacgauggcgcaccgcaagcccaccuacgagcgggacgucgaccugggggccggcacccgccacguggccguggagcccgaggucgccaaccuggacaucaucggccagcggaucgagaacaucaagcacgagcacaaguccaccuggcacuacgacgaggacaaccccuacaagacgugggccuaccacgggagcuacgaggugaagccguccggcagcgcguccagcauggucaacgggguggugaagcuccugaccaagcccugggacgucauccccauggugacccagaucgccaugaccgacacgacccccuucggccagcagcgcguguucaaggagaaggucgacacccggaccccgaaggccaagcgcgggacggcccagaucauggaggugaccgcccgguggcuguggggcuuccucagccgcaacaagaagccccggaucugcacccgcgaggaguucacccggaaggugcgcuccaacgcggccaucggcgccgucuucguggacgagaaccaguggaacagcgccaaggaggcgguggaggacgagcgguucugggaccugguccagaaggagcgcgagcugcacaagcaggggaagugcgccacgugcguguacaacaugaugggcaagcgggagaagaagcucggggaguucggcaaggccaaggggucccgcgccaucugguacauguggcugggcgcccgguuccuggaguucgaggcgcucggcuucaugaacgaggaccacugguucagccgcgagaacucccugagcgggguggagggcgaggggcugcacaagcucggcuacauccugcgggacaucuccaagauccccgggggcaacauguacgccgacgacaccgccggcugggacacccgcaucaccgaggacgaccugcagaacgaggccaagaucacggacaucauggagccggagcacgcccuccuggcgaccagcaucuucaagcugaccuaccagaacaaggucgugcgggugcagcgccccgccaagaacgggaccgucauggacgugaucucccgccgggaccagcgcggcagcggccaggugggcacguacggccucaacaccuucaccaacauggaggcccagcugauccggcagauggaguccgaggggaucuuccugcccagcgagcucgagacccccaaccuggccgagcgcguccuggacuggcucgagaaguacggcguggagcggcugaagcgcauggccaucuccggggacgacugcguggucaagccgaucgacgaccgguucgcgacggcccugaccgcccucaacgacaugggcaaggugcgcaaggacaucccccagugggagcccagcaagggguggaacgacuggcagcagguccccuucugcucccaccacuuccaccagcugaucaugaaggacggccgggagaucgucgugccgugccgcaaccaggacgagcuggugggccgggcccgcgucagccagggggccggcuggucccuccgggagaccgcgugccugggcaagagcuacgcccagauguggcagcugauguacuuccaccgccgggaccuccgccuggccgccaacgcgaucugcagcgccgugcccguggacuggguccccaccucccggacgaccuggagcauccacgcccaccaccaguggaugaccaccgaggacaugcuguccguguggaaccgcguguggaucgaggagaaccccuggauggaggacaagacgcacgucagcuccuggggcgacgugccguaccucgggaagcgggaggaccaguggugcggcagccugaucggccugaccgcccgcgccaccugggcguccaacauccagguggccaucaaccagguccgccggcucaucgggaacgagaacuaccuggacuacaugaccagcaugaagcgcuucaagaacgagggcgaccccgagggggcccugugguga

SEQ ID NO: 8556 - RNA, 9879 nt, Artificial Sequence
  derived and/or modified CDS sequence (opt1) from DENV-1__FJ898390__SS-prME
agcgugaccaugcugcucaugcugaugcccaccgcccuggccuuccaccucaccacccggggcggggagccccacaugaucgugaccaagcaggagcggggcaagagccugcuguucaagaccagcgccggggugaacaugugcacccucaucgccauggaccugggcgagcugugcgaggacaccaugaccuacaagugcccccggaucaccgaggccgagcccgacgacguggacugcuggugcaacgccaccgacaccugggugaccuacgggaccugcagccagacgggcgagcaccggcgcgacaagcggagcguggcccucgcgccccacgugggccuggggcuggagacccgcaccgagaccuggauguccagcgagggcgccuggaagcagauccagcgggucgagacgugggcccuccgccaccccggguucaccgugaucgcccuguuccuggcgcacgccaucggcaccuccaucacccagaaggggaucaucuucauccuccugaugcuggugacgcccagcauggccaugcggugcgucggcaucggcucccgcgacuucguggaggggcucagcggcgccaccuggguggacgucgugcuggagcacggguccugcgugaccaccauggccaaggacaagcccacgcuggacaucgagcuccugaagaccgaggucaccaaccccgcggugcugcggaagcucugcaucgaggccaagaucagcaacaccacgaccgacucccgcugccccacccagggcgaggccacccugauggaggagcaggacgccaacuucgugugccggcgcacguucgucgaccggggcugggggaacggcugcgggcuguucggcaaggggagccucaucacgugcgccaaguucaagugcgugaccaagcuggagggcaagaucgugcaguacgagaaccugaaguacuccgucaucgugaccgugcacacgggcgaccagcaccaggucgggaacgagagcaccgagcacggcaccaccgcgaccaucacgccccaggcccccaccuccgagauccagcucaccgacuacggggcccugacccuggacugcagcccccgcacgggccucgacuucaacgagauggugcugcugaccaugaaggagaaguccuggcucguccacaagcagugguuccuggaccugccgcuccccuggaccagcggggccagcaccucccaggagacguggaaccggcaggaccugcuggugaccuucaagaccgcccacgcgaagaagcaggagguggucgugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgugaugugcaccggguccuucaagcucgagaaggaggucgcggagacgcagcacggcaccgugcuggugcagaucaaguacgagggcaccgacgcccccugcaagauccccuucagcacccaggacgagaagggggucacgcagaacggccggcugaucaccgccaacccgaucgugaccgacaaggagaagcccgugaacaucgaggccgagccgcccuucggggaguccuacaucgucaucggcgugggcgagaaggcgcugaagcucagcugguucaagaagggguccagcaucggcaagauguucgaggccaccgcccgcggggcccggcgcauggccauccugggcgacacggcgugggacuucggguccaucggcggcguguucaccagcgucgggaagcuggugcaccagaucuucggcaccgccuacgggguccuguucuccggcgucagcuggaccaugaagaucgggaucggcgugcugcugacguggcucggccugaacucccgcagcaccucccugagcaugaccugcaucgccguggggcucgucacccuguaccugggcgugauggugcaggccgacuccgggugcgucaucaacuggaagggccgggagcucaagugcgggagcggcaucuucgugacgaacgaggugcacaccuggaccgagcaguacaaguuccaggccgacagcccgaagcgccuguccgcggccaucggcaaggccugggaggagggggucugcggcauccggagcgccacccgccuggagaacaucauguggaagcagaucuccaacgagcucaaccacauccugcuggagaacgacaugaaguucaccgugguggucggggacguggugggcauccucgcccaggggaagaagaugauccggccccagcccauggagcacaaguacagcuggaaguccuggggcaaggcgaagaucaucggcgccgacguccagaacacgaccuucaucaucgacgggcccaacaccccggagugccccgacgaccagcgcgccuggaacaucugggagguggaggacuacggcuucgggaucuucaccacgaacaucuggcugaagcugcgggacagcuacacccaggugugcgaccaccgccucauguccgccgcgaucaaggacagcaaggccguccacgccgacaugggcuacuggaucgaguccgagaagaacgagaccuggaagcuggcccgggccagcuucaucgaggugaagaccugcaucuggcccaagucccacacgcuguggagcaacggcgugcucgaguccgagaugaucauccccaagaucuacgggggcccgaucagccagcacaacuaccgccccggguacuucacccagaccgcgggccccuggcaccuggggaagcuggagcucgacuucgaccugugcgagggcaccacggucgugguggacgagcacugcggcaaccgggggccgucccugcgcaccaccaccgucacgggcaagaucauccacgaguggugcugccggagcugcacccugccgccccuccgcuucaagggggaggacggcugcugguacgggauggagauccggcccgugaaggagaaggaggagaaccuggugaaguccauggucagcgccggcagcggcgagguggacuccuucagccucgggcugcugugcaucuccaucaugaucgaggaggugaugcgcagccgguggucccgcaagaugcucaugaccggcacccuggccgucuuccugcuccugaucauggggcagcugacguggaacgaccucauccggcugugcaucauggugggcgccaacgccagcgaccgcauggggaugggcaccaccuaccuggcgcucauggccaccuucaagaugcgcccgauguucgccguggggcugcuguuccggcgccucacgucccgggagguccugcugcucaccaucgggcugagccugguggccuccgucgagcuccccaacagccuggaggagcugggcgacgggcucgccaugggcaucaugauccugaagcugcucaccgacuuccagucccaccagcugugggcgacccugcucagccugacguucaucaagaccacccugucccuccacuacgccuggaagaccauggccauggugcugagcaucgugucccuguucccccucugccugagcacgaccucccagaagaccaccuggcugcccguccuccugggcagccuggggugcaagccgcucacgauguuccugaucgccgagaacaagaucuggggccgcaaguccuggccccugaacgaggggaucauggcggugggcguggucagcauccuccugagcucccugcucaagaacgacgugccccuggccgggccccugaucgccggcggcaugcucaucgccugcuacgugaucagcggguccagcgccgaccugucccuggagaaggcggccgaggucagcugggaggaggaggccgagcacuccggcgccagccacaacauccucguggaggugcaggacgacgggaccaugaagaucaaggacgaggagcgggacgacacccugaccauccugcucaaggccacccugcuggcggucuccggcguguacccgcucagcauccccgccacgcuguucgugugguacuucuggcagaagaagaagcagcgcuccgggguccugugggacacccccagcccgcccgagguggagcgggccgugcuggacgacggcaucuaccgcaucaugcagcggggccuccuggggcgcucccaggucggcguggggguguuccaggagaacgucuuccacaccauguggcacgugacccggggcgccgugcugauguaccaggggaagcgccucgagcccagcugggccuccgucaagaaggaccugaucagcuacggcggcggguggcggcugcagggcuccuggaacacgggggaggagguccaggugaucgcggucgagcccggcaagaaccccaagaacgugcagaccgcccccgggaccuucaagacccccgagggcgaggugggcgccaucgcccucgacuucaagcccgggacgagcggcucccccaucgucaaccgcgaggggaagaucgugggccuguacggcaacgggguggucaccaccagcggcaccuacgugagcgccaucgcgcaggccaaggccucccaggaggggccgcugcccgagaucgaggacgagguguuccggaagcgcaaccucacgaucauggaccugcaccccggcagcgggaagacccggcgcuaccugccggccaucguccgggaggcgaucaagcgcaagcuccggacccugauccuggcccccacccgcgugguggccuccgagauggccgaggcccucaagggcaugcccauccgcuaccagacgaccgcggucaagagcgagcacaccggcaaggagaucguggaccugaugugccacgccaccuucacgaugcggcugcucucccccgugcgcgucccgaacuacaacaugaucaucauggacgaggcccacuucaccgaccccagcuccaucgccgcccggggguacaucagcacccgcgugggcaugggggaggcggccgccaucuucaugaccgccacgccgcccggcuccguggaggccuucccgcagagcaacgcggucauccaggacgaggagcgggacauccccgagcgcuccuggaacagcggguacgaguggaucaccgacuuccccggcaagaccgugugguucgugcccuccaucaagagcggcaacgacaucgccaacugccugcggaagaacgggaagcgcgucauccagcugucccggaagaccuucgacacggaguaccagaagaccaagaacaacgacugggacuacguggugaccaccgacaucagcgagaugggcgccaacuuccgcgccgaccgggucaucgacccgcgccggugccucaagcccgugauccugaaggacgggcccgagcgcgucauccuggcgggccccaugccggugacgguggccuccgccgcccagcggcgcgggcggaucggccgcaaccacaacaaggagggcgaccaguacaucuacauggggcagccccucaacaacgacgaggaccacgcccacuggaccgaggcgaagaugcugcuggacaacaucaacacccccgagggcaucauccccgcccucuucgagccggagcgggagaaguccgccgccaucgacggggaguaccgccugcgcggcgaggcccggaagaccuucgucgagcugaugcgccgcggggaccuccccguguggcuguccuacaagguggcgagcgagggcuuccaguacagcgaccgccgguggugcuucgacggcgagcgcaacaaccagguccuggaggagaacauggacguggagaucuggacgaaggagggggagcggaagaagcuccgcccccgguggcuggacgcccgcaccuacuccgacccccuggcccuccgggaguucaaggaguucgccgccggccgccggagcguguccggggaccugauccuggagaucggcaagcucccgcagcaccugacccagcgcgcgcagaacgcccuggacaaccucgucaugcugcacaacagcgagcagggcgggcgggccuaccgccacgccauggaggagcugcccgacaccaucgagacgcucaugcugcuggcgcucaucgccgugcugaccggcggggugacccuguucuuccucuccggccgggggcugggcaagaccagcaucggccugcucugcgucauggccuccagcgugcugcuguggauggccuccguggagccccacuggaucgccgcgagcaucauccucgaguucuuccugaugguccugcucauccccgagccggaccgccagcggacgccccaggacaaccagcuggccuacguggugaucgggcuccucuucaugauccugacggucgccgccaacgagaugggccugcucgagaccaccaagaaggaccuggggaucggccacguggccguggagaaccaccaccacgcgaccaugcuggacgucgaccuccaccccgccuccgccuggacgcuguacgccguggccaccaccaucaucaccccgaugaugcgccacacgaucgagaacaccaccgcgaacaucagccugaccgccaucgccaaccaggccgccauccucauggggcuggacaagggcuggcccaucuccaagauggacaucggcgugccccugcucgcgcuggggugcuacagccaggucaacccccugacgcucaccgccgccgugcugaugcugguggcccacuacgcgaucaucggcccggggcuccaggccaaggccacccgggaggcccagaagcgcaccgccgcgggcaucaugaagaaccccacggucgacgggaucguggccaucgaccuggaccccguggucuacgacgccaaguucgagaagcagcugggccagaucaugcuccugauccugugcaccucccagauccuccugaugcgcaccaccugggcccugugcgagagcaucacgcucgccaccggcccccugaccacccugugggagggguccccgggcaaguucuggaacacgaccaucgcggugagcauggccaacaucuuccggggguccuaccucgccggcgccggccuggccuucagccugaugaagucccucgggggcgggcgccggggcaccggggcgcagggcgagacccugggcgagaaguggaagcgccagcugaaccagcucuccaagagcgaguucaacaucuacaagcgguccgggaucauggagguggaccgcagcgaggccaaggagggccugaagcgcggggagacgacccgccacgccgucucccggggcaccgccaagcugcgcugguucguggagcggaaccuggugaagcccgaggggaaggucaucgaccucggcugcggccgcgggggcuggagcuacuacugcgcggggcugaagaaggugaccgaggugaagggcuacacgaagggcgggcccggccacgaggagcccaucccgauggccaccuacggguggaaccuggucaagcuccacuccggcaaggacguguucuucacgccgcccgagaagugcgacacccugcugugcgacaucggggagagcucccccaacccgacgaucgaggagggccggacccuccgcgugcugaagauggucgagcccuggcugcgggggaaccaguucugcaucaagauccucaaccccuacaugcccagcgugguggagacccuggagcagaugcagcgcaagcacggcggcaugcugguccggaacccgcucucccgcaacagcacccacgagauguacuggguguccugcgggaccggcaacaucgugagcgccgucaacaugacgucccggaugcugcugaaccgcuucaccauggcccaccgcaagcccaccuacgagcgggacguggaccucggggccggcacccgccacguggcggucgagcccgagguggccaaccuggacaucaucggccagcggaucgagaacaucaagcacgagcacaagagcacguggcacuacgacgaggacaaccccuacaagaccugggccuaccacggguccuacgaggucaagccgagcggcuccgccagcagcauggugaacgggguggucaagcugcucaccaagcccugggacgugauccccauggugacccagaucgccaugacggacaccacccccuucggccagcagcgcgucuucaaggagaagguggacacccggacgccgaaggcgaagcgcgggaccgcccagaucauggaggugaccgcccgguggcuguggggcuuccugucccgcaacaagaagccccggaucugcacccgcgaggaguucacgcggaagguccgcagcaacgccgccaucggcgcgguguucguggacgagaaccaguggaacuccgccaaggaggccgucgaggacgagcgguucugggaccucgugcagaaggagcgcgagcugcacaagcaggggaagugcgcgaccugcguguacaacaugaugggcaagcgggagaagaagcugggggaguucggcaaggcgaaggggagccgcgccaucugguacauguggcucggcgcccgguuccuggaguucgaggcccugggcuucaugaacgaggaccacugguucucccgcgagaacagccucuccggggucgagggcgaggggcugcacaagcugggcuacauccuccgggacaucagcaagauccccgggggcaacauguacgccgacgacaccgcgggcugggacacccgcaucacggaggacgaccugcagaacgaggccaagaucaccgacaucauggagccggagcacgcccugcucgccaccuccaucuucaagcugaccuaccagaacaagguggugcggguccagcgccccgccaagaacgggacggugauggacgugaucagccgccgggaccagcgcggcuccgggcaggucggcaccuacggccugaacaccuucaccaacauggaggcgcagcucauccggcagauggagagcgaggggaucuuccugcccuccgagcuggagacgcccaaccucgccgagcgcgugcuggacuggcuggagaagcacggcguggagcggcucaagcgcauggccaucagcggggacgacugcgucgugaagccgaucgacgaccgguucgccaccgcccugaccgcgcugaacgacaugggcaaggugcgcaaggacaucccccagugggagcccuccaagggguggaacgacuggcagcagguccccuucugcagccaccacuuccaccagcucaucaugaaggacggccgggagaucguggugccgugccgcaaccaggacgagcuggucggccgggcccgcgugucccagggggccggcuggagccugcgggagaccgccugccucggcaagagcuacgcccagauguggcagcugauguacuuccaccgccgggaccugcgccucgcggccaacgccaucugcuccgccgugcccgucgacugggugcccacgagccggaccaccugguccauccacgcgcaccaccaguggaugaccacggaggacaugcugagcguguggaaccgcgucuggaucgaggagaaccccuggauggaggacaagacccacguguccagcuggggcgacgugccguaccuggggaagcgggaggaccaguggugcggcucccucaucggccugaccgcccgcgccaccugggccagcaacauccaggucgccaucaaccaggugcgccggcugaucgggaacgagaacuaccucgacuacaugaccuccaugaagcgcuucaagaacgagggcgaccccgagggggcgcugugguga

SEQ ID NO: 8557 - RNA, 9879 nt, Artificial Sequence
  derived and/or modified CDS sequence (opt1) from DENV-1__FJ898391__SS-prME
agcgugaccaugcugcucaugcugaugcccaccgcccuggccuuccaccucacgacccggggcggggagccccacaugaucgugagcaagcaggagcggggcaagagccugcuguucaagaccagcgcgggggugaacaugugcacccucaucgccauggaccugggcgaguucugcgaggacacgaugaccuacaagugcccccgcaucaccgaggccgagcccgacgacguggacugcuggugcaacgccaccgacacgugggugaccuacgggaccugcagccagaccggcgagcaccggcgggacaagcgguccguggcccuggcgccccacgugggccucgggcuggagacgcgcaccgagaccuggaugagcuccgagggcgccuggaagcagauccagcggguggagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugcccgacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaagaccguccaguacgagaaccugaaguacagcgugaucgugaccguccacacgggcgaccagcaccagguggggaacgaguccaccgagcacggcaccaccgcgaccaucacgccccaggcccccagcaccgagauccagcugaccgacuacggggcccucacccuggacugcagcccccggacgggccuggacuucaacgagaugguccuccugaccaugaaggagaaguccuggcuggugcacaagcagugguuccucgaccugccgcugcccuggaccagcggggccuccaccagccaggagacguggaaccggaaggaccuccuggugaccuucaagaccgcccacgcgaagaagcaggaggucguggugcugggcucccaggagggcgccaugcacaccgcccucacgggggccaccgagauccagaccagcggcaccacgaccaucuucgccgggcaccugaagugccgccugaagauggacaagcucacccugaagggcauguccuacgucaugugcaccgggagcuucaagcuggagaaggagguggcggagacgcagcacggcaccgugcucguccagaucaaguacgagggcaccgacgcccccugcaagauccccuucuccacccaggacgagaagggggugacgcagaacggccggcugaucaccgccaacccgaucgugaccgacaaggagaagcccgucaacaucgaggccgagccgcccuucggggagagcuacaucgugaucggcgcgggcgagaaggcccugaagcuguccugguucaagaaggggagcuccaucggcaagauguucgaggccaccgcccgcggggcccggcgcauggcgauccucggcgacacggccugggacuucgggagcaucggcggcguguucaccuccgucgggaagcuggugcaccagaucuucggcaccgccuacggggugcuguucagcggcgucuccuggaccaugaagaucgggaucggcgugcuccugacguggcugggccucaacagccgcuccaccagccuguccaugaccugcaucgccguggggcuggucacccucuaccugggcgugauggugcaggccgacagcgggugcgucaucaacuggaagggccgggagcugaagugcgggagcggcaucuucgugacgaacgaggugcacaccuggaccgagcaguacaaguuccaggcggacuccccgaagcgccucagcgccgccaucggcaaggccugggaggagggggucugcggcauccgguccgccacccgccuggagaacaucauguggaagcagaucagcaacgagcugaaccacauccuccuggagaacgacaugaaguucaccgugguggucggggacguggcgggcauccuggcccaggggaagaagaugauccggccccagcccauggaguacaaguacuccuggaaguccuggggcaaggccaagaucaucggcgccgacgugcagaacacgaccuucaucaucgacgggcccaacaccccggagugccccgacgaccagcgcgcguggaacaucugggaggucgaggacuacggcuucgggaucuucaccacgaacaucuggcucaagcugcgggacuccuacacccaggugugcgaccaccgccugaugagcgccgccaucaaggacuccaaggccgugcacgccgacaugggcuacuggaucgagagcgagaagaacgagaccuggaagcucgcgcgggccuccuucaucgaggucaagaccugcaucuggcccaagagccacacgcugugguccaacggcgugcuggagagcgagaugaucauccccaagaucuacgggggcccgaucucccagcacaacuaccgccccggguacuucacccagaccgccggccccuggcaccucgggaagcuggagcuggacuucgaccucugcgagggcaccacgguggucguggacgagcacugcggcaaccgggggccgagccugcgcaccaccaccgugacgggcaagaucauccacgaguggugcugccgguccugcacccugccgccccugcgcuucaagggggaggacggcugcugguacgggauggagauccggcccgucaaggagaaggaggagaaccuggucaagagcauggugagcgccggcuccggcgaggucgacagcuucucccuggggcuccugugcaucagcaucaugaucgaggaggugaugcgcucccgguggagccgcaagaugcugaugaccggcacccucgccguguucuuccugcugaucauggggcagcucacguggaacgaccugauccggcugugcaucauggucggcgcgaacgccuccgaccgcauggggaugggcaccaccuaccucgcccugauggccaccuucaagaugcgcccgauguucgccguggggcuccuguuccggcgccugacgagccgggaggugcugcuccugaccaucgggcugucccucgucgcgagcguggagcugcccaacucccuggaggagcucggcgacgggcuggccaugggcaucaugauccugaagcuccugaccgacuuccagagccaccagcugugggccacccuccugucccugacguucaucaagaccaccuucagccuccacuacgccuggaagaccauggcgaugguccuguccaucgugagccuguucccccucugccuguccacgaccagccagaagaccaccuggcugcccgugcuccugggcucccuggggugcaagccgcucacgauguuccugaucgccgagaacaagaucuggggccgcaagagcuggccccugaacgaggggaucauggccgucggcaucgugagcauccuccuguccagccugcucaagaacgacgugccccuggccgggccccugaucgccggcggcaugcucaucgcgugcuacgucaucuccgggagcuccgccgaccugagccuggagaaggccgccgagguguccugggaggaggaggccgagcacagcggcgcgucccacaacauccucguggagguccaggacgacgggaccaugaagaucaaggacgaggagcgggacgacacccugaccauccugcucaaggccacccugcuggccgugagcggcguguacccgcucuccauccccgccacgcuguucgucugguacuucuggcagaagaagaagcagcgcagcggggugcugugggacacccccagcccgcccgagguggagcgggccguccucgacgacggcaucuaccgcaucaugcagcggggccugcuggggcgcagccaggugggcgugggggucuuccaggagaacguguuccacaccauguggcacgugacccggggcgcgguccugauguaccaggggaagcgccucgagcccuccugggccagcgugaagaaggaccugaucuccuacggcggcggguggcggcugcagggcagcuggaacacgggggaggaggugcaggucaucgccguggagcccggcaagaaccccaagaacgugcagaccgcccccgggaccuucaagaccuccgagggcgaggucggcgccaucgcgcucgacuucaagcccgggacgagcggcagccccaucgugaaccgcgaggggaagaucgugggccuguacggcaacggggucgugaccaccuccggcaccuacgugagcgccaucgcccaggccaaggcgucccaggaggggccccugccggagaucgaggacgaggucuuccggaagcgcaaccucacgaucauggaccugcaccccggcagcgggaagacccggcgcuaccugcccgccaucgugcgggaggccaucaagcgcaagcuccggacccugauccuggccccgacccgcguggucgccuccgagauggcggaggcccucaagggcaugcccauccgcuaccagacgaccgccgucaagagcgagcacaccggcaaggagaucguggaccugaugugccacgccaccuucacgaugcggcugcucucccccguccgcgugcccaacuacaacaugaucaucauggacgaggcccacuucaccgacccgagcuccaucgcggcccggggguacaucagcacccgcgugggcaugggggaggccgccgccaucuucaugaccgcgacgccgcccggcuccgucgaggccuucccccagagcaacgccgugauccaggacgaggagcgggacaucccggagcgcuccuggaacagcggguacgaguggaucaccgacuuccccggcaagaccgugugguucguccccuccaucaagagcggcaacgacaucgccaacugccugcggaagaacgggaagcgcgugauccagcugucccggaagaccuucgacacggaguaccagaagaccaagaacaacgacugggacuacguggucaccaccgacaucagcgagaugggcgcgaacuuccgcgccgaccgggugaucgacccccgccggugccucaagccggugauccugaaggacgggcccgagcgcgucauccuggccggccccaugcccgugacggucgccuccgccgcgcagcggcgcgggcggaucggccgcaaccacaacaaggagggcgaccaguacaucuacauggggcagccgcucaacaacgacgaggaccacgcccacuggaccgaggccaagaugcugcuggacaacaucaacacccccgagggcaucauccccgcccucuucgagcccgagcgggagaaguccgccgcgaucgacggggaguaccgccugcgcggcgaggcccggaagaccuucguggagcugaugcgccgcggggaccucccgguguggcugagcuacaaggucgccuccgagggcuuccaguacagcgaccgccgguggugcuucgacggcgagcgcaacaaccaggugcuggaggagaacauggacguggagaucuggacgaaggagggggagcggaagaagcuccgcccccgguggcuggacgcccgcaccuacuccgacccccuggcccuccgggaguucaaggaguucgcggccggccgccggagcgucuccggggaccugauccuggagaucggcaagcucccccagcaccugacccagcgcgcccagaacgcccuggacaaccucgugaugcugcacaacagcgagcagggcgggcgggcguaccgccacgccauggaggagcugccggacaccaucgagacgcucaugcugcuggcccucaucgccgugcugaccggcggggucacccuguucuuccucuccggccgggggcugggcaagaccagcaucggccugcucugcgugauggccuccagcgugcugcuguggauggcguccgucgagccccacuggaucgccgccagcaucauccucgaguucuuccugauggugcugcucauccccgagcccgaccgccagcggaccccgcaggacaaccagcuggccuacguggucaucgggcuccucuucaugauccugacgguggccgcgaacgagaugggccugcucgagaccaccaagaaggaccuggggaucggccacguggccgucgagaaccaccaccacgccgccaugcuggacguggaccuccaccccgccuccgcguggacccuguacgccguggccacgaccaucaucacccccaugaugcgccacaccaucgagaacacgaccgccaacaucagccugaccgccaucgcgaaccaggccgccauccucauggggcuggacaagggcuggccgaucuccaagauggacaucggcgucccccugcucgcccuggggugcuacagccaggugaacccccugacccucacggcggccgugcugaugcuggucgcccacuacgccaucaucggccccgggcuccaggccaaggcgacccgggaggcccagaagcgcaccgccgccggcaucaugaagaacccgaccguggacgggaucguggccaucgaccuggaccccgucguguacgacgcgaaguucgagaagcagcugggccagaucaugcuccugauccugugcacgucccagauccuccugaugcgcaccaccugggcccugugcgagagcaucacccucgccacgggcccccugaccacccugugggaggggucccccggcaaguucuggaacaccacgaucgccgugagcauggccaacaucuuccgggggagcuaccucgcgggcgccggccuggccuucucccugaugaagucccucgggggcgggcgccggggcaccggggcccagggcgagacccugggcgagaaguggaagcgccagcugaaccagcucuccaagagcgaguucaacaccuacaagcgguccgggaucauggaggucgaccgcagcgaggcgaaggagggccugaagcgcggggagacgaccaagcacgccgugucccgcggcaccgccaagcugcggugguucguggagcgcaaccucgucaagccggaggggaaggugaucgaccugggcugcggccgcggcggguggagcuacuacugcgccgggcugaagaaggugaccgaggucaagggguacacgaagggcgggcccggccacgaggagcccauccccauggccaccuacggguggaaccuggugaagcuccacuccggcaaggacguguucuucaucccgcccgagaagugcgacacccugcugugcgacaucggggagagcucccccaaccccaccaucgaggagggccgcacgcuccggguccugaagaugguggagccguggcugcgcgggaaccaguucugcaucaagauccucaaccccuacaugcccagcguggucgagacccuggagcagaugcagcggaagcacggcggcaugcuggugcgcaacccccucucccggaacagcacccacgagauguacuggguguccugcgggaccggcaacaucgucagcgcggugaacaugaccucccgcaugcugcugaaccgguucacgauggcccaccgcaagccgaccuacgagcgcgacguggaccucggggccggcacccggcacgucgccguggagcccgagguggccaaccuggacaucaucggccagcgcaucgagaacaucaagcacgagcacaagagcaccuggcacuacgacgaggacaaccccuacaagacgugggcguaccacggguccuacgaggucaagcccagcggcagcgccuccagcauggugaacggggucgugaagcugcucaccaagccgugggacgugauccccauggucacccagaucgccaugaccgacacgacccccuucggccagcagcggguguucaaggagaagguggacacccgcacccccaaggccaagcgggggacggcccagaucauggaggucaccgcgaaguggcuguggggcuuccugucccgcaacaagaagccgcggaucugcacccgcgaggaguucacccggaaggugcgcagcaacgccgccaucggcgccguguucgucgacgagaaccaguggaacuccgcgaaggaggccguggaggacgagcgguucugggaccucgugcaccgcgagcgggagcugcacaagcaggggaagugcgccacgugcgucuacaacaugaugggcaagcgcgagaagaagcugggggaguucggcaaggccaaggggagccgggccaucugguacauguggcucggcgcgcgcuuccuggaguucgaggcccugggcuucaugaacgaggaccacugguucucccgggagaacagccucuccgggguggagggcgaggggcugcacaagcugggcuacauccuccgcgacaucagcaagauccccgggggcaacauguacgccgacgacaccgccggcugggacacccggaucaccgaggacgaccugcagaacgaggccaagaucacggacaucauggagcccgagcacgcgcugcucgccaaguccaucuucaagcugaccuaccagaacaaggugguccgcgugcagcggccggccaagaacgggaccgugauggacgucaucagccgccgcgaccagcggggcuccggccaggugggcaccuacggccugaacacguucaccaacauggaggcccagcucauccgccagauggagagcgaggggaucuucucccccagcgagcuggagacccccaaccuggccggccgggugcucgacuggcuggagaagcacggggucgagcgccugaagcggauggcgaucuccggcgacgacugcguggugaagcccaucgacgaccgcuucgccaccgcccucacggcccugaacgacauggggaagguccggaaggacaucccgcagugggagcccagcaagggcuggaacgacuggcagcagguccccuucugcagccaccacuuccaccagcugaucaugaaggacggccgcgagaucgugguccccugccggaaccaggacgagcucguggggcgcgcccgggugucccagggcgcgggguggagccugcgcgagaccgccugccugggcaaguccuacgcccagauguggcagcucauguacuuccaccggcgcgaccugcggcuggccgcgaacgccaucugcagcgccgucccgguggacugggugcccaccucccgcaccacguggagcauccacgcccaccaccaguggaugaccaccgaggacaugcucuccgucuggaaccggguguggaucgaggagaaccccuggauggaggacaagacccacaucagcuccuggggcgacgugcccuaccugggcaagcgcgaggaccaguggugcggcagccugaucgggcucacggcccgggcgaccugggccaccaacauccaggucgccaucaaccaggugcgccgccugaucggcaacgagaacuaccuggacuacaugaccuccaugaagcgguucaagaacgagagcgacccggagggggcccucugguga

SEQ ID NO: 8558 - RNA, 9879 nt, Artificial Sequence
  derived and/or modified CDS sequence (opt1) from DENV-1__FJ898392__SS-prME
agcgugaccaugcugcucaugcugaugcccaccgcccuggccuuccaccucaccacccggggcggggagccccacaugaucgugaccaagcaggagcggggcaagagccugcuguucaagaccagcgcgggggugaacaugugcacccucaucgccauggaccugggcgagcugugcgaggacaccaugaccuacaagugcccccgcaucaccgaggccgagcccgacgacguggacugcuggugcaacgccaccgacaccugggugaccuacgggaccugcagccagacgggcgagcaccggcgcgacaagcggagcguggcccucgcgccccacgugggccuggggcuggagacccgcaccgagaccuggauguccagcgagggcgccuggaagcagauccagcggguggagacgugggcccuccgccaccccggguucaccgugaucgcccuguuccuggcgcacgccaucggcaccuccaucacccagaaggggaucaucuucauccuccugaugcuggugacgcccagcauggccaugcggugcgucggcaucggcucccgcgacuucguggaggggcucagcggcgccaccuggguggacgucgugcuggagcacggguccugcgugaccaccauggccaaggacaagcccacgcuggacaucgagcuccugaagaccgaggucaccaaccccgcggugcugcggaagcucugcaucgaggccaagaucagcaacaccacgaccgacucccgcugccccacccagggcgaggccacccugauggaggagcaggacgccaacuucgugugccggcgcacguucgucgaccggggcugggggaacggcugcgggcuguucggcaaggggagccucaucacgugcgccaaguucaagugcgugaccaagcuggagggcaagaucgugcaguacgagaaccugaaguacuccgucaucgugaccgugcacacgggcgaccagcaccaggucgggaacgagagcaccgagcacggcaccaccgcgaccaucacgccccaggcccccaccuccgagauccagcucaccgacuacggggcccugacccuggacugcagcccccgcacgggccucgacuucaacgagauggugcugcugaccaugaaggagaaguccuggcucguccacaagcagugguuccuggaccugccgcuccccuggaccagcggggccagcaccucccaggagacguggaaccggcaggaccugcuggugaccuucaagaccgcccacgcgaagaagcaggagguggucgugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgugaugugcaccggguccuucaagcucgagaaggaggucgcggagacgcagcacggcaccgugcuggugcagaucaaguacgagggcaccgacgcccccugcaagauccccuucagcacccaggacgagaagggggucacgcagaacggccggcugaucaccgccaacccgaucgugaccgacaaggagaagcccgugaacaucgaggccgagccgcccuucggggaguccuacaucgucaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcguggggaagcugguccaccagaucuucggcaccgccuacgggguccuguucuccggcgugagcuggaccaugaagaucgggaucggcguccugcugacguggcucggccugaacucccgcagcaccucccugagcaugaccugcaucgccguggggcucgugacccuguaccugggcgucauggugcaggccgacuccgggugcgugaucaacuggaagggccgggagcucaagugcgggagcggcaucuucgucacgaacgaggugcacaccuggaccgagcaguacaaguuccaggcggacagcccgaagcgccuguccgccgccaucggcaaggccugggaggagggggugugcggcauccggagcgccacccgccuggagaacaucauguggaagcagaucuccaacgagcucaaccacauccugcuggagaacgggaugaaguucaccgucguggugggcgacgucguggggauccucgcgcagggcaagaagaugauccggccccagcccauggagcacaaguacagcuggaaguccuggggcaaggccaagaucaucggggccgacgugcagaacacgaccuucaucaucgacggccccaacaccccggagugccccgacgaccagcgcgccuggaacaucugggaggucgaggacuacggguucggcaucuucaccacgaacaucuggcugaagcugcgggacagcuacacccaggugugcgaccaccgccucauguccgcggccaucaaggacagcaaggccgugcacgccgacaugggcuacuggaucgaguccgagaagaacgagaccuggaagcuggcccgggcgagcuucaucgaggucaagaccugcaucuggcccaagucccacacgcuguggagcaacggggugcucgaguccgagaugaucauccccaagaucuacggcgggccgaucagccagcacaacuaccgccccggcuacuucacccagaccgccgggcccuggcaccugggcaagcuggagcucgacuucgaccugugcgagggcaccacgguggucguggacgagcacugcgggaaccggggcccgucccugcgcaccaccaccgugacggggaagaucauccacgaguggugcugccggagcugcacccugccgccccuccgcuucaagggcgaggacgggugcugguacggcauggagauccggcccgucaaggagaaggaggagaaccuggugaaguccauggugagcgccggcagcggggaggucgacuccuucagccucggccugcugugcaccuccaucaugaucgaggaggugaugcgcagccgguggucccgcaagaugcucaugaccgggacgcuggccguguuccugcuccugaucaugggccagcugaccuggaacgaccucauccggcugugcaucauggucggggccaacgcgagcgaccgcaugggcaugggcaccaccuaccuggcccucauggccacguucaagaugcgcccgauguucgccguggggcugcuguuccggcgccucaccucccgggaggugcugcugcucaccaucgggcugagccuggucgccuccguggagcuccccaacagccuggaggagcugggggacggccucgcgaugggcaucaugauccugaagcugcucaccgacuuccagucccaccagcugugggccacgcugcucagccugaccuucaucaagaccacccugucccuccacuacgccuggaagacgauggccaugguccugagcaucgugucccuguucccccucugccugagcaccaccucccagaagaccacguggcugcccgugcuccuggggagccugggcugcaagccgcucaccauguuccugaucgcggagaacaagaucugggggcgcaaguccuggccccugaacgagggcaucauggccgucgggguggugagcauccuccugagcucccugcucaagaacgacgucccccuggccggcccccugaucgccggcgggaugcucaucgccugcuacgugaucagcggcuccagcgcggaccugucccuggagaaggccgccgaggugagcugggaggaggaggccgagcacuccggggccagccacaacauccucgucgaggugcaggacgacggcaccaugaagaucaaggacgaggagcgggacgacacccugaccauccugcucaaggcgacgcugcuggccguguccggggucuacccgcucagcauccccgccacccuguucgugugguacuucuggcagaagaagaagcagcgcuccggcgugcugugggacacccccagcccgcccgaggucgagcgggccgugcuggacgacggcaucuaccgcaucaugcagcgggggcuccugggccgcucccaggugggggucggcguguuccaggagaacguguuccacaccauguggcacgucacgcgcggggccgugcugauguaccagggcaagcgccucgagcccagcugggcguccgugaagaaggaccugaucagcuacggcgggggcuggcggcugcagggguccuggaacaccggcgaggagguccaggugaucgccguggagcccgggaagaaccccaagaacguccagaccgcccccggcaccuucaagacgcccgagggcgaggugggggccaucgcccucgacuucaagcccggcaccagcgggucccccaucgugaaccgcgagggcaagaucgucggccuguacgggaacggcguggugaccaccagcgggacguacgucagcgcgaucgcccaggccaaggccucccaggagggcccgcugcccgagaucgaggacgagguguuccggaagcgcaaccucaccaucauggaccugcaccccgggagcggcaagacccggcgcuaccugccggcgaucgugcgggaggccaucaagcgcaagcuccggacccugauccuggcccccacgcgcgucguggccuccgagauggccgaggcgcucaagggcaugcccauccgcuaccagaccaccgccgucaagagcgagcacaccgggaaggagaucgucgaccugaugugccacgccacguucaccaugcggcugcucucccccgugcgcgugccgaacuacaacaugaucaucauggacgaggcccacuucaccgaccccagcuccaucgccgcgcggggcuacaucagcacccgcgucgggaugggcgaggccgccgccaucuucaugacggccacgccgcccggguccguggaggcguucccgcagagcaacgccgugauccaggacgaggagcgggacauccccgagcgcuccuggaacagcggcuacgaguggaucaccgacuuccccggcaagaccgucugguucgugcccuccaucaagagcgggaacgacaucgccaacugccugcggaagaacggcaagcgcgugauccagcugucccggaagacguucgacaccgaguaccagaagaccaagaacaacgacugggacuacgucgugaccacggacaucagcgagaugggggccaacuuccgcgcggaccgggugaucgacccgcgccggugccucaagcccgucauccugaaggacggccccgagcgcgugauccuggccgggcccaugccggucaccguggccuccgccgcccagcggcgcggccggaucggccgcaaccacaacaaggagggggaccaguacaucuacaugggccagccccucaacaacgacgaggaccacgcgcacuggaccgaggccaagaugcugcuggacaacaucaacacccccgaggggaucauccccgcccucuucgagccggagcgggagaaguccgccgccaucgacggcgaguaccgccugcgcggggaggcgcggaagacguucguggagcugaugcgccggggcgaccuccccgucuggcuguccuacaagguggccagcgagggcuuccaguacagcgaccgccgguggugcuucgacggggagcgcaacaaccaggugcuggaggagaacauggacgucgagaucuggaccaaggagggcgagcggaagaagcuccgcccccgguggcuggacgcccgcaccuacuccgacccccuggcccuccgggaguucaaggaguucgccgcggggcgccggagcguguccggcgaccugauccuggagaucggcaagcucccgcagcaccugacccagcgcgcccagaacgcccuggacaaccucgugaugcugcacaacagcgagcagggcgggcgggccuaccgccacgcgauggaggagcugcccgacacgaucgagacccucaugcugcuggcccucaucgccguccugaccgggggcgugacccuguucuuccucuccgggcggggccugggcaagaccagcaucgggcugcucugcgugauggccuccagcguccugcuguggauggccuccguggagccccacuggaucgcggccagcaucauccucgaguucuuccugauggugcugcucauccccgagccggaccgccagcggacgccccaggacaaccagcuggccuacgucgugaucggccuccucuucaucauccugaccguggccgccaacgagauggggcugcucgagaccaccaagaaggaccugggcaucgggcacgucgcgguggagaaccaccaccacgccacgaugcuggacguggaccuccaccccgccuccgccuggacccuguacgccgucgcgaccaccaucaucacgccgaugaugcgccacaccaucgagaacaccaccgccaacaucagccugacggccaucgccaaccaggccgcgauccucaugggccuggacaagggcuggcccaucuccaagauggacaucggggugccccugcucgcccugggcugcuacagccaggugaacccccugacccucaccgccgccguccugaugcugguggcgcacuacgccaucaucgggccgggccuccaggccaaggccacccgggaggcccagaagcgcacggcggccgggaucaugaagaaccccaccguggacggcaucgucgccaucgaccuggaccccgugguguacgacgccaaguucgagaagcagcugggccagaucaugcuccugauccugugcaccucccagauccuccugaugcgcaccacgugggcccugugcgagagcaucacccucgcgaccgggccccugaccacgcugugggagggcuccccggggaaguucuggaacaccaccaucgccgucagcauggccaacaucuuccggggcuccuaccucgccggcgccgggcuggcguucagccugaugaagucccucggcgggggccgccgggggaccggcgcccagggcgagacgcugggggagaaguggaagcgccagcugaaccagcucuccaagagcgaguucaacaucuacaagcgguccggcaucauggagguggaccgcagcgaggccaaggaggggcugaagcggggcgagaccacccgccacgccgugucccgggggaccgcgaagcugcgcugguucgucgagcggaaccuggugaagcccgagggcaaggugaucgaccucggcugcgggcgcggcggguggagcuacuacugcgccggccugaagaaggucacggaggugaagggguacaccaagggcggccccgggcacgaggagcccaucccgauggccaccuacggcuggaaccuggugaagcuccacuccgggaaggacgucuucuucacgccgcccgagaagugcgacacgcugcugugcgacaucggcgagagcucccccaacccgaccaucgaggaggggcggacccuccgcgugcugaagaugguggagcccuggcugcggggcaaccaguucugcaucaagauccucaaccccuacaugcccagcgucguggagacccuggagcagaugcagcgcaagcacggcgggaugcuggugcggaacccgcucucccgcaacagcacccacgagauguacugggucuccugcggcacggggaacaucgugagcgccgugaacaugaccucccggaugcugcugaaccgcuucaccauggcccaccgcaagcccaccuacgagcgggacgucgaccucggcgcgggcacgcgccacguggccguggagcccgaggucgccaaccuggacaucaucgggcagcggaucgagaacaucaagcacgagcacaagagcaccuggcacuacgacgaggacaaccccuacaagaccugggccuaccacggcuccuacgaggugaagccgagcggguccgccagcagcauggucaacggcguggugaagcugcucaccaagcccugggacgucauccccauggugacgcagaucgcgaugaccgacaccacccccuucgggcagcagcgcguguucaaggagaaggucgacacgcggaccccgaaggccaagcgcggcaccgcccagaucauggaggugaccgcccgguggcuguggggcuuccugucccgcaacaagaagccccggaucugcacgcgcgaggaguucacccggaaggugcgcagcaacgccgcgaucggggccgucuucguggacgagaaccaguggaacuccgccaaggaggccguggaggacgagcgguucugggaccucguccagaaggagcgcgagcugcacaagcagggcaagugcgcgaccugcguguacaacaugauggggaagcgggagaagaagcugggcgaguucgggaaggccaagggcagccgcgccaucugguacauguggcucggcgcccgguuccuggaguucgaggcccugggguucaugaacgaggaccacugguucucccgcgagaacagccucuccggcguggagggggagggccugcacaagcugggguacauccuccgggacaucagcaagauccccggcggcaacauguacgcggacgacaccgccgggugggacacgcgcaucaccgaggacgaccugcagaacgaggccaagaucaccgacaucauggagccggagcacgcccugcucgccaccuccaucuucaagcugacguaccagaacaaggucgugcgggugcagcgccccgcgaagaacggcaccgucauggacgugaucagccgccgggaccagcgcggguccggccaggugggcaccuacgggcugaacaccuucacgaacauggaggcccagcucauccggcagauggagagcgagggcaucuuccugcccuccgagcuggagacccccaaccucgccgagcgcguccuggacuggcuggagaaguacgggguggagcggcucaagcgcauggccaucagcggcgacgacugcguggucaagccgaucgacgaccgguucgccaccgcgcugaccgcccugaacgacauggggaaggugcgcaaggacaucccccagugggagcccuccaagggcuggaacgacuggcagcagguccccuucugcagccaccacuuccaccagcucaucaugaaggacggccgggagaucgucgugccgugccgcaaccaggacgagcugguggggcgggcccgcgucucccagggcgccggguggagccugcgggagacggccugccucggcaagagcuacgcgcagauguggcagcugauguacuuccaccgccgggaccugcgccucgccgccaacgccaucugcuccgcggugcccguggacuggguccccaccagccggaccaccugguccauccacgcccaccaccaguggaugacgaccgaggacaugcugagcguguggaaccgcguguggaucgaggagaaccccuggauggaggacaagacccacgucuccagcuggggcgacgugccguaccugggcaagcgggaggaccaguggugcggcucccucaucgggcugaccgcccgcgccaccugggccagcaacauccagguggcgaucaaccagguccgccggcugaucggcaacgagaacuaccucgacuacaugacguccaugaagcgcuucaagaacgagggggaccccgagggcgcccugugguga

SEQ ID NO: 8559 - RNA, 9879 nt, Artificial Sequence
  derived and/or modified CDS sequence (opt1) from DENV-1__FJ898393__SS-prME
agcgugaccaugcugcucaugcugaugcccaccgcccuggccuuccaccucaccacccgcggcggggagccccacaugaucgugaccaagcaggagcggggcaagagccugcuguucaagaccagcgcgggggugaacaugugcacccucaucgccauggaccugggcgagcugugcgaggacaccaugaccuacaagugcccccggaucaccgaggccgagcccgacgacguggacugcuggugcaacgccaccgacaccugggugaccuacgggaccugcagccagacgggcgagcaccggcgcgacaagcggagcguggcccucgcgccccacgugggccuggggcuggagacccgcaccgagaccuggauguccagcgagggcgccuggaagcagauccagcgggucgagacgugggcccuccgccaccccggguucaccgugaucgcccuguuccuggcgcacgccaucggcaccuccaucacccagaaggggaucaucuucauccuccugaugcuggugacgcccagcauggccaugcggugcgucggcaucggcucccgcgacuucguggaggggcucagcggcgccaccuggguggacgucgugcuggagcacggguccugcgugaccaccauggccaaggacaagcccacgcuggacaucgagcuccugaagaccgaggucaccaaccccgcggugcugcggaagcucugcaucgaggccaagaucagcaacaccacgaccgacucccgcugccccacccagggcgaggccacccugauggaggagcaggacgccaacuucgugugccggcgcacguucgucgaccggggcugggggaacggcugcgggcuguucggcaaggggagccucaucacgugcgccaaguucaagugcgugaccaagcuggagggcaagaucgugcaguacgagaaccugaaguacuccgucaucgugaccgugcacacgggcgaccagcaccaggucgggaacgagagcaccgagcacggcaccaccgcgaccaucacgccccaggcccccaccuccgagauccagcucaccgacuacggggcccugacccuggacugcagcccccgcacgggccucgacuucaacgagauggugcugcugaccaugaaggagaaguccuggcucguccacaagcagugguuccuggaccugccgcuccccuggaccagcggggccagcaccucccaggagacguggaaccggcaggaccugcuggugaccuucaagaccgcccacgcgaagaagcaggagguggucgugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgugaugugcaccggguccuucaagcucgagaaggaggucgcggagacgcagcacggcaccgugcuggugcagaucaaguacgagggcaccgacgcccccugcaagauccccuucagcacccaggacgagaagggggucacgcagaacggccggcugaucaccgccaacccgaucgugaccgacaaggagaagcccgugaacaucgaggccgagccgcccuucggggaguccuacaucgucaucggcgcgggcgagaaggcccugaagcucagcugguucaagaagggguccagcaucggcaagauguucgaggccaccgcccgcggggcccggcgcauggcgauccugggcgacacggccugggacuucggguccgugggcggcguguucaccagcgucgggaagcuggugcaccagaucuucggcaccgccuacgggguccuguucuccggcgucagcuggaccaugaagaucgggaucggcgugcugcugacguggcucggccugaacucccgcagcaccucccugagcaugaccugcaucgccguggggcucgucacccuguaccugggcgugauggugcaggccgacuccgggugcgucaucaacuggaagggccgggagcucaagugcgggagcggcaucuucgugacgaacgaggugcacaccuggaccgagcaguacaaguuccaggcggacagcccgaagcgccuguccgccgccaucggccgggccugggaggagggggucugcggcauccgcagcgccacccggcuggagaacaucauguggaagcagaucuccaacgagcucaaccacauccugcuggagaacgacaugaaguucaccgugguggucggggacguggugggcauccucgcgcaggggaagaagaugauccgcccccagcccauggagcacaaguacagcuggaaguccuggggcaaggccaagaucaucggcgccgacguccagaacacgaccuucaucaucgacgggcccaacaccccggagugccccgacgaccagcgggccuggaacaucugggagguggaggacuacggcuucgggaucuucaccacgaacaucuggcugaagcugcgcgacagcuacacccaggugugcgaccaccggcucauguccgcggccaucaaggacagcaaggccguccacgccgacaugggcuacuggaucgaguccgagaagaacgagaccuggaagcuggcccgcgcgagcuucaucgaggugaagaccugcaucuggcccaagucccacacgcuguggagcaacggcgugcucgaguccgagaugaucauccccaagaucuacgggggcccgaucagccagcacaacuaccggcccggguacuucacccagaccgccggccccuggcaccuggggaagcuggagcucgacuucgaccugugcgagggcaccacggucgugguggacgagcacugcggcaaccgcgggccgucccugcggaccaccaccgucacgggcaagaucauccacgaguggugcugccgcagcugcacccugccgccccuccgguucaagggggaggacggcugcugguacgggauggagauccgccccgugaaggagaaggaggagaaccuggugaaguccauggucagcgccggcagcggcgagguggacuccuucagccucgggcugcugugcaucuccaucaugaucgaggaggugaugcggagccgcuggucccggaagaugcucaugaccggcacccuggccgucuuccugcuccugaucauggggcagcugacguggaacgaccucauccgccugugcaucauggugggcgccaacgcgagcgaccgcauggggaugggcaccaccuaccuggcccucauggccaccuucaagaugcggccgauguucgccgugggccugcuguuccgccggcucacgucccgcgagguccugcugcucaccaucgggcugagccugguggccuccgucgagcuccccaacagccuggaggagcugggcgacgggcucgcgaugggcaucaugauccugaagcugcucaccgacuuccagucccaccagcugugggccacccugcucagccugacguucaucaagaccacccugucccuccacuacgccuggaagaccauggccauggugcugagcaucgcgucccuguucccccucugccugagcacgaccucccagaagaccaccuggcugcccgugcuccugggcagccuggggugcaagccgcucacgauguuccugaucaccgagaccaagaucuggggccggaaguccuggccccugaacgaggggaucauggccgucggcguggugagcauccuccugagcucccugcucaagaacgacgucccccuggccgggccccugaucgccggcggcaugcucaucgccugcuacgugaucagcggguccagcgcggaccugucccuggagaaggccgccgaggugagcugggaggaggaggccgagcacuccggcgccagccacaacauccucgucguggugcaggacgacgggaccaugaagaucaaggacgaggagcgcgacgacacccugacgauccugcucaaggcgacccugcuggccgucuccggcguguacccgcucagcauccccgccacccuguucgugugguacuucuggcagaagaagaagcagcgguccgggguccugugggacacccccagcccgcccgagguggagcgcgccgugcuggacgacggcaucuaccggaucaugcagcgcggccuccuggggcggucccaggucggcguggggguguuccaggagaacgucuuccacacgauguggcacgugacccgcggcgccgugcugauguaccaggggaagcggcucgagcccagcugggcguccgucaagaaggaccugaucagcuacggcggcggguggcgccugcagggcuccuggaacaccggggaggagguccaggugaucgccgucgagcccggcaagaaccccaagaacgugcagaccgcccccgggacguucaagacccccgagggcgaggugggcgccaucgcccucgacuucaagcccgggaccagcggcucccccaucgucaaccgggaggggaagaucgugggccuguacggcaacgggguggucaccacgagcggcaccuacgugagcgcgaucgcccaggccaaggccucccaggaggggccgcugcccgagaucgaggacgagguguuccgcaagcggaaccucaccaucauggaccugcaccccggcagcgggaagacccgccgguaccugccggcgaucguccgcgaggccaucaagcggaagcuccgcacgcugauccuggcccccacccgcgugguggccuccgagauggccgaggcgcucaagggcaugcccauccgguaccagaccaccgccgucaagagcgagcacacgggcaaggagaucguggaccugaugugccacgccaccuucaccaugcgccugcucucccccgugcgggucccgaacuacaacaugaucaucauggacgaggcccacuucaccgaccccagcuccaucgccgcgcgcggguacaucagcacgcgggugggcaugggggaggccgccgccaucuucaugaccgccacgccgcccggcuccguggaggcguucccgcagagcaacgccgucauccaggacgaggagcgcgacauccccgagcgguccuggaacagcggguacgaguggaucaccgacuuccccggcaagacggugugguucgugcccuccaucaagagcggcaacgacaucgccaacugccugcgcaagaacgggaagcgggucauccagcugucccgcaagaccuucgacaccgaguaccagaagaccaagaacaacgacugggacuacguggugacgaccgacaucagcgagaugggcgccaacuuccgggcggaccgcgucaucgacccgcggcgcugccucaagcccgugauccugaaggacgggcccgagcgggucauccuggccggccccaugccggugaccguggccuccgccgcccagcgccgggggcgcaucggccggaaccacaacaaggagggcgaccaguacaucuacauggggcagccccucaacaacgacgaggaccacgcgcacuggaccgaggccaagaugcugcuggacaacaucaacacgcccgagggcaucauccccgcccucuucgagccggagcgcgagaaguccgccgccaucgacggggaguaccgccugcggggcgaggcgcgcaagaccuucgucgagcugaugcggcgcggggaccuccccguguggcuguccuacaagguggccagcgagggcuuccaguacagcgaccggcgcuggugcuucgacggcgagcggaacaaccagguccuggaggagaacauggacguggagaucuggaccaaggagggggagcgcaagaagcuccggccccgcuggcuggacgcccggaccuacuccgacccccuggcccuccgcgaguucaaggaguucgccgcgggccggcgcagcguguccggggaccugauccuggagaucggcaagcucccgcagcaccugacgcagcgggcccagaacgcccuggacaaccucgucaugcugcacaacagcgagcagggcgggcgcgccuaccggcacgcgauggaggagcugcccgacaccaucgagacccucaugcugcuggcccucaucgccgugcugaccggcggggugacccuguucuuccucuccggccgcgggcugggcaagacgagcaucggccugcucugcgucauggccuccagcgugcugcuguggauggccuccguggagccccacuggaucgcggccagcaucauccucgaguucuuccugaugguccugcucauccccgagccggaccggcagcgcacgccccaggacaaccagcuggccuacguggugaucgggcuccucuucaugauccugaccgucgccgccaacgagaugggccugcucgagaccacgaagaaggaccuggggaucggccacguggcgguggagaaccaccaccacgccaccaugcuggacgucgaccuccaccccgccuccgccuggacccuguacgccguggcgaccacgaucaucaccccgaugaugcggcacaccaucgagaacaccacggccaacaucagccugaccgccaucgccaaccaggccgcgauccucauggggcuggacaagggcuggcccaucuccaagauggacaucggcgugccccugcucgcccuggggugcuacagccaggucaacccccugacccucaccgccgccgugcugaugcugguggcgcacuacgccaucaucggcccggggcuccaggccaaggccacgcgcgaggcccagaagcgcaccgcggccggcaucaugaagaaccccaccgucgacgggaucguggccaucgaccuggaccccguggucuacgacgccaaguucgagaagcagcugggccagaucaugcuccugauccugugcaccucccagauccuccugaugcggacgaccugggcccugugcgagagcaucacccucgcgaccggcccccugacgacccugugggagggguccccgggcaaguucuggaacaccaccaucgccgugagcauggccaacaucuuccgcggguccuaccucgccggcgccggccuggcguucagccugaugaagucccucgggggcgggcggcgcggcacgggggcccagggcgagacccugggcgagaaguggaagcggcagcugaaccagcucuccaagagcgaguucaacaucuacaagcgcuccgggaucauggagguggaccggagcgaggccaaggagggccugaagcgcggggagaccacccggcacgccgucucccgcggcacggcgaagcugcggugguucguggagcgcaaccuggugaagcccgaggggaaggucaucgaccucggcugcggccgcggcggguggagcuacuacugcgccgggcugaagaaggugaccgaggugaagggguacaccaagggcgggcccggccacgaggagcccaucccgauggccaccuacggguggaaccuggucaagcuccacuccggcaaggacguguucuucacgccgcccgagaagugcgacacccugcugugcgacaucggggagagcucccccaacccgaccaucgaggagggccgcacccuccgggugcugaagauggucgagcccuggcugcgcgggaaccaguucugcaucaagauccucaaccccuacaugcccagcgugguggagacccuggagcagaugcagcggaagcacggcggcaugcugguccgcaacccgcucucccggaacagcacgcacgagauguacuggguguccugcgggaccggcaacaucgugagcgccgucaacaugaccucccgcaugcugcugaaccgcuucaccauggcccaccggaagcccacguacgagcgcgacguggaccucggggcgggcacccggcacguggccgucgagcccgagguggccaaccuggacaucaucggccagcgcaucgagaacaucaagcacgagcacaagagcaccuggcacuacgacgaggacaaccccuacaagaccugggccuaccacggguccuacgaggucaagccgagcggcuccgccagcagcauggugaacgggguggucaagcugcucacgaagcccugggacgugauccccauggugacccagaucgcgaugaccgacaccacgcccuucggccagcagcgggucuucaaggagaagguggacacccgcaccccgaaggccaagcgggggaccgcccagaucauggaggugacggcccgcuggcuguggggcuuccugucccggaacaagaagccccgcaucugcacccgggaggaguucacccgcaagguccggagcaacgccgcgaucggcgccguguucguggacgagaaccaguggaacuccgccaaggaggccgucgaggacgagcgcuucugggaccucgugcagaaggagcgggagcugcacaagcaggggaagugcgcgaccugcguguacaacaugaugggcaagcgcgagaagaagcugggggaguucggcaaggccaaggggagccgggccaucugguacauguggcucggcgcccgcuuccuggaguucgaggcccugggcuucaugaacgaggaccacugguucucccgggagaacagccucuccggggucgagggcgaggggcugcacaagcugggcuacauccuccgcgacaucagcaagauccccgggggcaacauguacgcggacgacacggccggcugggacacccggaucaccgaggacgaccugcagaacgaggccaagaucaccgacaucauggagccggagcacgcccugcucgccacguccaucuucaagcugaccuaccagaacaagguggugcgcguccagcgccccgcgaagaacgggaccgugauggacgugaucagccggcgcgaccagcggggcuccgggcaggucggcaccuacggccugaacacguucaccaacauggaggcccagcucauccgccagauggagagcgaggggaucuuccugcccuccgagcuggagacccccaaccucgccgagcgggugcuggacuggcuggagaaguacggcguggagcgccucaagcggauggccaucagcggggacgacugcgucgugaagccgaucgacgaccgcuucgccaccgcgcugacggcccugaacgacaugggcaaggugcggaaggacaucccccagugggagcccuccaagggguggaacgacuggcagcagguccccuucugcagccaccacuuccaccagcucaucaugaaggacggccgcgagaucguggugccgugccggaaccaggacgagcuggucggccgcgcccgggugucccagggggccggcuggagccugcgcgagaccgccugccucggcaagagcuacgcgcagauguggcagcugauguacuuccaccggcgcgaccugcggcucgccgccaacgccaucugcuccgcggugcccgucgacugggugcccaccagccgcaccacgugguccauccacgcccaccaccaguggaugaccaccgaggacaugcugagcguguggaaccgggucuggaucgaggagaaccccuggauggaggacaagacccacguguccagcuggggcgacgugccguaccuggggaagcgcgaggaccaguggugcggcucccucaucggccugaccgcccgcgccacgugggccagcaacauccaggucgcgaucaaccaggugcggcgccugaucgggaacgagaacuaccucgacuacaugaccuccaugaagcgguucaagaacgagggcgaccccgagggggcccugugguga

SEQ ID NO: 8560 - RNA, 9879 nt, Artificial Sequence
  derived and/or modified CDS sequence (opt1) from DENV-1__FJ898394__SS-prME
agcgugaccaugcugcucaugcugaugcccaccgcccuggccuuccaccucaccacccggggcggggagccccacaugaucgugaccaagcaggagcggggcaagagccugcuguucaagaccagcgccggggugaacaugugcacccucaucgccauggaccugggcgagcugugcgaggacaccaugaccuacaagugcccccggaucaccgaggccgagcccgacgacguggacugcuggugcaacgccaccgacaccugggugaccuacgggaccugcagccagaccggcgagcaccggcgcgacaagcggagcguggcccucgcgccccacgugggccuggggcuggagacccgcaccgagaccuggauguccagcgagggcgccuggaagcagauccagcggguggagacgugggcccuccgccacccgggguucaccgugaucgcccuguuccuggcgcacgccaucggcaccuccaucacccagaaggggaucaucuucauccuccugaugcuggugacgcccagcauggccaugcggugcgucggcaucggcucccgcgacuucguggaggggcucagcggcgccaccuggguggacgucgugcuggagcacggguccugcgugaccaccauggccaaggacaagcccacgcuggacaucgagcuccugaagaccgaggucaccaaccccgcggugcugcggaagcucugcaucgaggccaagaucagcaacaccacgaccgacucccgcugcccgacccagggcgaggccacccugauggaggagcaggacgccaacuucgugugccggcgcacguucgucgaccggggcugggggaacggcugcgggcuguucggcaaggggagccucaucacgugcgccaaguucaagugcgugaccaagcuggagggcaagaucgugcaguacgagaaccugaaguacuccgucaucgugaccgugcacacgggcgaccagcaccaggucgggaacgagagcaccgagcacggcaccaccgcgaccaucacgccccaggcccccaccuccgagauccagcucaccgacuacggggcccugacccuggacugcagcccccgcacgggccucgacuucaacgagauggugcugcugaccaugaaggagaaguccuggcucguccacaagcagugguuccuggaccugccgcuccccuggaccagcggggccagcacgccccaggagacguggaaccggcaggaccugcuggugaccuucaagaccgcccacgcgaagaagcaggagguggucgugcucggcucccaggagggcgccaugcacaccgcccugacgggggccaccgagauccagaccagcggcaccacgaccaucuucgccgggcaccugaagugccgccucaagauggacaagcugacccugaagggcauguccuacgugaugugcaccgggagcuucaagcucgagaaggaggucgcggagacgcagcacggcaccgugcuggugcagaucaaguacgagggcaccgacgcccccugcaagaucccguucuccacccaggacgagaagggggucacgcagaacggccggcugaucaccgccaaccccaucgugaccgacaaggagaagcccgugaacaucgaggccgagcccccguucggggagagcuacaucgucaucggcgcgggcgagaaggcccugaagcucuccugguucaagaaggggagcuccaucggcaagauguucgaggccaccgcccgcggggcccggcgcauggcgauccugggcgacacggccugggacuucgggagcaucggcggcguguucaccuccguggggaagcugguccaccagaucuucggcaccgccuacgggguccuguucagcggcguguccuggaccaugaagaucgggaucggcguccugcugacguggcucggccugaacagccgcuccaccagccuguccaugaccugcaucgccguggggcucgugacccuguaccugggcgucauggugcaggccgacagcgggugcgugaucaacuggaagggccgggagcucaagugcggguccggcaucuucgucacgaacgaggugcacaccuggaccgagcaguacaaguuccaggcggacagccccaagcgccugagcgccgccaucggcaaggccugggaggagggggugugcggcauccgguccgccacccgccuggagaacaucauguggaagcagaucagcaacgagcucaaccacauccugcuggagaacgacaugaaguucaccgucguggugggggacgucgugggcauccucgcgcaggggaagaagaugauccggccccagcccauggagcacaaguacuccuggaaguccuggggcaaggccaagaucaucggcgccgacgugcagaacacgaccuucaucaucgacgggccgaacacccccgagugccccgacgaccagcgcgccuggaacaucugggaggucgaggacuacggcuucgggaucuucaccacgaacaucuggcugaagcugcgggacuccuacacccaggugugcgaccaccgccucaugagcgcggccaucaaggacuccaaggccgugcacgccgacaugggcuacuggaucgagagcgagaagaacgagaccuggaagcuggcccgggcguccuucaucgaggucaagaccugcaucuggcccaagagccacacgcugugguccaacggcgugcucgagagcgagaugaucaucccgaagaucuacgggggccccaucucccagcacaacuaccgccccggguacuucacccagaccgccggcccguggcaccuggggaagcuggagcucgacuucgaccugugcgagggcaccacgguggucguggacgagcacugcggcaaccgggggcccagccugcgcaccaccaccgugacgggcaagaucauccacgaguggugcugccgguccugcacccugccgccccuccgcuucaagggggaggacggcugcugguacgggauggagauccggccggucaaggagaaggaggagaaccuggucaagagcaugguguccgccggcagcggcgaggucgacagcuucucccucgggcugcugugcaucagcaucaugaucgaggaggugaugcgcucccgguggagccgcaagaugcucaugaccggcacccuggccguguuccugcuccugaucauggggcagcugacguggaacgaccucauccggcugugcaucauggucggcgccaacguguccgaccgcauggggaugggcaccaccuaccuggcgcucauggccaccuucaagaugcgccccauguucgccgugggccugcuguuccggcgccucacgagccgggagguccugcugcucaccaucgggcugucccugguggccagcgucgagcuccccaacucccuggaggagcugggcgacgggcucgccaugggcaucaugauccugaagcugcucaccgacuuccagagccaccagcugugggcgacccugcucucccugacguucaucaagaccacccugagccuccacuacgccuggaagaccauggccauggugcuguccaucgugagccuguucccccucugccuguccacgaccagccagaagaccaccuggcugccgguccuccugggcucccuggggugcaagccccucacgauguuccugaucgccgagaacaagaucuggggccgcaagagcuggccccugaacgaggggaucauggcggugggcguggucuccauccuccugagcagccugcucaagaacgacgugccccuggccgggccgcugaucgccggcggcaugcucaucgccugcuacgugaucuccgggagcuccgccgaccugagccuggagaaggcggccgaggucuccugggaggaggaggccgagcacagcggcgccucccacaacauccucguggaggugcaggacgacgggaccaugaagaucaaggacgaggagcgggacgacacccugaccauccugcucaaggccacccugcuggcggucagcggcguguacccccucuccauccccgccacgcuguucgugugguacuucuggcagaagaagaagcagcgcagcgggguccugugggacacccccuccccgcccgagguggagcgggccgugcuggacgacggcaucuaccgcaucaugcagcggggccuccuggggcgcagccaggucggcguggggguguuccaggagaacgucuuccacaccauguggcacgugacccggggcgccgugcugauguaccaggggaagcgccucgagcccuccugggccagcgucaagaaggaccugaucuccuacggcggcggguggcggcugcagggcagcuggaacacgggggaggagguccaggugaucgcggucgagcccggcaagaacccgaagaacgugcagaccgcccccgggaccuucaagacccccgagggcgaggugggcgccaucgcccucgacuucaagcccgggacguccggcagcccgaucgucaaccgcgaggggaagaucgugggccuguacggcaacgggguggucaccaccuccggcaccuacgugagcgccaucgcgcaggccaaggccagccaggaggggccccugcccgagaucgaggacgagguguuccggaagcgcaaccucacgaucauggaccugcacccgggcuccgggaagacccggcgcuaccugcccgccaucguccgggaggcgaucaagcgcaagcuccggacccugauccuggcccccacccgcgugguggccagcgagauggccgaggcccucaagggcaugcccauccgcuaccagacgaccgcggucaaguccgagcacaccggcaaggagaucguggaccugaugugccacgccaccuucacgaugcggcugcucagcccggugcgcguccccaacuacaacaugaucaucauggacgaggcccacuucaccgaccccuccagcaucgccgcccggggguacaucuccacccgcgugggcaugggggaggcggccgccaucuucaugaccgccacgcccccgggcagcguggaggccuucccccaguccaacgcggucauccaggacgaggagcgggacauccccgagcgcagcuggaacuccggguacgaguggaucaccgacuuccccggcaagaccgugugguucgugccgagcaucaaguccggcaacgacaucgccaacugccugcggaagaacgggaagcgcgucauccagcugagccggaagaccuucgacacggaguaccagaagaccaagaacaacgacugggacuacguggugaccaccgacaucuccgagaugggcgccaacuuccgcgccgaccgggucaucgacccccgccggugccucaagcccgugauccugaaggacgggcccgagcgcgucauccuggcgggcccgaugcccgugacgguggccagcgccgcccagcggcgcgggcggaucggccgcaaccacaacaaggagggcgaccaguacaucuacauggggcagccccucaacaacgacgaggaccacgcccacuggaccgaggcgaagaugcugcuggacaacaucaacacccccgagggcaucaucccggcccucuucgagcccgagcgggagaaguccgccgccaucgacggggaguaccgccugcgcggcgaggcccggaagaccuucgucgagcugaugcgccgcggggaccuccccguguggcugagcuacaagguggcguccgagggcuuccaguacagcgaccgccgguggugcuucgacggcgagcgcaacaaccagguccuggaggagaacauggacguggagaucuggacgaaggagggggagcggaagaagcuccgcccccgguggcuggacgcccgcaccuacagcgacccgcuggcccuccgggaguucaaggaguucgccgccggccgccgguccgugagcggggaccugauccuggagaucggcaagcucccccagcaccugacccagcgcgcgcagaacgcccuggacaaccucgucaugcugcacaacuccgagcagggcgggcgggccuaccgccacgccauggaggagcugcccgacaccaucgagacgcucaugcugcuggcgcucaucgccgugcugaccggcggggugacccuguucuuccucagcggccgggggcugggcaagaccuccaucggccugcucugcgucauggccagcuccgugcugcuguggauggccagcguggagccccacuggaucgccgcguccaucauccucgaguucuuccugaugguccugcucaucccggagcccgaccgccagcggacgccccaggacaaccagcuggccuacguggugaucgggcuccucuucaugauccugacggucgccgccaacgagaugggccugcucgagaccaccaagaaggaccuggggaucggccacguggccguggagaaccaccaccacgcgaccaugcuggacgucgaccuccacccggccagcgccuggacgcuguacgccguggccaccaccaucaucacccccaugaugcgccacacgaucgagaacaccaccgcgaacaucucccugaccgccaucgccaaccaggccgccauccucauggggcuggacaagggcuggcccaucagcaagauggacaucggcgugccccugcucgcgcuggggugcuacucccaggucaacccgcugacgcucaccgccgccgugcugaugcugguggcccacuacgcgaucaucggccccgggcuccaggccaaggccacccgggaggcccagaagcgcaccgccgcgggcaucaugaagaaccccacggucgacgggaucguggccaucgaccuggaccccguggucuacgacgccaaguucgagaagcagcugggccagaucaugcuccugauccugugcaccagccagauccuccugaugcgcaccaccugggcccugugcgaguccaucacgcucgccaccggcccgcugaccacccugugggaggggagccccggcaaguucuggaacacgaccaucgcgguguccauggccaacaucuuccgggggagcuaccucgccggcgccggccuggccuucucccugaugaagucccucgggggcgggcgccggggcaccggggcgcagggcgagacccugggcgagaaguggaagcgccagcugaaccagcucagcaaguccgaguucaacaucuacaagcggagcgggaucauggagguggaccgcuccgaggccaaggagggccugaagcgcggggagacgacccgccacgccgucagccggggcaccgccaagcugcgcugguucguggagcggaaccuggugaagcccgaggggaaggucaucgaccucggcugcggccgcgggggcugguccuacuacugcgcggggcugaagaaggugaccgaggugaagggcuacacgaagggcgggcccggccacgaggagccgauccccauggccaccuacggguggaaccuggucaagcuccacagcggcaaggacguguucuucacgccgcccgagaagugcgacacccugcugugcgacaucggggaguccagcccgaaccccacgaucgaggagggccggacccuccgcgugcugaagauggucgagcccuggcugcgggggaaccaguucugcaucaagauccucaaccccuacaugccguccgugguggagacccuggagcagaugcagcgcaagcacggcggcaugcugguccggaacccccucagccgcaacuccacccacgagauguacugggugagcugcgggaccggcaacaucguguccgccgucaacaugacgagccggaugcugcugaaccgcuucaccaugacccaccgcaagcccaccuacgagcgggacguggaccucggggccggcacgcgccacguggccgucgagcccgagguggcgaaccuggacaucaucggccagcggaucgagaacaucaagcacgagcacaaguccaccuggcacuacgacgaggacaacccguacaagaccugggccuaccacgggagcuacgaggucaagcccuccggcagcgccuccagcauggugaacgggguggucaagcugcucaccaagcccugggacgugauccccauggugacgcagaucgccaugaccgacaccaccccguucggccagcagcgcgucuucaaggagaagguggacacgcggacccccaaggccaagcgcgggaccgcgcagaucauggaggugaccgcccgguggcuguggggcuuccugagccgcaacaagaagccccggaucugcacgcgcgaggaguucacccggaagguccgcuccaacgccgccaucggcgccguguucguggacgagaaccaguggaacagcgcgaaggaggccgucgaggacgagcgguucugggaccucgugcagaaggagcgcgagcugcacaagcaggggaagugcgcgaccugcguguacaacaugaugggcaagcgggagaagaagcugggggaguucggcaaggccaaggggucccgcgcgaucugguacauguggcucggcgcccgguuccuggaguucgaggcccugggcuucaugaacgaggaccacugguucagccgcgagaacucccucagcggggucgagggcgaggggcugcacaagcugggcuacauccuccgggacaucuccaagauccccggcgggaacauguacgccgacgacaccgccgggugggacacgcgcaucaccgaggacgaccugcagaacgaggcgaagaucaccgacaucauggagcccgagcacgcccugcucgccaccagcaucuucaagcugacguaccagaacaagguggugcggguccagcgccccgccaagaacgggaccgugauggacgugaucucccgccgggaccagcgcggcagcgggcaggucggcaccuacggccugaacaccuucacgaacauggaggcccagcucauccggcagauggaguccgaggggaucuuccugcccagcgagcuggagaccccgaaccucgcggagcgcgugcuggacuggcuggagaagcacggcguggagcggcucaagcgcauggccaucuccggggacgacugcgucgugaagcccaucgacgaccgguucgccaccgcccugaccgcccugaacgacaugggcaaggugcgcaaggacaucccccagugggagcccagcaagggguggaacgacuggcagcaggucccguucugcucccaccacuuccaccagcucaucaugaaggacggccgggagaucguggugcccugccgcaaccaggacgagcuggucggccgggcgcgcgugagccagggggccggcuggucccugcgggagacggccugccucggcaagagcuacgcccagauguggcagcugauguacuuccaccgccgggaccugcgccucgccgcgaacgccaucugcagcgccgugcccgucgacugggugcccaccucccggaccaccuggagcauccacgcccaccaccaguggaugacgaccgaggacaugcuguccguguggaaccgcgucuggaucgaggagaacccguggauggaggacaagacccacgugagcuccuggggcgacgugcccuaccuggggaagcgggaggaccaguggugcggcagccucaucggccugaccgcgcgcgccaccugggccuccaacauccaggucgccaucaaccaggugcgccggcugaucgggaacgagaacuaccucgacuacaugacgagcaugaagcgcuucaagaacgagggcgaccccgagggggcccugugguga

SEQ ID NO: 8561 - RNA, 9879 nt, Artificial Sequence
  derived and/or modified CDS sequence (opt1) from DENV-1__GQ199838__SS-prME
agcgugaccaugcugcucaugcugaugcccaccgcccuggccuuccaccucaccacccggggcggggagccccacaugaucgugaccaagcaggagcggggcaagagccugcuguucaagaccagcgcgggggugaacaugugcacccucaucgccauggaccugggggagcugugcgaggacaccaugaccuacaagugcccccgcaucaccgaggccgagcccgacgacguggacugcuggugcaacgccaccgacaccugggugaccuacgggaccugcagccagacgggggagcaccggcgcgacaagcggagcguggcccucgcgccccacgugggccuggggcuggagacccgcaccgagaccuggauguccagcgagggcgccuggaagcagauccagcgggucgagacgugggcccuccgccaccccggguucaccgugaucgcccuguuccuggcgcacgccaucggcaccuccaucacccagaaggggaucaucuucauccuccugaugcuggugacgcccagcauggccaugcggugcgucggcaucggcucccgcgacuucguggaggggcucagcggcgccaccuggguggacgucgugcuggagcacggguccugcgugaccaccauggccaaggacaagcccacgcuggacaucgagcuccugaagaccgaggucaccaaccccgcggugcugcggaagcucugcaucgaggccaagaucagcaacaccacgaccgacucccgcugccccacccagggcgaggccacccugauggaggagcaggacgccaacuucgugugccggcgcacgcuggucgaccggggcugggggaacggcugcggccuguucggcaaggggagccugaucacgugcgccaaguucaagugcgugaccaagcuggagggcaagaucgugcaguacgagaaccucaaguacuccgucaucgugaccgugcacacgggcgaccagcaccaggucgggaacgagagcaccgagcacggcaccaccgcgaccaucacgccccaggcccccaccuccgagauccagcugaccgacuacggggcccugacccucgacugcagcccccgcacgggccuggacuucaacgagauggugcugcucaccaugaaggagaaguccuggcugguccacaagcagugguuccuggaccucccgcugcccuggaccagcggggccagcaccucccaggagacguggaaccggcaggaccugcucgugaccuucaagaccgcccacgcgaagaagcaggagguggucgugcugggcagccaggagggcgccaugcacaccgcccugacgggggccaccgagauccagaccuccggcaccacgaccaucuucgccgggcaccucaagugccgccugaagauggacaagcugacccucaagggcaugagcuacgugaugugcaccggguccuucaagcuggagaaggaggucgcggagacgcagcacggcaccgugcuggugcagaucaaguacgagggcaccgacgcccccugcaagauccccuucagcacccaggacgagaagggggucacgcagaacggccggcugaucaccgccaacccgaucgugaccgacaaggagaagcccgugaacaucgaggccgagccgcccuucggggaguccuacaucgucaucggcgcgggcgagaaggcccucaagcugagcugguucaagaagggguccagcaucggcaagauguucgaggccaccgcccgcggggcccggcgcauggcgauccugggcgacacggccugggacuucggguccaucggcggcguguucaccagcguggggaagcucguccaccagaucuucggcaccgccuacggggugcuguucuccggcgugagcuggaccaugaagaucgggaucggcguccugcucacguggcugggccugaacucccgcagcaccucccucagcaugaccugcaucgccguggggcuggugacccuguaccucggcgucauggugcaggccgacuccgggugcgugaucaacuggaagggccgggagcugaagugcgggagcggcaucuucgucacgaacgaggugcacaccuggaccgagcaguacaaguuccaggcggacagcccgaagcgccuguccgccgccaucggcaaggccugggaggagggggugugcggcauccggagcgccacccgccucgagaacaucauguggaagcagaucuccaacgagcugaaccacauccugcucgagaacgggaugaaguucaccgucguggugggcgacgucguggggauccuggcgcagggcaagaagaugauccggccccagcccauggagcacaaguacagcuggaaguccuggggcaaggccaagaucaucggggccgacgugcagaacacgaccuucaucaucgacggccccaacaccccggagugccccgacgaccagcgcgccuggaacaucugggaggucgaggacuacggguucggcaucuucaccacgaacaucuggcugaagcuccgggacagcuacacccaggugugcgaccaccgccugauguccgcggccaucaaggacagcaaggccgugcacgccgacaugggcuacuggaucgaguccgagaagaacgagaccuggaagcuggcccgggcgagcuucaucgaggucaagaccugcaucuggcccaagucccacacgcucuggagcaacggggugcuggaguccgagaugaucauccccaagaucuacggcgggccgaucagccagcacaacuaccgccccggcuacuucacccagaccgccgggcccuggcaccugggcaagcucgagcuggacuucgaccugugcgagggcaccacgguggucguggacgagcacugcgggaaccggggcccgucccuccgcaccaccaccgugacggggaagaucauccacgaguggugcugccggagcugcacccugccgccccugcgcuucaagggcgaggacgggugcugguacggcauggagauccggcccgucaaggagaaggaggagaaccucgugaaguccauggugagcgccggcagcggggaggucgacuccuucagccugggccugcucugcaccuccaucaugaucgaggaggugaugcgcagccgguggucccgcaagaugcugaugaccgggacgcuggccguguuccuccugcugaucaugggccagcucaccuggaacgaccugauccggcugugcaucauggucggggccaacgcgagcgaccgcaugggcaugggcaccaccuaccucgcccugauggccacguucaagaugcgcccgauguucgccguggggcuccucuuccggcgccugaccucccgggaggugcugcuccugaccaucggccugagccucgucgccuccguggagcugcccaacagccuggaggagcucggggacggccuggcgaugggcaucaugauccugaagcuccugaccgacuuccagucccaccagcugugggccacgcuccugagccugaccuucaucaagaccacccucucccugcacuacgccuggaagacgauggccaugguccugagcaucgugucccucuucccccugugccugagcaccaccucccagaagaccacguggcuccccgugcugcuggggagccucggcugcaagccgcugaccauguuccugaucgcggagaacaagaucugggggcgcaaguccuggccccucaacgagggcaucauggccgucgggguggugagcauccugcugagcucccuccugaagaacgacgucccccuggccggcccccucaucgccggcgggaugcugaucgccugcuacgugaucagcggcuccagcgcggaccugucccucgagaaggccgccgaggugagcugggaggaggaggccgagcacuccggggccagccacaacauccuggucgaggugcaggacgacggcaccaugaagaucaaggacgaggagcgggacgacacccugaccauccuccugaaggcgacgcugcucgccguguccggggucuacccgcugagcauccccgccacccuguucgugugguacuucuggcagaagaagaagcagcgcuccggcgugcugugggacacccccagcccgcccgaggucgagcgggccgugcucgacgacggcaucuaccgcaucaugcagcgggggcugcugggccgcucccaggugggggucggcguguuccaggagaacguguuccacaccauguggcacgucacgcgcggggccgugcucauguaccagggcaagcgccuggagcccagcugggcguccgugaagaaggaccugaucagcuacggcgggggcuggcggcuccagggguccuggaacaccggcgaggagguccaggugaucgccguggagcccgggaagaaccccaagaacguccagaccgcccccggcaccuucaagacgcccgagggcgaggugggggccaucgcccuggacuucaagcccggcaccagcgggucccccaucgugaaccgcgagggcaagaucgucggccuguacgggaacggcguggugaccaccagcgggacguacgucagcgcgaucgcccaggccaaggccucccaggagggcccgcuccccgagaucgaggacgagguguuccggaagcgcaaccugaccaucauggaccugcaccccgggagcggcaagacccggcgcuaccucccggcgaucgugcgggaggccaucaagcgcaagcugcggacccugauccucgcccccacgcgcgucguggccuccgagauggccgaggcgcugaagggcaugcccauccgcuaccagaccaccgccgucaagagcgagcacaccgggaaggagaucgucgaccugaugugccacgccacguucaccaugcggcuccugucccccgugcgcgugccgaacuacaacaugaucaucauggacgaggcccacuucaccgaccccagcuccaucgccgcgcggggcuacaucagcacccgcgucgggaugggcgaggccgccgccaucuucaugacggccacgccgcccggguccguggaggcguucccgcagagcaacgccgugauccaggacgaggagcgggacauccccgagcgcuccuggaacagcggcuacgaguggaucaccgacuuccccggcaagaccgucugguucgugcccuccaucaagagcgggaacgacaucgccaacugccugcggaagaacggcaagcgcgugauccagcucucccggaagacguucgacaccgaguaccagaagaccaagaacaacgacugggacuacgucgugaccacggacaucagcgagaugggggccaacuuccgcgcggaccgggugaucgacccgcgccggugccugaagcccgucauccugaaggacggccccgagcgcgugauccucgccgggcccaugccggucaccguggccuccgccgcccagcggcgcggccggaucggccgcaaccacaacaaggagggggaccaguacaucuacaugggccagccccugaacaacgacgaggaccacgcgcacuggaccgaggccaagaugcugcucgacaacaucaacacccccgaggggaucauccccgcccuguucgagccggagcgggagaaguccgccgccaucgacggcgaguaccgccugcgcggggaggcgcggaagacguucguggagcucaugcgccggggcgaccugcccgucuggcuguccuacaagguggccagcgagggcuuccaguacagcgaccgccgguggugcuucgacggggagcgcaacaaccaggugcucgaggagaacauggacgucgagaucuggaccaaggagggcgagcggaagaagcugcgcccccgguggcuggacgcccgcaccuacuccgacccccucgcccugcgggaguucaaggaguucgccgcggggcgccggagcguguccggcgaccugauccucgagaucggcaagcugccgcagcaccugacccagcgcgcccagaacgcccucgacaaccuggugaugcugcacaacagcgagcagggcgggcgggccuaccgccacgcgauggaggagcuccccgacacgaucgagacccugaugcugcucgcccugaucgccguccugaccgggggcgugacccucuucuuccuguccgggcggggccugggcaagaccagcaucgggcuccugugcgugauggccuccagcguccugcucuggauggccuccguggagccccacuggaucgcggccagcaucauccuggaguucuuccugauggugcuccugauccccgagccggaccgccagcggacgccccaggacaaccagcuggccuacgucgugaucggccuccuguucaucauccugaccguggccgccaacgagauggggcuccuggagaccaccaagaaggaccugggcaucgggcacgucgcgguggagaaccaccaccacgccacgaugcucgacguggaccugcaccccgccuccgccuggacccuguacgccgucgcgaccaccaucaucacgccgaugaugcgccacaccaucgagaacaccaccgccaacaucagccucacggccaucgccaaccaggccgcgauccugaugggccuggacaagggcuggcccaucuccaagauggacaucggggugccccuccuggcccugggcugcuacagccaggugaacccccucacccugaccgccgccguccugaugcucguggcgcacuacgccaucaucgggccgggccugcaggccaaggccacccgggaggcccagaagcgcacggcggccgggaucaugaagaaccccaccguggacggcaucgucgccaucgaccuggaccccgugguguacgacgccaaguucgagaagcagcucggccagaucaugcugcugauccucugcaccucccagauccugcugaugcgcaccacgugggcccucugcgagagcaucacccuggcgaccgggccccugaccacgcucugggagggcuccccggggaaguucuggaacaccaccaucgccgucagcauggccaacaucuuccggggcuccuaccuggccggcgccgggcuggcguucagccucaugaagucccugggcgggggccgccgggggaccggcgcccagggcgagacgcugggggagaaguggaagcgccagcucaaccagcuguccaagagcgaguucaacaucuacaagcgguccggcaucauggagguggaccgcagcgaggccaaggaggggcugaagcggggcgagaccacccgccacgccgugucccgggggaccgcgaagcugcgcugguucgucgagcggaaccucgugaagcccgagggcaaggugaucgaccugggcugcgggcgcggcggguggagcuacuacugcgccggccugaagaaggucacggaggugaagggguacaccaagggcggccccgggcacgaggagcccaucccgauggccaccuacggcuggaaccucgugaagcugcacuccgggaaggacgucuucuucacgccgcccgagaagugcgacacgcugcucugcgacaucggcgagagcucccccaacccgaccaucgaggaggggcggacccugcgcgugcugaagaugguggagcccuggcuccggggcaaccaguucugcaucaagauccugaaccccuacaugcccagcgucguggagacccuggagcagaugcagcgcaagcacggcgggaugcucgugcggaacccgcugucccgcaacagcacccacgagauguacugggucuccugcggcacggggaacaucgugagcgccgugaacaugaccucccggaugcugcucaaccgcuucaccauggcccaccgcaagcccaccuacgagcgggacgucgaccugggcgcgggcacgcgccacguggccguggagcccgaggucgccaaccuggacaucaucgggcagcggaucgagaacaucaagcacgagcacaagagcaccuggcacuacgacgaggacaaccccuacaagaccugggccuaccacggcuccuacgaggugaagccgagcggguccgccagcagcauggucaacggcguggugaagcuccugaccaagcccugggacgucauccccauggugacgcagaucgcgaugaccgacaccacccccuucgggcagcagcgcguguucaaggagaaggucgacacgcggaccccgaaggccaagcgcggcaccgcccagaucauggaggugaccgcccgguggcuguggggcuuccucucccgcaacaagaagccccggaucugcacgcgcgaggaguucacccggaaggugcgcagcaacgccgcgaucggggccgucuucguggacgagaaccaguggaacuccgccaaggaggccguggaggacgagcgguucugggaccugguccagaaggagcgcgagcugcacaagcagggcaagugcgcgaccugcguguacaacaugauggggaagcgggagaagaagcucggcgaguucgggaaggccaagggcagccgcgccaucugguacauguggcugggcgcccgguuccuggaguucgaggcccucggguucaugaacgaggaccacugguucucccgcgagaacagccuguccggcguggagggggagggccugcacaagcucggguacauccugcgggacaucagcaagauccccggcggcaacauguacgcggacgacaccgccgggugggacacgcgcaucaccgaggacgaccugcagaacgaggccaagaucaccgacaucauggagccggagcacgcccuccuggccaccuccaucuucaagcugacguaccagaacaaggucgugcgggugcagcgccccgcgaagaacggcaccgucauggacgugaucagccgccgggaccagcgcggguccggccaggugggcaccuacgggcucaacaccuucacgaacauggaggcccagcugauccggcagauggagagcgagggcaucuuccugcccuccgagcucgagacccccaaccuggccgagcgcguccuggacuggcucgagaaguacgggguggagcggcugaagcgcauggccaucagcggcgacgacugcguggucaagccgaucgacgaccgguucgccaccgcgcugaccgcccucaacgacauggggaaggugcgcaaggacaucccccagugggagcccuccaagggcuggaacgacuggcagcagguccccuucugcagccaccacuuccaccagcugaucaugaaggacggccgggagaucgucgugccgugccgcaaccaggacgagcugguggggcgggcccgcgucucccagggcgccggguggagccuccgggagacggccugccugggcaagagcuacgcgcagauguggcagcugauguacuuccaccgccgggaccuccgccuggccgccaacgccaucugcuccgcggugcccguggacuggguccccaccagccggaccaccugguccauccacgcccaccaccaguggaugacgaccgaggacaugcugagcguguggaaccgcguguggaucgaggagaaccccuggauggaggacaagacccacgucuccagcuggggcgacgugccguaccucggcaagcgggaggaccaguggugcggcucccugaucgggcugaccgcccgcgccaccugggccagcaacauccagguggcgaucaaccagguccgccggcucaucggcaacgagaacuaccuggacuacaugacguccaugaagcgcuucaagaacgagggggaccccgagggcgcccugugguga

SEQ ID NO: 8562 - RNA, 9879 nt, Artificial Sequence
  derived and/or modified CDS sequence (opt1) from DENV-1__FJ898396__SS-prME
agcgugaccaugcugcucaugcugaugcccaccgcccuggccuuccaccucaccacccggggcggggagccccacaugaucgugaccaagcaggagcggggcaagagccugcuguucaagaccagcgcgggggugaacaugugcacccucaucgccauggaccugggcgagcugugcgaggacaccaugaccuacaagugcccccggaucaccgaggccgagcccgacgacguggacugcuggugcaacgccaccgacaccugggugaccuacgggaccugcagccagaccggcgagcaccggcgcgacaagcggagcguggcccucgcgccccacgugggccuggggcuggagacccgcaccgagaccuggauguccagcgagggcgccuggaagcagauccagcgggucgagacgugggcccuccgccaccccggguucaccgugaucgcccuguuccuggcgcacgccaucggcaccuccaucacccagaaggggaucaucuucauccuccugaugcuggugacgcccagcauggccaugcggugcgucggcaucggcucccgcgacuucguggaggggcucagcggcgccaccuggguggacgucgugcuggagcacggguccugcgugaccaccauggccaaggacaagcccacgcuggacaucgagcuccugaagaccgaggucaccaaccccgcggugcugcggaagcucugcaucgaggccaagaucagcaacaccacgaccgacucccgcugccccacccagggcgaggccacccugauggaggagcaggacgccaacuucgugugccggcgcacguucgucgaccggggcugggggaacggcugcgggcuguucggcaaggggagccucaucacgugcgccaaguucaagugcgugaccaagcuggagggcaagaucgugcaguacgagaaccugaaguacuccgucaucgugaccgugcacacgggcgaccagcaccaggucgggaacgagagcaccgagcacggcaccaccgcgaccaucacgccccaggcccccaccuccgagauccagcucaccgacuacggggcccugacccuggacugcagcccccgcacgggccucgacuucaacgagauggugcugcugaccaugaaggagaaguccuggcucguccacaagcagugguuccuggaccugccgcuccccuggaccagcggggccagcaccucccaggagacguggaaccggcaggaccugcuggugaccuucaagaccgcccacgcgaagaagcaggagguggucgugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgugaugugcaccggguccuucaagcucgagaaggaggucgcggagacgcagcacggcaccgugcuggugcagaucaaguacgagggcaccgacgcccccugcaagauccccuucagcacccaggacgagaagggggucacgcagaacggccggcugaucaccgccaacccgaucgugaccgacaaggagaagcccgugaacaucgaggccgagccgcccuucggggaguccuacaucgucaucggcgcgggcgagaaggcccugaagcucagcugguucaagaagggguccagcaucggcaagauguucgaggccaccgcccgcggggcccggcgcauggcgauccugggcgacacggccugggacuucggguccgugggcggcguguucaccagcgucgggaagcuggugcaccagaucuucggcaccgccuacgggguccuguucuccggcgucagcuggaccaugaagaucgggaucggcgugcugcugacguggcucggccugaacucccgcagcaccucccugagcaugaccugcaucgccguggggcucgucacccuguaccugggcgugauggugcaggccgacuccgggugcgucaucaacuggaagggccgggagcucaagugcgggagcggcaucuucgugacgaacgaggugcacaccuggaccgagcaguacaaguuccaggcggacagcccgaagcgccuguccgccgccaucggcaaggccugggaggagggggucugcggcauccggagcgccacccgccuggagaacaucauguggaagcagaucuccaacgagcucaaccacauccugcuggagaacgacaugaaguucaccgugguggucggggacguggugggcauccucgcgcaggggaagaagaugauccggccccagcccauggagcacaaguacagcuggaaguccuggggcaaggccaagaucaucggcgccgacguccagaacacgaccuucaucaucgacgggcccaacaccccggagugccccgacgaccagcgcgccuggaacaucugggagguggaggacuacggcuucgggaucuucaccacgaacaucuggcugaagcugcgggacagcuacacccaggugugcgaccaccgccucauguccgcggccaucaaggacagcaaggccguccacgccgacaugggcuacuggaucgaguccgagaagaacgagaccuggaagcuggcccgggcgagcuucaucgaggugaagaccugcaucuggcccaagucccacacgcuguggagcaacggcgugcucgaguccgagaugaucauccccaagaucuacgggggcccgaucagccagcacaacuaccgccccggguacuucacccagaccgccggccccuggcaccuggggaagcuggagcucgacuucgaccugugcgagggcaccacggucgugguggacgagcacugcggcaaccgggggccgucccugcgcaccaccaccgucacgggcaagaucauccacgaguggugcugccggagcugcacccugccgccccuccgcuucaagggggaggacggcugcugguacgggauggagauccggcccgugaaggagaaggaggagaaccuggugaaguccauggucagcgccggcagcggcgagguggacuccuucagccucgggcugcugugcaucuccaucaugaucgaggaggugaugcgcagccgguggucccgcaagaugcucaugaccggcacccuggccgucuuccugcuccugaucauggggcagcugacguggaacgaccucauccggcugugcaucauggugggcgccaacgcgagcgaccgcauggggaugggcaccaccuaccuggcccucauggccaccuucaagaugcgcccgauguucgccguggggcugcuguuccggcgccucacgucccgggagguccugcugcucaccaucgggcugagccugguggccuccgucgagcuccccaacagccuggaggagcugggcgacgggcucgcgaugggcaucaugauccugaagcugcucaccgacuuccagucccaccagcugugggccacccugcucagccugacguucaucaagaccacccugucccuccacuacgccuggaagaccauggccauggugcugagcaucgcgucccuguucccccucugccugagcacgaccucccagaagaccaccuggcugcccgugcuccugggcagccuggggugcaagccgcucacgauguuccugaucaccgagaccaagaucuggggccgcaaguccuggccccugaacgaggggaucauggccgucggcguggugagcauccuccugagcucccugcucaagaacgacgucccccuggccgggccccugaucgccggcggcaugcucaucgccugcuacgugaucagcggguccagcgcggaccugucccuggagaaggccgccgaggugagcugggaggaggaggccgagcacuccggcgccagccacaacauccucgucguggugcaggacgacgggaccaugaagaucaaggacgaggagcgggacgacacccugacgauccugcucaaggcgacccugcuggccgucuccggcguguacccgcucagcauccccgccacccuguucgugugguacuucuggcagaagaagaagcagcgcuccgggguccugugggacacccccagcccgcccgagguggagcgggccgugcuggacgacggcaucuaccgcaucaugcagcggggccuccuggggcgcucccaggucggcguggggguguuccaggagaacgucuuccacacgauguggcacgugacccggggcgccgugcugauguaccaggggaagcgccucgagcccagcugggcguccgucaagaaggaccugaucagcuacggcggcggguggcggcugcagggcuccuggaacaccggggaggagguccaggugaucgccgucgagcccggcaagaaccccaagaacgugcagaccgcccccgggacguucaagacccccgagggcgaggugggcgccaucgcccucgacuucaagcccgggaccagcggcucccccaucgucaaccgcgaggggaagaucgugggccuguacggcaacgggguggucaccacgagcggcaccuacgugagcgcgaucgcccaggccaaggccucccaggaggggccgcugcccgagaucgaggacgagguguuccggaagcgcaaccucaccaucauggaccugcaccccggcagcgggaagacccggcgcuaccugccggcgaucguccgggaggccaucaagcgcaagcuccggacgcugauccuggcccccacccgcgugguggccuccgagauggccgaggcgcucaagggcaugcccauccgcuaccagaccaccgccgucaagagcgagcacacgggcaaggagaucguggaccugaugugccacgccaccuucaccaugcggcugcucucccccgugcgcgucccgaacuacaacaugaucaucauggacgaggcccacuucaccgaccccagcuccaucgccgcgcggggguacaucagcacgcgcgugggcaugggggaggccgccgccaucuucaugaccgccacgccgcccggcuccguggaggcguucccgcagagcaacgccgucauccaggacgaggagcgggacauccccgagcgcuccuggaacagcggguacgaguggaucaccgacuuccccggcaagacggugugguucgugcccuccaucaagagcggcaacgacaucgccaacugccugcggaagaacgggaagcgcgucauccagcugucccggaagaccuucgacaccgaguaccagaagaccaagaacaacgacugggacuacguggugacgaccgacaucagcgagaugggcgccaacuuccgcgcggaccgggucaucgacccgcgccggugccucaagcccgugauccugaaggacgggcccgagcgcgucauccuggccggccccaugccggugaccguggccuccgccgcccagcggcgcgggcggaucggccgcaaccacaacaaggagggcgaccaguacaucuacauggggcagccccucaacaacgacgaggaccacgcgcacuggaccgaggccaagaugcugcuggacaacaucaacacgcccgagggcaucauccccgcccucuucgagccggagcgggagaaguccgccgccaucgacggggaguaccgccugcgcggcgaggcgcggaagaccuucgucgagcugaugcgccgcggggaccuccccguguggcuguccuacaagguggccagcgagggcuuccaguacagcgaccgccgguggugcuucgacggcgagcgcaacaaccagguccuggaggagaacauggacguggagaucuggaccaaggagggggagcggaagaagcuccgcccccgguggcuggacgcccgcaccuacuccgacccccuggcccuccgggaguucaaggaguucgccgcgggccgccggagcguguccggggaccugauccuggagaucggcaagcucccgcagcaccugacgcagcgcgcccagaacgcccuggacaaccucgucaugcugcacaacagcgagcagggcgggcgggccuaccgccacgcgauggaggagcugcccgacaccaucgagacccucaugcugcuggcccucaucgccgugcugaccggcggggugacccuguucuuccucuccggccgggggcugggcaagacgagcaucggccugcucugcgucauggccuccagcgugcugcuguggauggccuccguggagccccacuggaucgcggccagcaucacccucgaguucuuccugaugguccugcucauccccgagccggaccgccagcggacgccccaggacaaccagcuggccuacguggugaucgggcuccucuucaugauccugaccgucgccgccaacgagaugggccugcucgagacgaccaagaaggaccuggggaucggccacguggcgguggagaaccaccaccacgccaccaugcuggacgucgaccuccaccccgccuccgccuggacccuguacgccguggcgacgaccaucaucaccccgaugaugcgccacaccaucgagaacacgaccgccaacaucagccugaccgccaucgccaaccaggccgcgauccucauggggcuggacaagggcuggcccaucuccaagauggacaucggcgugccccugcucgcccuggggugcuacagccaggucaacccccugacccucacggccgccgugcugaugcugguggcgcacuacgccaucaucggcccggggcuccaggccaaggccacccgggaggcccagaagcgcaccgcggccggcaucaugaagaaccccaccgucgacgggaucguggccaucgaccuggaccccguggucuacgacgccaaguucgagaagcagcugggccagaucaugcuccugauccugugcacgucccagauccuccugaugcgcaccaccugggcccugugcgagagcaucacccucgcgacgggcccccugaccacccugugggagggguccccgggcaaguucuggaacaccacgaucgccgugagcauggccaacaucuuccggggguccuaccucgccggcgccggccuggcguucagccugaugaagucccucgggggcgggcgccggggcaccggggcccagggcgagacccugggcgagaaguggaagcgccagcugaaccagcucuccaagagcgaguucaacaucuacaagcgguccgggaucauggagguggaccgcagcgaggccaaggagggccugaagcgcggggagaccacgcgccacgccgucucccggggcaccgcgaagcugcgcugguucguggagcggaaccuggugaagcccgaggggaaggucaucgaccucggcugcggccgcgggggcuggagcuacuacugcgccgggcugaagaaggugaccgaggugaagggcuacaccaagggcgggcccggccacgaggagcccaucccgauggccacguacggguggaaccuggucaagcuccacuccggcaaggacguguucuucacgccgcccgagaagugcgacacccugcugugcgacaucggggagagcucccccaacccgaccaucgaggagggccggacccuccgcgugcugaagauggucgagcccuggcugcgggggaaccaguucugcaucaagauccucaaccccuacaugcccagcgugguggagacgcuggagcagaugcagcgcaagcacggcggcaugcugguccggaacccgcucucccgcaacagcacccacgagauguacuggguguccugcgggaccggcaacaucgugagcgccgucaacaugaccucccggaugcugcugaaccgcuucacgauggcccaccgcaagcccaccuacgagcgggacguggaccucggggcgggcacccgccacguggccgucgagcccgagguggccaaccuggacaucaucggccagcggaucgagaacaucaagcacgagcacaagagcaccuggcacuacgacgaggacaaccccuacaagacgugggccuaccacggguccuacgaggucaagccgagcggcuccgccagcagcauggugaacgggguggucaagcugcucaccaagcccugggacgugauccccauggugacccagaucgcgaugaccgacacgacccccuucggccagcagcgcgucuucaaggagaagguggacacccggaccccgaaggccaagcgcgggacggcccagaucauggaggugaccgcccgguggcuguggggcuuccugucccgcaacaagaagccccggaucugcacccgcgaggaguucacccggaagguccgcagcaacgccgcgaucggcgccguguucguggacgagaaccaguggaacuccgccaaggaggccgucgaggacgagcgguucugggaccucgugcagaaggagcgcgagcugcacaagcaggggaagugcgcgacgugcguguacaacaugaugggcaagcgggagaagaagcugggggaguucggcaaggccaaggggagccgcgccaucugguacauguggcucggcgcccgguuccuggaguucgaggcccugggcuucaugaacgaggaccacugguucucccgcgagaacagccucuccggggucgagggcgaggggcugcacaagcugggcuacauccuccgggacaucagcaagauccccgggggcaacauguacgcggacgacaccgccggcugggacacccgcaucaccgaggacgaccugcagaacgaggccaagaucacggacaucauggagccggagcacgcccugcucgccaccuccaucuucaagcugaccuaccagaacaagguggugcggguccagcgccccgcgaagaacgggaccgugauggacgugaucagccgccgggaccagcgcggcuccgggcaggucggcacguacggccugaacaccuucaccaacauggaggcccagcucauccggcagauggagagcgaggggaucuuccugcccuccgagcuggagacccccaaccucgccgagcgcgugcuggacuggcuggagaaguacggcguggagcggcucaagcgcauggccaucagcggggacgacugcgucgugaagccgaucgacgaccgguucgccacggcgcugaccgcccugaacgacaugggcaaggugcgcaaggacaucccccagugggagcccuccaagggguggaacgacuggcagcagguccccuucugcagccaccacuuccaccagcucaucaugaaggacggccgggagaucguggugccgugccgcaaccaggacgagcuggucggccgggcccgcgugucccagggggccggcuggagccugcgggagaccgccugccucggcaagagcuacgcgcagauguggcagcugauguacuuccaccgccgggaccugcgccucgccgccaacgccaucugcuccgcggugcccgucgacugggugcccaccagccggacgaccugguccauccacgcccaccaccaguggaugaccaccgaggacaugcugagcguguggaaccgcgucuggaucgaggagaaccccuggauggaggacaagacccacguguccagcuggggcgacgugccguaccuggggaagcgggaggaccaguggugcggcucccucaucggccugacggcccgcgccaccugggccagcaacauccaggucgcgaucaaccaggugcgccggcugaucgggaacgagaacuaccucgacuacaugaccuccaugaagcgcuucaagaacgagggcgaccccgagggggcccugugguga

SEQ ID NO: 8563 - RNA, 9879 nt, Artificial Sequence
  derived and/or modified CDS sequence (opt1) from DENV-1__GQ199839__SS-prME
agcgugaccaugcugcucaugcugaugcccaccgcccuggccuuccaccucaccacccggggcggggagccccacaugaucgugaccaagcaggagcggggcaagagccugcuguucaagaccagcgcgggggugaacaugugcacccucaucgccauggaccugggcgagcugugcgaggacaccaugaccuacaagugcccccggaucaccgaggccgagcccgacgacguggacugcuggugcaacgccaccgacaccugggugaccuacgggaccugcagccggacgggcgagcaccgccgggacaagcgcagcguggcccucgcgccccacgugggccuggggcuggagacccggaccgagaccuggauguccagcgagggcgccuggaagcagauccagcgcguggagacgugggcccuccggcaccccggguucaccgugaucgcccuguuccuggcgcacgccaucggcaccuccaucacccagaaggggaucaucuucauccuccugaugcuggugacgcccagcauggccaugcgcugcgucggcaucggcucccgggacuucguggaggggcucagcggcgccaccuggguggacgucgugcuggagcacggguccugcgugaccaccauggccaaggacaagcccacgcuggacaucgagcuccugaagaccgaggucaccaaccccgcggugcugcgcaagcucugcaucgaggccaagaucagcaacaccacgaccgacucccggugccccacccagggcgaggccacccugauggaggagcaggacgccaacuucgugugccgccggacguucgucgaccgcggcugggggaacggcugcgggcuguucggcaaggggagccucaucacgugcgccaaguucaagugcgugaccaagcuggagggcaagaucgugcaguacgagaaccugaaguacuccgucaucgugaccgugcacacgggcgaccagcaccaggucgggaacgagagcaccgagcacggcaccaccgcgaccaucacgccccaggcccccaccuccgagauccagcucaccgacuacggggcccugacccuggacugcagcccccggacgggccucgacuucaacgagauggugcugcugaccaugaaggagaaguccuggcucguccacaagcagugguuccuggaccugccgcuccccuggaccagcggggccagcaccucccaggagacguggaaccgccaggaccugcuggugaccuucaagaccgcccacgcgaagaagcaggagguggucgugcucggcagccaggagggcgccaugcacaccgcccugacgggggccaccgagauccagaccuccggcaccacgaccaucuucgccgggcaccugaagugccggcucaagauggacaagcugacccugaagggcaugagcuacgugaugugcaccggguccuucaagcucgagaaggaggucgcggagacgcagcacggcaccgugcuggugcagaucaaguacgagggcaccgacgcccccugcaagauccccuucagcacccaggacgagaagggggucacgcagaacggccgccugaucaccgccaacccgaucgugaccgacaaggagaagcccgugaacaucgaggccgagccgcccuucggggaguccuacaucgucaucggcgcgggcgagaaggcccugaagcucagcugguucaagaagggguccagcaucggcaagauguucgaggccaccgcccgcggggcccgccgcauggcgauccugggcgacacggccugggacuucggguccaucggcggcguguucaccagcguggggaagcugguccaccagaucuucggcaccgccuacgggguccuguucuccggcgugagcuggaccaugaagaucgggaucggcguccugcugacguggcucggccugaacucccggagcaccucccugagcaugaccugcaucgccguggggcucgugacccuguaccugggcgucauggugcaggccgacuccgggugcgugaucaacuggaagggccgcgagcucaagugcgggagcggcaucuucgucacgaacgaggugcacaccuggaccgagcaguacaaguuccaggcggacagcccgaagcggcuguccgccgccaucggcaaggccugggaggagggggugugcggcauccgcagcgccacccggcuggagaacaucauguggaagcagaucuccaacgagcucaaccacauccugcuggagaacgggcucaaguucaccgucguggugggcgacgucguggggauccuggcgcagggcaagaagaugauccgcccccagcccauggagcacaaguacagcuggaaguccuggggcaaggccaagaucaucggggccgacgugcagaacacgaccuucaucaucgacggccccaacaccccggagugccccgacgaccagcgggccuggaacaucugggaggucgaggacuacggguucggcaucuucaccacgaacaucuggcugaagcuccgcgacagcuacacccaggugugcgaccaccggcugauguccgcggccaucaaggacagcaaggccgugcacgccgacaugggcuacuggaucgaguccgagaagaacgagaccuggaagcuggcccgcgcgagcuucaucgaggucaagaccugcaucuggcccaagucccacacgcucuggagcaacggggugcuggaguccgagaugaucauccccaagaucuacggcgggccgaucagccagcacaacuaccggcccggcuacuucacccagaccgccgggcccuggcaccugggcaagcucgagcuggacuucgaccugugcgagggcaccacgguggucguggacgagcacugcgggaaccgcggcccgucccuccggaccaccaccgugacggggaagaucauccacgaguggugcugccgcagcugcacccugccgccccugcgguucaagggcgaggacgggugcugguacggcauggagauccgccccgucaaggagaaggaggagaaccucgugaaguccauggugagcgccggcagcggggaggucgacuccuucagccugggccugcucugcaccuccaucaugaucgaggaggugaugcggagccgcuggucccggaagaugcugaugaccgggacgcuggccguguuccuccugcugaucaugggccagcucaccuggaacgaccugauccgccugugcaucauggucggggccaacgcgagcgaccgcaugggcaugggcaccaccuaccucgcccugauggccacguucaagaugcggccgauguucgccguggggcuccuguuccgccggcugaccucccgcgaggugcugcuccugaccaucgggcugagccucgucgccuccguggagcugcccaacagccuggaggagcucggggacggccuggcgaugggcaucaugauccugaagcuccugaccgacuuccagucccaccagcugugggccacgcuccugagccugaccuucaucaagaccacccucucccugcacuacgccuggaagacgauggccaugguccugagcaucgugucccucuucccccugugccugagcaccaccucccagaagaccacguggcuccccgugcugcuggggagccucggcugcaagccgcugaccauguuccugaucgcggagaacaagaucugggggcggaaguccuggccccucaacgagggcaucauggccgucgggguggugagcauccugcugagcucccuccugaagaacgacgucccccuggccggcccccucaucgccggcgggaugcugaucgccugcuacgugaucagcggcuccagcgcggaccugucccucgagaaggccgccgaggugagcugggaggaggaggccgagcacuccggggccagccacaacaucuucgucgaggugcaggacgacggcaccaugaagaucaaggacgaggagcgcgacgacacccugaccauccugcucaaggcgacgcugcuggccguguccggggucuacccgcucagcauccccgccacccuguucgugugguacuucuggcagaagaagaagcagcgguccggcgugcugugggacacccccagcccgcccgaggucgagcgcgccgcccuggacgacggcaucuaccggaucaugcagcgcgggcuccugggccggucccaggugggggugggcgucuuccaggagaacguguuccacaccauguggcacgugacgcgcggggcgguccugauguaccagggcaagcggcucgagcccagcugggccuccgugaagaaggaccugaucagcuacggcgggggcuggcgccugcagggguccuggaacaccggcgaggaggugcaggucaucgccguggagcccgggaagaaccccaagaacgugcagaccgcccccggcaccuucaagacgcccgagggcgaggucggggccaucgcgcucgacuucaagcccggcaccagcgggucccccaucgugaaccgggagggcaagaucgugggccuguacgggaacggcgucgugaccaccagcgggacguacgugagcgccaucgcccagaccaaggccucccaggagggcccgcugcccgagaucgaggacgaggucuuccgcaagcggaaccucaccaucauggaccugcaccccgggagcggcaagacccgccgguaccugccggcgaucgugcgcgaggccaucaagcggaagcuccgcacgcugauccuggcccccacccgcguggucgccuccgagauggccgaggcgcucaagggcaugcccauccgguaccagaccaccgccgucaagagcgagcacacggggaaggagaucguggaccugaugugccacgccaccuucaccaugcgccugcucucccccguccgggugccgaacuacaacaugaucaucauggacgaggcccacuucaccgaccccagcuccaucgccgcgcgcggcuacaucagcacgcggguggggaugggcgaggccgccgccaucuucaugaccgccacgccgcccggguccgucgaggcguucccgcagagcaacgccgugauccaggacgaggagcgcgacauccccgagcgguccuggaacagcggcuacgaguggaucaccgacuuccccggcaagacggugugguucguccccuccaucaagagcgggaacgacaucgccaacugccugcgcaagaacggcaagcgggugauccagcugucccgcaagaccuucgacaccgaguaccagaagaccaagaacaacgacugggacuacguggucacgaccgacaucagcgagaugggggccaacuuccgggcggaccgcgugaucgacccgcggcgcugccucaagcccgugauccugaaggacggccccgagcgggucauccuggccgggcccaugccggugaccgucgccuccgccgcccagcgccggggccgcaucggccggaaccacaacaaggagggggaccaguacaucuacaugggccagccccucaacaacgacgaggaccacgcgcacuggaccgaggccaagaugcugcuggacaacaucaacacgcccgaggggaucauccccgcccucuucgagccggagcgcgagaaguccgccgccaucgacggcgaguaccgccugcgcggggaggcgcgcaagaccuucguggagcugaugcggcgcggcgaccuccccguguggcuguccuacaaggucgccagcgagggcuuccaguacagcgaccggcgcuggugcuucgacggggagcggaacaaccaggugcuggaggagaacauggacguggagaucuggaccaaggagggcgagcgcaagaagcuccggccccgcuggcuggacgcccggaccuacuccgacccccuggcccuccgcgaguucaaggaguucgccgcggggcggcgcagcgucuccggcgaccugauccuggagaucggcaagcucccgcagcaccugacgcagcgggcccagaacgcccuggacaaccucgugaugcugcacaacagcgagcagggcgggcgcgccuaccggcacgcgauggaggagcugcccgacaccaucgagacccucaugcugcuggcccucaucgccgugcugaccgggggcgucacccuguucuuccucuccgggcgcggccugggcaagacgagcaucgggcugcucugcgugauggccuccagcgugcugcuguggauggccuccgucgagccccacuggaucgcggccagcaucauccucgaguucuuccugauggugcugcucauccccgagccggaccggcagcgcacgccccaggacaaccagcuggccuacguggucaucggccuccucuucaucauccugaccguggccgccaacgagauggggcugcucgagaccacgaagaaggaccugggcaucgggcacguggcggucgagaaccaccaccacgccaccaugcuggacguggaccuccaccccgccuccgccuggacccuguacgccguggcgaccacgaucaucaccccgaugaugcggcacaccaucgagaacaccacggccaacaucagccugaccgccaucgccaaccaggccgcgauccucaugggccuggacaagggcuggcccaucuccaagauggacaucggggucccccugcucgcccugggcugcuacagccaggugaacccccugacccucaccgccgccgugcugaugcuggucgcgcacuacgccaucaucgggccgggccuccaggccaaggccacgcgcgaggcccagaagcgcaccgcggccgggaucaugaagaaccccaccguggacggcaucguggccaucgaccuggaccccgucguguacgacgccaaguucgagaagcagcugggccagaucaugcuccugauccugugcaccucccagauccuccugaugcggacgaccugggcccugugcgagagcaucacccucgcgaccgggccccugacgacccugugggagggcuccccggggaaguucuggaacaccaccaucgccgugagcauggccaacaucuuccgcggcuccuaccucgccggcgccgggcuggcguucagccugaugaagucccucggcgggggccggcgcgggacgggcgcccagggcgagacccugggggagaaguggaagcggcagcugaaccagcucuccaagagcgaguucaacaucuacaagcgcuccggcaucauggaggucgaccggagcgaggccaaggaggggcugaagcgcggcgagaccacccggcacgccgugucccgcgggacggcgaagcugcggugguucguggagcgcaaccuggucaagcccgagggcaaggugaucgaccucggcugcgggcggggcggguggagcuacuacugcgccggccugaagaaggugaccgaggucaagggguacaccaagggcggccccgggcacgaggagcccaucccgauggccaccuacggcuggaaccuggugaagcuccacuccgggaaggacguguucuucacgccgcccgagaagugcgacacccugcugugcgacaucggcgagagcucccccaacccgaccaucgaggaggggcgcacccuccggguccugaagaugguggagcccuggcugcgcggcaaccaguucugcaucaagauccucaaccccuacaugcccagcguggucgagacccuggagcagaugcagcggaagcacggcgggaugcuggugcgcaacccgcucucccggaacagcacgcacgagauguacuggguguccugcggcaccgggaacaucgucagcgccgugaacaugaccucccgcaugcugcugaaccgcuucaccauggcccaccggaagcccacguacgagcgcgacguggaccucggcgcgggcacccggcacgucgccguggagcccgagguggccaaccuggacaucaucgggcagcgcaucgagaacaucaagcacgagcacaagagcaccuggcacuacgacgaggacaaccccuacaagaccugggccuaccacggcuccuacgaggucaagccgagcggguccgccagcagcauggugaacggcgucgugaagcugcucacgaagcccugggacgugauccccauggucacccagaucgcgaugaccgacaccacgcccuucgggcagcagcggguguucaaggagaagguggacacccgcaccccgaaggccaagcggggcaccgcccagaucauggaggucacggcccgcuggcuguggggcuuccugucccggaacaagaagccccgcaucugcacccgggaggaguucacccgcaaggugcggagcaacgccgcgaucggggccguguucgucgacgagaaccaguggaacuccgccaaggaggccguggaggacgagcgcuucugggaccucgugcagaaggagcgggagcugcacaagcagggcaagugcgcgaccugcgucuacaacaugauggggaagcgcgagaagaagcugggcgaguucgggaaggccaagggcagccgggccaucugguacauguggcucggcgcccgcuuccuggaguucgaggcccugggguucaugaacgaggaccacugguucucccgggagaacagccucuccggcguggagggggagggccugcacaagcugggguacauccuccgcgacaucagcaagauccccggcggcaacauguacgcggacgacacggccgggugggacacccggaucaccgaggacgaccugcagaacgaggccaagaucaccgacaucauggagccggagcacgcccugcucgccacguccaucuucaagcugaccuaccagaacaaggugguccgcgugcagcgccccgcgaagaacggcaccgugauggacgucaucagccggcgcgaccagcggggguccggccaggugggcaccuacgggcugaacacguucaccaacauggaggcccagcucauccgccagauggagagcgagggcaucuuccugcccuccgagcuggagacccccaaccucgccgagcgggugcuggacuggcuggagaaguacggggucgagcgccucaagcggauggccaucagcggcgacgacugcguggugaagccgaucgacgaccgcuucgccaccgcgcugacggcccugaacgacauggggaagguccggaaggacaucccccagugggagcccuccaagggcuggaacgacuggcagcagguccccuucugcagccaccacuuccaccagcucaucaugaaggacggccgcgagaucguggucccgugccggaaccaggacgagcugguggggcgcgcccgggugucccagggcgccggguggagccugcgcgagaccgccugccucggcaagagcuacgcgcagauguggcagcugauguacuuccaccggcgcgaccugcggcucgccgccaacgccaucugcuccgcgguccccguggacugggugcccaccagccgcaccacgugguccauccacgcccaccaccaguggaugaccaccgaggacaugcugagcgucuggaaccggguguggaucgaggagaaccccuggauggaggacaagacccacguguccagcuggggcgacgucccguaccugggcaagcgcgaggaccaguggugcggcucccucaucgggcugaccgcccgcgccacgugggccagcaacauccagguggcgaucaaccaggugcggcgccugaucggcaacgagaacuaccucgacuacaugaccuccaugaagcgguucaagaacgagggggaccccgagggcgcccugugguga

SEQ ID NO: 8564 - RNA, 9879 nt, Artificial Sequence
  derived and/or modified CDS sequence (opt1) from DENV-1__FJ898397__SS-prME
agcgugaccaugcugcucaugcugaugcccaccgcccuggccuuccaccucaccauccggggcggggagccccacaugaucgugagcaagcaggagcggggcaagagccugcuguucaagaccagcgccggggugaacaugugcacccucaucgccauggaccugggcgaguucugcgaggacaccaugaccuacaagugcccccgcaucaccgaggccgagcccgacgacguggacugcuggugcaacgccaccgacaccugggugaccuacgggaccugcagccagaccggcgagcaccggcgggacaagcgguccguggcccuggcgccccacgugggccucgggcuggagacccgcacggagaccuggaugagcuccgagggcgccuggaagcagauccagcggguggagaccugggcccugcgccaccccggguucaccgugaucgcccucuuccuggcgcacgccaucggcacgagcaucacccagaaggggaucaucuucauccugcucaugcuggugacccccuccauggccaugcggugcgucggcaucggcagccgcgacuucguggaggggcuguccggcgccaccuggguggacgucgugcucgagcacgggagcugcgugacgaccauggccaaggacaagcccacccuggacaucgagcugcucaagaccgaggucacgaaccccgcggugcugcggaagcugugcaucgaggccaagaucuccaacaccaccaccgacagccgcugcccgacgcagggcgaggccacccucguggaggagcaggacgccaacuucgucugccggcgcaccuucguggaccggggcugggggaacggcugcgggcuguucggcaaggggucccugaucacgugcgccaaguucaagugcgugacgaagcucgagggcaagaucguccaguacgagaaccugaaguacagcgugaucgugaccguccacaccggcgaccagcaccagguggggaacgaguccaccgagcacggcacgaccgcgaccaucacgccccaggcccccagcaccgagauccagcugacggacuacggggcccucacccuggacugcagcccccggaccggccuggacuucaacgagaugguccuccugaccaugaaggagaaguccuggcuggugcacaagcagugguuccucgaccugccgcugcccuggacgagcggggccuccaccagccaggagaccuggaaccggaaggaccuccuggugaccuucaagacggcccacgcgaagaagcaggaggucguggugcugggcucccaggagggcgccaugcacaccgcccucaccggggccaccgagauccagacgagcggcaccaccaccaucuucgccgggcaccugaagugccgccugaagauggacaagcucacgcugaagggcauguccuacgucaugugcaccgggagcuucaagcuggagaaggagguggcggagacccagcacggcaccgugcucguccagaucaaguacgagggcacggacgcccccugcaagauccccuucuccacccaggacgagaagggggugacccagaacggccggcugaucaccgccaacccgaucgugacggacaaggagaagcccgucaacaucgaggccgagccgcccuucggggagagcuacaucgugaucggcgcgggcgagaaggcccugaagcuguccugguucaagaaggggagcuccaucggcaagauguucgaggccaccgcccgcggggcccggcgcauggcgauccucggcgacaccgccugggacuucgggagcaucggcggcguguucaccuccgucgggaagcuggugcaccagaucuucggcacggccuacggggugcuguucagcggcgucuccuggaccaugaagaucgggaucggcgugcuccugaccuggcugggccucaacagccgcuccaccagccuguccaugacgugcaucgccguggggcuggucacccucuaccugggcgugauggugcaggccgacagcgggugcgucaucaacuggaagggccgggagcugaagugcgggagcggcaucuucgugaccaacgaggugcacaccuggacggagcaguacaaguuccaggcggacuccccgaagcgccucagcgccgccaucggcaaggccugggaggagggggucugcggcauccgguccgccacccgccuggagaacaucauguggaagcagaucagcaacgagcugaaccacauccuccuggagaacgacaugaaguucaccgugguggucggggacguggcgggcauccuggcccaggggaagaagaugauccggccccagcccauggaguacaaguacuccuggaaguccuggggcaaggccaagaucaucggcgccgacgugcagaacaccaccuucaucaucgacgggcccaacacgccggagugccccgacgaccagcgcgcguggaacaucugggaggucgaggacuacggcuucgggaucuucaccaccaacaucuggcucaagcugcgggacuccuacacccaggugugcgaccaccgccugaugagcgccgccaucaaggacuccaaggccgugcacgccgacaugggcuacuggaucgagagcgagaagaacgagacguggaagcucgcgcgggccuccuucaucgaggucaagaccugcaucuggcccaagagccacacccugugguccaacggcgugcuggagagcgagaugaucauccccaagaucuacgggggcccgaucucccagcacaacuaccgccccggguacuucacccagacggccggccccuggcaccucgggaagcuggagcuggacuucgaccucugcgagggcaccaccguggucguggacgagcacugcggcaaccgggggccgagccugcgcaccacgaccgugaccggcaagaucauccacgaguggugcugccgguccugcacccugccgccccugcgcuucaagggggaggacggcugcugguacgggauggagauccggcccgucaaggagaaggaggagaaccuggucaagagcauggugagcgccggcuccggcgaggucgacagcuucucccuggggcuccugugcaucagcaucaugaucgaggaggugaugcgcucccgguggagccgcaagaugcugaugacgggcacccucgccguguucuuccugcugaucauggggcagcucaccuggaacgaccugauccggcugugcaucauggucggcgcgaacgccuccgaccgcauggggaugggcaccacguaccucgcccugauggccaccuucaagaugcgcccgauguucgccguggggcuccuguuccggcgccugaccagccgggaggugcugcuccugaccaucgggcugucccucgucgcgagcguggagcugcccaacucccuggaggagcucggcgacgggcuggccaugggcaucaugauccugaagcuccugacggacuuccagagccaccagcugugggccacccuccugucccugaccuucaucaagaccacguucagccuccacuacgccuggaagaccauggcgaugguccuguccaucgugagccuguucccccucugccuguccaccaccagccagaagacgaccuggcugcccgugcuccugggcucccuggggugcaagccgcucaccauguuccugaucgccgagaacaagaucuggggccgcaagagcuggccccugaacgaggggaucauggccgucggcaucgugagcauccuccuguccagccugcucaagaacgacgugccccuggccgggccccugaucgccggcggcaugcucaucgcgugcuacgucaucuccgggagcuccgccgaccugagccuggagaaggccgccgagguguccugggaggaggaggccgagcacagcggcgcgucccacaacauccucguggagguccaggacgacgggaccaugaagaucaaggacgaggagcgggacgacacgcugaccauccugcucaaggccacccugcuggccgugagcggcguguacccgcucuccauccccgccacccuguucgucugguacuucuggcagaagaagaagcagcgcagcggggugcugugggacacccccagcccgcccgagguggagcgggccguccucgacgacggcaucuaccgcaucaugcagcggggccugcuggggcgcagccaggugggcgugggggucuuccaggagaacguguuccacacgauguggcacgugacccggggcgcgguccugauguaccaggggaagcgccucgagcccuccugggccagcgugaagaaggaccugaucuccuacggcggcggguggcggcugcagggcagcuggaacaccggggaggaggugcaggucaucgccguggagcccggcaagaaccccaagaacgugcagaccgcccccgggacguucaagaccuccgagggcgaggucggcgccaucgcgcucgacuucaagcccgggaccagcggcagccccaucgugaaccgcgaggggaagaucgugggccuguacggcaacggggucgugaccacguccggcaccuacgugagcgccaucgcccaggccaaggcgucccaggaggggccccugccggagaucgaggacgaggucuuccggaagcgcaaccucaccaucauggaccugcaccccggcagcgggaagacccggcgcuaccugcccgccaucgugcgggaggccaucaagcgcaagcuccggacgcugauccuggccccgacccgcguggucgccuccgagauggcggaggcccucaagggcaugcccauccgcuaccagaccaccgccgucaagagcgagcacacgggcaaggagaucguggaccugaugugccacgccaccuucaccaugcggcugcucucccccguccgcgugcccaacuacaacaugaucaucauggacgaggcccacuucaccgacccgagcuccaucgcggcccggggguacaucagcacgcgcgugggcaugggggaggccgccgccaucuucaugaccgcgacgccgcccggcuccgucgaggccuucccccagagcaacgccgugauccaggacgaggagcgggacaucccggagcgcuccuggaacagcggguacgaguggaucaccgacuuccccggcaagacggugugguucguccccuccaucaagagcggcaacgacaucgccaacugccugcggaagaacgggaagcgcgugauccagcugucccggaagaccuucgacaccgaguaccagaagaccaagaacaacgacugggacuacguggucacgaccgacaucagcgagaugggcgcgaacuuccgcgccgaccgggugaucgacccccgccggugccucaagccggugauccugaaggacgggcccgagcgcgucauccuggccggccccaugcccgugaccgucgccuccgccgcgcagcggcgcgggcggaucggccgcaaccacaacaaggagggcgaccaguacaucuacauggggcagccgcucaacaacgacgaggaccacgcccacuggaccgaggccaagaugcugcuggacaacaucaacacgcccgagggcaucauccccgcccucuucgagcccgagcgggagaaguccgccgcgaucgacggggaguaccgccugcgcggcgaggcccggaagaccuucguggagcugaugcgccgcggggaccucccgguguggcugagcuacaaggucgccuccgagggcuuccaguacagcgaccgccgguggugcuucgacggcgagcgcaacaaccaggugcuggaggagaacauggacguggagaucuggaccaaggagggggagcggaagaagcuccgcccccgguggcuggacgcccgcaccuacuccgacccccuggcccuccgggaguucaaggaguucgcggccggccgccggagcgucuccggggaccugauccuggagaucggcaagcucccccagcaccugacgcagcgcgcccagaacgcccuggacaaccucgugaugcugcacaacagcgagcagggcgggcgggcguaccgccacgccauggaggagcugccggacaccaucgagacccucaugcugcuggcccucaucgccgugcugaccggcggggucacgcuguucuuccucuccggccgggggcugggcaagaccagcaucggccugcucugcgugauggccuccagcgugcugcuguggauggcguccgucgagccccacuggaucgccgccagcaucauccucgaguucuuccugauggugcugcucauccccgagcccgaccgccagcggaccccgcaggacaaccagcuggccuacguggucaucgggcuccucuucaugauccugaccguggccgcgaacgagaugggccugcucgagaccacgaagaaggaccuggggaucggccacguggccgucgagaaccaccaccacgccgccaugcuggacguggaccuccaccccgccuccgcguggacccuguacgccguggccaccaccaucaucacgcccaugaugcgccacaccaucgagaacaccaccgccaacaucagccugacggccaucgcgaaccaggccgccauccucauggggcuggacaagggcuggccgaucuccaagauggacaucggcgucccccugcucgcccuggggugcuacagccaggugaacccccugacccucaccgcggccgugcugaugcuggucgcccacuacgccaucaucggccccgggcuccaggccaaggcgacccgggaggcccagaagcgcacggccgccggcaucaugaagaacccgaccguggacgggaucguggccaucgaccuggaccccgucguguacgacgcgaaguucgagaagcagcugggccagaucaugcuccugauccugugcaccucccagauccuccugaugcgcaccacgugggcccugugcgagagcaucacccucgccaccggcccccugaccacgcugugggaggggucccccggcaaguucuggaacaccaccaucgccgugagcauggccaacaucuuccgggggagcuaccucgcgggcgccggccuggccuucucccugaugaagucccucgggggcgggcgccggggcaccggggcccagggcgagacgcugggcgagaaguggaagcgccagcugaaccagcucuccaagagcgaguucaacaccuacaagcgguccgggaucauggaggucgaccgcagcgaggcgaaggagggccugaagcgcggggagaccaccaagcacgccgugucccgcggcacggccaagcugcggugguucguggagcgcaaccucgucaagccggaggggaaggugaucgaccugggcugcggccgcggcggguggagcuacuacugcgccgggcugaagaaggugaccgaggucaagggguacaccaagggcgggcccggccacgaggagcccauccccauggccaccuacggguggaaccuggugaagcuccacuccggcaaggacguguucuucaucccgcccgagaagugcgacacgcugcugugcgacaucggggagagcucccccaaccccaccaucgaggagggccgcacccuccggguccugaagaugguggagccguggcugcgcgggaaccaguucugcaucaagauccucaaccccuacaugcccagcguggucgagacccuggagcagaugcagcggaagcacggcggcaugcuggugcgcaacccccucucccggaacagcacgcacgagauguacuggguguccugcgggaccggcaacaucgucagcgcggugaacaugaccucccgcaugcugcugaaccgguucaccauggcccaccgcaagccgaccuacgagcgcgacguggaccucggggccggcacgcggcacgucgccguggagcccgagguggccaaccuggacaucaucggccagcgcaucgagaacaucaagcacgagcacaagagcaccuggcacuacgacgaggacaaccccuacaagaccugggcguaccacggguccuacgaggucaagcccagcggcagcgccuccagcauggugaacggggucgugaagcugcucaccaagccgugggacgugauccccauggucacgcagaucgccaugaccgacaccacccccuucggccagcagcggguguucaaggagaagguggacacgcgcacccccaaggccaagcgggggaccgcccagaucauggaggucaccgcgaaguggcuguggggcuuccugucccgcaacaagaagccgcggaucugcacgcgcgaggaguucacccggaaggugcgcagcaacgccgccaucggcgccguguucgucgacgagaaccaguggaacuccgcgaaggaggccguggaggacgagcgguucugggaccucgugcaccgcgagcgggagcugcacaagcaggggaagugcgcgaccugcgucuacaacaugaugggcaagcgcgagaagaagcugggggaguucggcaaggccaaggggagccgggccaucugguacauguggcucggcgcgcgcuuccuggaguucgaggcccugggcuucaugaacgaggaccacugguucucccgggagaacagccucuccgggguggagggcgaggggcugcacaagcugggcuacauccuccgcgacaucagcaagauccccgggggcaacauguacgccgacgacaccgccggcugggacacgcggaucaccgaggacgaccugcagaacgaggccaagaucaccgacaucauggagcccgagcacgcgcugcucgccaccuccaucuucaagcugacguaccagaacaaggugguccgcgugcagcggccggccaagaacgggaccgugauggacgucaucagccgccgcgaccagcggggcuccggccaggugggcaccuacggccugaacaccuucacgaacauggaggcccagcucauccgccagauggagagcgaggggaucuucucccccagcgagcuggagacccccaaccuggccggccgggugcucgacuggcuggagaagcacggggucgagcgccugaagcggauggcgaucuccggcgacgacugcguggugaagcccaucgacgaccgcuucgccaccgcccucaccgcccugaacgacauggggaagguccggaaggacaucccgcagugggagcccagcaagggcuggaacgacuggcagcagguccccuucugcagccaccacuuccaccagcugaucaugaaggacggccgcgagaucgugguccccugccggaaccaggacgagcucguggggcgcgcccgggugucccagggcgcgggguggagccugcgcgagacggccugccugggcaaguccuacgcccagauguggcagcucauguacuuccaccggcgcgaccugcggcuggccgcgaacgccaucugcagcgccgucccgguggacugggugcccaccucccgcaccaccuggagcauccacgcccaccaccaguggaugacgaccgaggacaugcucuccgucuggaaccggguguggaucgaggagaaccccuggauggaggacaagacccacaucagcuccuggggcgacgugcccuaccugggcaagcgcgaggaccaguggugcggcagccugaucgggcucaccgcccgggcgacgugggccaccaacauccaggucgccaucaaccaggugcgccgccugaucggcaacgagaacuaccuggacuacaugaccuccaugaagcgguucaagaacgagagcgacccggagggggcccucugguga

SEQ ID NO: 8565 - RNA, 9879 nt, Artificial Sequence
  derived and/or modified CDS sequence (opt1) from DENV-1__FJ898398__SS-prME
agcgugaccaugcugcugaugcugaugcccaccgcccuggccuuccaccucacgacccggggcggggagccccacaugaucgugagcaagcaggagcggggcaagagccugcuguucaagaccuccgccggggugaacaugugcacccucaucgccauggaccugggcgaguucugcgaggacaccaugaccuacaagugcccccgcaucaccgaggccgagcccgacgacguggacugcuggugcaacgccaccgacacgugggucaccuacgggaccugcagccagaccggcgagcaccggcgggacaagcgguccguggcccuggcgccccacgugggccucgggcuggagacgcgcaccgagaccuggaugagcuccgagggcgccuggaagcagauccagcgggucgagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugcccgacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaagaucguccaguacgagaaccugaaguacagcgugaucgugaccguccacaccggcgaccagcaccagguggggaacgaguccacggagcacggcaccaccgcgaccaucacgccccaggcccccagcacggagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccagcggggccuccaccagccaggagaccuggaaccggcaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcauguccuacgucaugugcaccgggagcuucaagcuggagaaggagguggcggagacccagcacggcacggugcucguccagaucaaguacgagggcaccgacgcccccugcaagauccccuucuccacccaggacgagaagggggugacccagaacggccggcugaucacggccaacccgaucgugaccgacaaggagaagcccgucaacaucgaggccgagccgcccuucggggagagcuacaucgugaucggcgcgggcgagaaggcccugaagcuguccugguucaagaaggggagcuccaucggcaagauguucgaggccaccgcccgcggggcccggcgcauggcgauccucggcgacaccgccugggacuucgggagcaucggcggcguguucacguccgucgggaagcuggugcaccagaucuucggcaccgccuacggggugcuguucagcggcgucuccuggaccaugaagaucgggaucggcgugcuccugaccuggcugggccucaacagccgcuccacgagccuguccaugaccugcaucgccguggggcuggucacccucuaccugggcgugauggugcaggccgacagcgggugcgucaucaacuggaagggccgggagcugaagugcgggagcggcaucuucgugaccaacgaggugcacacguggaccgagcaguacaaguuccaggcggacuccccgaagcgccucagcgccgccaucggcaaggccugggaggagggggucugcggcauccgguccgccacccgccuggagaacaucauguggaagcagaucagcaacgagcugaaccacauccuccuggagaacgacaugaagcugaccgugguggucggggacguggcgggcauccucgcccaggggaagaagaugauccggccccagcccauggaguacaaguacuccuggaagaucuggggcaaggccaagaucaucggcgccgacgugcagaacaccacguucaucaucgacgggcccaacaccccggagugccccgacgaccagcgcgcguggaacaucugggaggucgaggacuacggcuucgggaucuucaccaccaacaucuggcugaagcugcgggacagcuacacccaggugugcgaccaccgccucauguccgccgccaucaaggacagcaaggccgugcacgccgacaugggcuacuggaucgaguccgagaagaacgagaccuggaagcuggcgcgggccagcuucaucgaggucaagaccugcaucuggcccaagucccacacccuguggagcaacggcgugcucgaguccgagaugaucauccccaagaucuacgggggcccgaucagccagcacaacuaccgccccggguacuucacgcagaccgccggccccuggcaccuggggaagcuggagcucgacuucgaccugugcgagggcaccaccguggucguggacgagcacugcggcaaccgggggccgucccugcgcacgaccaccgugaccggcaagaucauccacgaguggugcugccggagcugcacgcugccgccccuccgcuucaagggggaggacggcugcugguacgggauggagauccggcccgucaaggagaaggaggagaaccuggugaaguccauggugagcgccggcagcggcgaggucgacuccuucagccucgggcugcugugcaucuccaucaugaucgaggaggugaugcgcagccgguggucccgcaagaugcucaugaccggcacccuggccguguucuuccugcucaucauggggcagcugaccuggaacgaccugauccggcucugcaucauggucggcgcgaacgccagcgaccgcauggggaugggcacgaccuaccuggcccugauggccaccuucaagaugcgcccgauguucgccgugggccuccuguuccggcgccugaccucccgggaggugcuccugcugacgaucgggcucagccuggucgcguccguggagcugcccaacagccucgaggagcugggcgacgggcuggccaugggcaucaugauccucaagcugcugaccgacuuccagucccaccagcucugggccacccugcugagccucaccuucauccgcacgaccuucucccugcacuacgccuggaagaccauggcgaugguccugagcaucgugucccucuucccccugugccugagcaccacgucccagaagaccaccuggcuccccgugcugcugggcagccucgggugcaagccgcugaccauguuccugaucgccgagaacaagaucuggggccggaaguccuggccccucaacgaggggaucauggccgucggcaucgugagcauccugcugagcucccuccugaagaacgacgugccccuggccgggccccucaucgccggcggcaugcugaucgcgugcuacgucaucagcggguccagcgccgaccugucccucgagaaggccgccgaggugagcugggaggaggaggccgagcacuccggcgcgagccacaacauccugguggagguccaggacgacgggacgaugaagaucaaggacgaggagcgcgacgacacccugaccauccuccugaaggccacccugcucgccguguccggcguguacccgcugagcauccccgccacccuguucgucugguacuucuggcagaagaagaagcagcgguccggggugcucugggacacgcccagcccgcccgagguggagcgcgccguccuggacgacggcaucuaccggaucaugcagcgcggccugcuggggcggucccaggugggcgugggggucuuccaggagaacguguuccacaccauguggcacgugacccgcggcgcgguccucauguaccaggggaagcggcuggagcccagcugggccuccgugaagaaggaccugaucagcuacggcggcggguggcgccuccagggcuccuggaacaccggggaggaggugcaggucaucgccguggagcccggcaagaaccccaagaacgugcagacggcccccgggaccuucaagaccagcgagggcgaggucggcgccaucgcgcuggacuucaagcccgggaccuccggcagccccaucgugaaccgggaggggaagaucgugggccuguacggcaacggggucgugacgaccagcggcaccuacguguccgccaucgcccaggccaaggcgagccaggaggggccccucccggagaucgaggacgaggucuuccgcaagcggaaccugaccaucauggaccugcaccccggcuccgggaagacgcgccgguaccuccccgccaucgugcgcgaggccaucaagcggcgccugcgcacccugauccucgccccgacccggguggucgccagcgagauggcggaggcccugaagggcaugcccauccgcuaccagaccacggccgugaaguccgagcacaccggcaaggagaucguggaccugaugugccacgccaccuucaccaugcggcuccugagccccguccgcgugcccaacuacaacaugaucaucauggacgaggcccacuucacggacccguccagcaucgcggcccggggguacaucuccacccgcgugggcaugggggaggccgccgccaucuucaugaccgcgacgccgcccggcagcgucgaggccuucccccaguccaacgccgugauccaggacgaggagcgggacaucccggagcgcagcuggaacuccggguacgaguggaucacggacuuccccggcaagaccgugugguucguccccagcaucaaguccggcaacgacaucgccaacugccugcggaagaacgggaagcgcgugauccagcucagccggaagaccuucgacaccgaguaccagaagacgaagaacaacgacugggacuacguggucaccaccgacaucuccgagaugggcgcgaacuuccgcgccgaccgggugaucgacccccgccggugccugaagccggugauccugaaggacgggcccgagcgcgucauccucgccggccccaugcccgugaccgucgccagcgccgcgcagcggcgcgggcggaucggccgcaaccacaacaaggagggcgaccaguacaucuacauggggcagccgcugaacaacgacgaggaccacgcccacuggacggaggccaagaugcugcucgacaacaucaacacccccgagggcaucauccccgcccuguucgagcccgagcgcgagaaguccgccgcgaucgacggggaguaccggcugcgcggcgaggcccggaagaccuucguggagcucaugcgccgcggggaccugccgguguggcugagcuacaaggucgccagcgagggcuuccaguacuccgaccgccgguggugcuucgacggcgagcgcaacaaccaggugcucgaggagagcauggacguggagaucuggaccaaggagggggagcggaagaagcugcgcccccgguggcuggacgcccgcacguacuccgacccccucgcccugcgggaguucaaggaguucgcggccggccgccggagcgucuccggggaccugauccucgagaucggcaagcugccccagcaccugacccagcgcgcccagaacgcccucgacaaccuggugaugcugcacaacagcgagcagggcgggcgggcguaccgccacgccauggaggagcucccggacaccaucgagacccugaugcugcucgcccugaucgccgugcugacgggcggggucacccucuucuuccuguccggccgggggcugggcaagaccagcaucggccuccugugcgugauggccuccagcgugcugcucuggauggcguccgucgagccccacuggaucgccgccagcaucauccuggaguucuuccugauggugcuccugauccccgagcccgaccgccagcggaccccgcaggacaaccagcuggccuacguggucaucgggcuccuguucaugauccugaccguggccgcgaacgagaugggccuccuggagacgaccaagaaggaccuggggaucggccacguggccgucgagaaccaccaccacgccgccaugcucgacguggaccugcaccccgccuccgcguggacccuguacgccguggccaccacgaucaucacccccaugaugcgccacaccaucgagaacaccacggccaacaucagccucaccgccaucgcgaaccaggccgccauccugauggggcuggacaagggcuggccgaucuccaagauggacaucggcgucccccuccuggcccuggggugcuacagccaggugaacccccucacccugaccgcggccgugcugaugcucgucgcccacuacgccaucaucggccccgggcugcaggccaaggcgacgcgcgaggcccagaagcggaccgccgccggcaucaugaagaacccgaccguggacgggaucguggccaucgaccuggaccccgucguguacgacgcgaaguucgagaagcagcucggccagaucaugcugcugauccucugcaccucccagauccugcugaugcgcacgaccugggcccucugcgagagcaucacccuggccaccggcccccugacgacccucugggaggggucccccggcaaguucuggaacaccaccaucgccgugagcauggccaacaucuuccgggggagcuaccuggcgggcgccggccuggccuucucccucaugaagucccucgggggcgggcgccgggggacgggggcccagggcgagacccugggcgagaaguggaagcgccagcucaaccagcuguccaagagcgaguucaacaccuacaagcgguccgggaucauggaggucgaccgcagcgaggcgaaggagggccugaagcgcggggagaccacgaagcacgccgugucccgcggcaccgccaagcuccggugguucguggagcgcaaccuggucaagccggaggggaaggugaucgaccugggcugcggccgcggcggguggagcuacuacugcgccgggcugaagaaggugaccgaggucaagggguacaccaagggcgggcccggccacgaggagcccauccccauggccacguacggguggaaccucgugaagcugcacuccggcaaggacguguucuucaucccgcccgagaagugcgacacccugcucugcgacaucggggagagcucccccaaccccaccaucgaggagggccgcacccugcggguccugaagaugguggagccguggcuccgcgggaaccaguucugcaucaagauccugaaccccuacaugcccagcguggucgagacgcuggagcagaugcagcggaagcacggcggcaugcucgugcgcaacccccugucccggaacagcacccacgagauguacuggguguccugcgggaccggcaacaucgucagcgcggugaacaugaccucccgcaugcugcucaaccgcuucaccauggcccaccggaagccgacguacgagcgcgacguggaccugggggccggcacccggcacgucgccguggagcccgagguggccaaccuggacaucaucggccagcgcaucgagaacaucaagcacgagcacaagagcaccuggcacuacgacgaggacaaccccuacaagaccugggcguaccacggguccuacgaggucaagcccagcggcagcgccuccagcauggugaacggggucgugaagcuccugacgaagccgugggacgugauccccauggucacccagaucgccaugaccgacaccacgcccuucggccagcagcggguguucaaggagaagguggacacccgcacccccaaggccaagcgggggaccgcccagaucauggaggucacggcgaaguggcuguggggcuuccucucccgcaacaagaagccgcggaucugcacccgcgaggaguucacccggaaggugcgcagcaacgccgccaucggcgccguguucgucgacgagaaccaguggaacuccgcgaaggaggccguggaggacgagcgguucugggaccuggugcaccgcgagcgggagcugcacaagcaggggaagugcgcgaccugcgucuacaacaugaugggcaagcgcgagaagaagcucggggaguucggcaaggccaaggggagccgggccaucugguacauguggcugggcgcgcgcuuccuggaguucgaggcccucggcuucaugaacgaggaccacugguucucccgggagaacagccuguccgggguggagggcgaggggcugcacaagcucggcuacauccugcgcgacaucagcaagauccccgggggcaacauguacgccgacgacacggccggcugggacacccggaucaccgaggacgaccugcagaacgaggccaagaucaccgacaucauggagcccgagcacgcgcuccuggccaaguccaucuucaagcugacguaccagaacaaggugguccgcgugcagcgcccggccaagaacgggaccgugauggacgucaucagccggcgcgaccagcggggcuccggccaggugggcaccuacggccucaacaccuucacgaacauggaggcccagcugauccgccagauggagagcgaggggaucuucucccccagcgagcuggagacccccaaccucgccggccgggugcugaacuggcuggagaagcacggggucgagcgccucaagcggauggcgaucuccggcgacgacugcguggugaagcccaucgacgaccgcuucgccaccgcccugaccgcccugaacgacauggggaagguccggaaggacaucccgcagugggagcccagcaagggcuggaacgacuggcagcagguccccuucugcagccaccacuuccaccagcucaucaugaaggacggccgcgagaucgugguccccugccggaaccaggacgagcugguggggcgcgcccgggugucccagggcgcgggguggagccugcgcgagacggccugccucggcaaguccuacgcccagauguggcagcugauguacuuccaccggcgcgaccugcggcucgccgcgaacgccaucugcagcgccgucccgguggacugggugcccaccucccgcaccaccuggagcauccacgcccaccaccaguggaugacgaccgaggacaugcuguccgucuggaaccggguguggaucgaggagaaccccuggauggaggacaagacccacgugagcuccuggggcgacguccccuaccugggcaagcgcgaggaccaguggugcggcagccucaucgggcugaccgcccgcgcgacgugggccaccaacauccagguggccaucaaccaggugcggcgccugcucggcaacgagaacuaccuggacuacaugaccuccaugaagcgguucaagaacgagagcgacccggagggggcccugugguga

SEQ ID NO: 8566 - RNA, 9879 nt, Artificial Sequence
  derived and/or modified CDS sequence (opt1) from DENV-1__FJ898399__SS-prME
agcgugaccaugcugcucaugcugaugcccaccgcccuggccuuccaccucacgacccgcggcggggagccccacaugaucgugagcaagcaggagcggggcaagagccugcuguucaagaccagcgcgggggugaacaugugcacccucaucgccauggaccugggcgaguucugcgaggacaccaugaccuacaagugcccccgcaucaccgaggccgagcccgacgacguggacugcuggugcaacgccaccgacacgugggucaccuacgggaccugcagccagaccggcgagcaccggcgcgacaagcgguccguggcccuggcgccccacgugggccucgggcuggagacgcgcaccgagaccuggaugagcuccgagggcgccuggaagcagauccagcgggucgagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugcccgacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaagaucguccaguacgagaaccugaaguacagcgugaucgugaccguccacaccggcgaccagcaccagguggggaacgaguccacggagcacggcaccaccgcgaccaucacgccccaggcccccagcacggagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccagcggggccuccaccagccaggagaccuggaaccggaaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcauguccuacgucaugugcaccgggagcuucaagcuggagaaggagguggcggagacccagcacggcacggugcucguccagaucaaguacgagggcaccgacgcccccugcaagauccccuucuccacccaggacgagaagggggugacccagaacggccggcugaucacggccaacccgaucgugaccgacaaggagaagcccgucaacaucgaggccgagccgcccuucggggagagcuacaucgugaucggcgcgggcgagaaggcccugaagcuguccugguucaagaaggggagcuccaucggcaagauguucgaggccaccgcccgcggggcccggcgcauggcgauccucggcgacaccgccugggacuucgggagcaucggcggcguguucacguccgucgggaagcuggugcaccagaucuucggcaccgccuacggggugcuguucagcggcgucuccuggaccaugaagaucgggaucggcgugcuccugaccuggcugggccucaacagccgcuccacgagccuguccaugaccugcaucgccguggggcuggucacccucuaccugggcgugauggugcaggccgacagcgggugcgucaucaacuggaagggccgggagcugaagugcgggagcggcaucuucgugaccaacgaggugcacacguggaccgagcaguacaaguuccaggcggacuccccgaagcgccucagcgccgccaucggcaaggccugggaggagggggucugcggcauccgguccgccacccgccuggagaacaucauguggaagcagaucagcaacgagcugaaccacauccuccuggagaacgacaugaagcugaccgugguggucggggacguggcgggcauccucgggcagggcaagaagaugauccggccccagcccauggaguacaaguacuccuggaaguccuggggcaaggccaagaucaucggggccgacgcccagaacaccacguucaucaucgacggccccaacaccccggagugccccgacgaccagcgcgcguggaacaucugggagguggaggacuacggguucggcaucuucaccaccaacaucuggcugaagcugcgggacuccuacacgcaggucugcgaccaccgccucaugagcgccgccaucaaggacuccaaggccgugcacgccgacaugggcuacuggaucgagagcgagaagaacgagaccuggaagcuggcgcgggccuccuucaucgaggugaagaccugcaucuggcccaagagccacacccugugguccaacgggguccucgagagcgagaugaucauccccaagaucuacggcgggccgaucucccagcacaacuaccgccccggcuacuucacgcagaccgccgggcccuggcaccugggcaagcuggagcucgacuucgaccugugcgagggcaccaccgugguggucgacgagcacugcgggaaccggggcccgagccugcgcacgaccaccgugaccgggaagaucauccacgaguggugcugccgguccugcacgcugccgccccuccgcuucaagggcgaggacgggugcugguacggcauggagauccggcccgugaaggagaaggaggagaaccuggucaagagcauggugagcgccggcuccggggagguggacagcuucucccucggccugcugugcaucagcaucaugaucgaggaggucaugcgcucccgguggagccgcaagaugcucaugaccgggacccuggccguguucuuccugcucaucaugggccagcugaccuggaacgaccugauccggcucugcaucauggugggggcgaacgccuccgaccgcaugggcaugggcacgaccuaccuggcccugauggccaccuucaagaugcgcccgauguucgccgucgggcuccuguuccggcgccugaccagccgggaggugcuccugcugacgaucggccucucccugguggcgagcgucgagcugcccaacucccucgaggagcugggggacggccuggccaugggcaucaugauccucaagcugcugaccgacuuccagagccaccagcucugggccacccugcugucccucaccuucaucaagacgaccuucagccugcacuacgccuggaagaccauggcgauggugcuguccaucgucagccucuucccccugugccuguccaccacgagccagaagaccaccuggcuccccgugcugcuggggucccucggcugcaagccgcugaccauguuccugaucgccgagaacaagaucugggggcgcaagagcuggccccucaacgagggcaucauggccguggggaucgucagcauccugcuguccagccuccugaagaacgacgugccccuggccggcccccucaucgccggcgggaugcugaucgcgugcuacgugaucuccggcagcuccgccgaccugagccucgagaaggccgccgaggucuccugggaggaggaggccgagcacagcggggcgucccacaacauccugguggaggugcaggacgacggcacgaugaagaucaaggacgaggagcgggacgacacccugaccauccuccugaaggccacccugcucgccgucagcgggguguacccgcuguccauccccgccacccuguucgugugguacuucuggcagaagaagaagcagcgcagcggcguccucugggacacgcccagcccgcccgagguggagcgggccgugcuggacgacggcaucuaccgcaucaugcagcgggggcugcugggccgcagccaggucggggugggcguguuccaggagaacgucuuccacaccauguggcacgugacccgcggggccgugcucauguaccagggcaagcgccuggagcccuccugggccagcgucaagaaggaccugaucuccuacggcgggggcuggcggcuccaggggagcuggaacaccggcgaggagguccaggugaucgccgucgagcccgggaagaaccccaagaacgugcagacggcccccggcaccuucaagaccuccgagggcgaggugggggccaucgcgcuggacuucaagcccggcaccagcgggagccccaucgucaaccgcgagggcaagaucgugggccuguacgggaacggcguggucacgaccuccgggaccuacgugagcgccaucgcccaggccaaggcgucccaggagggcccccucccggagaucgaggacgagguguuccggaagcgcaaccugaccaucauggaccugcaccccgggagcggcaagacgcggcgcuaccuccccgccaucguccgggaggccaucaagcgcaagcugcggacccugauccucgccccgacccgcgugguggccuccgagauggcggaggcccugaagggcaugcccauccgcuaccagaccacggccgucaagagcgagcacaccgggaaggagaucguggaccugaugugccacgccaccuucaccaugcggcuccugucccccgugcgcguccccaacuacaacaugaucaucauggacgaggcccacuucacggacccgagcuccaucgcggcccggggcuacaucagcacccgcguggggaugggcgaggccgccgccaucuucaugaccgcgacgccgcccggguccguggaggccuucccccagagcaacgccgucauccaggacgaggagcgggacaucccggagcgcuccuggaacagcggcuacgaguggaucacggacuuccccggcaagaccgugugguucgugcccuccaucaagagcgggaacgacaucgccaacugccugcggaagaacggcaagcgcgucauccagcucucccggaagaccuucgacaccgaguaccagaagacgaagaacaacgacugggacuacguggugaccaccgacaucagcgagaugggggcgaacuuccgcgccgaccgggucaucgacccccgccggugccugaagccggugauccugaaggacggccccgagcgcgugauccucgccgggcccaugcccgucaccguggccuccgccgcgcagcggcgcggccggaucggccgcaaccacaacaaggagggggaccaguacaucuacaugggccagccgcugaacaacgacgaggaccacgcccacuggacggaggccaagaugcugcucgacaacaucaacacccccgaggggaucauccccgcccuguucgagcccgagcgggagaaguccgccgcgaucgacggcgaguaccgccugcgcggggaggcccggaagaccuucgucgagcucaugcgccggggcgaccugccgguguggcugagcuacaagguggccuccgagggcuuccaguacagcgaccgccgguggugcuucgacggggagcgcaacaaccagguccucgaggagaacauggacguggagaucuggaccaaggagggcgagcggaagaagcugcgcccccgguggcuggacgcccgcacguacuccgacccccucgcccugcgggaguucaaggaguucgcggccgggcgccggagcguguccggcgaccugauccucgagaucggcaagcugccccagcaccugacccagcgcgcccagaacgcccucgacaaccuggucaugcugcacaacagcgagcagggcgggcgggcguaccgccacgccauggaggagcucccggacaccaucgagacccugaugcugcucgcccugaucgccgugcugaccgggggcgugacccucuucuuccuguccgggcggggccugggcaagaccagcaucgggcuccugugcgucauggccuccagcgugcugcucuggauggcguccguggagccccacuggaucgccgccagcaucauccuggaguucuuccugaugguccuccugauccccgagcccgaccgccagcggaccccgcaggacaaccagcuggccuacguggugaucggccuccuguucaugauccugaccgucgccgcgaacgagauggggcuccuggagacgaccaagaaggaccugggcaucgggcacguggccguggagaaccaccaccacgccgccaugcucgacgucgaccugcaccccgccuccgcguggacccuguacgccguggccaccacgaucaucacccccaugaugcgccacaccaucgagaacaccacggccaacaucagccucaccgccaucgcgaaccaggccgccauccugaugggccuggacaagggcuggccgaucuccaagauggacaucggggugccccuccuggcccugggcugcuacagccaggucaacccccucacccugaccgcggccgugcugaugcucguggcccacuacgccaucaucgggcccggccugcaggccaaggcgacgcgggaggcccagaagcgcaccgccgccgggaucaugaagaacccgaccgucgacggcaucguggccaucgaccuggaccccguggucuacgacgcgaaguucgagaagcagcucggccagaucaugcugcugauccucugcaccucccagauccugcugaugcgcacgaccugggcccucugcgagagcaucacccuggccaccgggccccugacgacccucugggagggcucccccgggaaguucuggaacaccaccaucgccgugagcauggccaacaucuuccggggcagcuaccuggcgggcgccgggcuggccuucucccucaugaagucccugggcgggggccgccgggggacgggcgcccagggcgagacccugggggagaaguggaagcgccagcucaaccagcuguccaagagcgaguucaacaccuacaagcgguccggcaucauggagguggaccgcagcgaggcgaaggaggggcugaagcggggcgagaccacgaagcacgccgucucccgcgggaccgccaagcuccggugguucguggagcgcaaccuggugaagccggagggcaaggucaucgaccugggcugcgggcggggcggguggagcuacuacugcgccggccugaagaaggugaccgaggugaagggguacaccaagggcggccccgggcacgaggagcccauccccauggccacguacggcuggaaccucgucaagcugcacuccgggaaggacguguucuucaucccgcccgagaagugcgacacccugcucugcgacaucggcgagagcucccccaaccccaccaucgaggaggggcgcacccugcgggugcugaagauggucgagccguggcuccgcggcaaccaguucugcaucaagauccugaaccccuacaugcccagcgugguggagacgcuggagcagaugcagcggcgccacggcgggaugcucguccggaacccccugucccgcaacagcacccacgagauguacuggguguccugcggcaccgggaacaucgugagcgcggucaacaugaccucccggaugcugcucaaccgcuucaccauggcccaccgcaagccgacguacgagcgggacguggaccugggcgccggcacccgccacguggccgucgagcccgagguggccaaccuggacaucaucgggcagcggaucgagaacaucaagcacgagcacaagagcaccuggcacuacgacgaggacaaccccuacaagaccugggcguaccacggcuccuacgaggugaagcccagcgggagcgccuccagcauggucaacggcguggucaagcuccugacgaagccgugggacgugauccccauggugacccagaucgccaugaccgacaccacgcccuucgggcagcagcgcgucuucaaggagaagguggacacccggacccccaaggccaagcgcggcaccgcccagaucauggaggugacggcgaaguggcuguggggcuuccucucccggaacaagaagccgcgcaucugcacccgggaggaguucacccgcaagguccggagcaacgccgccaucggggccguguucguggacgagaaccaguggaacuccgcgaaggaggccgucgaggacgagcgcuucugggaccuggugcaccgggagcgcgagcugcacaagcagggcaagugcgcgaccugcguguacaacaugauggggaagcgggagaagaagcucggcgaguucgggaaggccaagggcagccgcgccaucugguacauguggcugggcgcgcgguuccuggaguucgaggcccucggguucaugaacgaggaccacugguucucccgcgagaacagccuguccggcgucgagggggagggccugcacaagcucggguacauccugcgggacaucagcaagauccccggcggcaacauguacgccgacgacacggccgggugggacacccgcaucaccgaggacgaccugcagaacgaggccaagaucaccgacaucauggagcccgagcacgcgcuccuggccaaguccaucuucaagcugacguaccagaacaagguggugcggguccagcgcccggccaagaacggcaccgugauggacgugaucagccgccgggaccagcgcggguccggccaggucggcaccuacgggcucaacaccuucacgaacauggaggcccagcugauccggcagauggagagcgagggcaucuucucccccagcgagcuggagacccccaaccucgccgggcgcgugcuggacuggcuggagaagcacggcguggagcggcucaagcgcauggcgaucuccggggacgacugcgucgugaagcccaucgacgaccgguucgccaccgcccugaccgcccugaacgacaugggcaaggugcgcaaggacaucccgcagugggagcccagcaagggcuggaacgacuggcagcagguccccuucugcagccaccacuuccaccagcucaucaugaaggacgggcgggagaucguggugcccugccgcaaccaggacgagcuggucggccgggcccgcgugucccagggggcgggcuggagccugcgggagacggccugccucgggaaguccuacgcccagauguggcagcugauguacuuccaccgccgggaccugcgccucgccgcgaacgccaucugcagcgccgugccggucgacugggugcccaccucccggaccaccuggagcauccacgcccaccaccaguggaugacgaccgaggacaugcuguccguguggaaccgcgucuggaucgaggagaaccccuggauggaggacaagacccacaucagcuccuggggcgacgugcccuaccugggcaagcgggaggaccaguggugcgggagccucaucggccugaccgcccgcgcgacgugggccaccaacauccagguggccaucaaccagguccgccggcugaucgggaacgagaacuaccucgacuacaugaccuccaugaagcgcuucaagaacgagagcgacccggagggcgcccugugguga

SEQ ID NO: 8567 - RNA, 9879 nt, Artificial Sequence
  derived and/or modified CDS sequence (opt1) from DENV-1__FJ898401__SS-prME
agcgugaccaugcugcucaugcugaugcccaccgcccuggccuuccaccucaccacccgcggcggggagccccacaugaucgugagcaagcaggagcggggcaagagccugcuguucaagaccagcgcgggggugaacaugugcacccucaucgccauggaccugggcgaguucugcgaggacacgaugaccuacaagugcccccgcaucaccgaggccgagcccgacgacguggacugcuggugcaacgccaccgacacgugggugaccuacgggaccugcagccagaccggcgagcaccggcgcgacaagcgguccguggcccuggcgccccacgugggccucgggcuggagacgcgcaccgagaccuggaugagcuccgagggcgccuggaagcagauccagcggguggagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugcccgacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaagaucguccaguacgagaaccugaaguacagcgugaucgugaccguccacaccggcgaccagcaccagguggggaacgaguccacggagcacggcaccaccgcgaccaucacgccccaggcccccagcacggagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccagcggggccuccaccagccaggagaccuggaaccggaaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcauguccuacgucaugugcaccgggagcuucaagcuggagaaggagguggcggagacccagcacggcacggugcucguccagaucaaguacgagggcaccgacgcccccugcaagauccccuucuccacccaggacgagaagggggugacccagaacggccggcugaucacggccaacccgaucgugaccgacaaggagaagcccgucaacaucgaggccgagccgcccuucggggagagcuacaucgugaucggcgcgggcgagaaggcccugaagcuguccugguucaagaaggggagcuccaucggcaagauguucgaggccaccgcccgcggggcccggcgcauggcgauccucggcgacaccgccugggacuucgggagcaucggcggcguguucacguccgucgggaagcuggugcaccagaucuucggcaccgccuacggggugcuguucagcggcgucuccuggaccaugaagaucgggaucggcgugcuccugaccuggcugggccucaacagccgcuccacgagccuguccaugaccugcaucgccguggggcuggucacccucuaccugggcgugauggugcaggccgacagcgggugcgucaucaacuggaagggccgggagcugaagugcgggagcggcaucuucgugaccaacgaggugcacacguggaccgagcaguacaaguuccaggcggacuccccgaagcgccucagcgccgccaucggcaaggccugggaggagggggucugcggcauccgguccgccacccgccuggagaacaucauguggaagcagaucagcaacgagcugaaccacauccuccuggagaacgacaugaaguucaccgugguggucggggacguggcgggcauccuggcccaggggaagaagaugauccggccccagcccauggaguacaaguacuccuggaaguccuggggcaaggccaagaucaucggcgccgacgugcagaacaccacguucaucaucgacgggcccaacaccccggagugccccgacgaccagcgcgcguggaacaucugggaggucgaggacuacggcuucgggaucuucaccaccaacaucuggcucaagcugcgggacuccuacacccaggugugcgaccaccgccugaugagcgccgccaucaaggacuccaaggccgugcacgccgacaugggcuacuggaucgagagcgagaagaacgagaccuggaagcucgcgcgggccuccuucaucgaggucaagaccugcaucuggcccaagagccacacccugugguccaacggcgugcuggagagcgagaugaucauccccaagaucuacgggggcccgaucucccagcacaacuaccgccccggguacuucacgcagaccgccggccccuggcaccucgggaagcuggagcuggacuucgaccucugcgagggcaccaccguggucguggacggccacugcgggaaccggggcccgagccugcgcacgaccaccgugaccgggaagaucauccacgaguggugcugccgguccugcacgcugccgccccugcgcuucaagggcgaggacgggugcugguacggcauggagauccggcccgucaaggagaaggaggagaaccuggucaagagcauggugagcgccggcuccggggaggucgacagcuucucccugggccuccugugcaucagcaucaugaucgaggaggugaugcgcucccgguggagccgcaagaugcugaugaccgggacccucgccguguucuuccugcugaucaugggccagcucaccuggaacgaccugauccggcugugcaucauggucggggcgaacgccuccgaccgcaugggcaugggcacgaccuaccucgcccugauggccaccuucaagaugcgcccgauguucgccguggggcuccuguuccggcgccugaccagccgggaggugcugcuccugacgaucggccugucccucgucgcgagcguggagcugcccaacucccuggaggagcucggggacggccuggccaugggcaucaugauccugaagcuccugaccgacuuccagagccaccagcugugggccacccuccugucccugaccuucaucaagacgaccuucagccuccacuacgccuggaagaccauggcgaugguccuguccaucgugagccuguucccccucugccuguccaccacgagccagaagaccaccuggcugcccgugcuccuggggucccugggcugcaagccgcucaccauguuccugaucgccgagaacaagaucugggggcgcaagagcuggccccugaacgagggcaucauggccgucgggaucgugagcauccuccuguccagccugcucaagaacgacgugccccuggccggcccccugaucgccggcgggaugcucaucgcgugcuacgucaucuccggcagcuccgccgaccugagccuggagaaggccgccgagguguccugggagaaggaggccgagcacagcggggcgucccacaacauccucguggagguccaggacgacggcacgaugaagaucaaggacgaggagcgggacgacacccugaccauccugcucaaggccacccugcuggccgugagcgggguguacccgcucuccauccccgccacccuguucgucuggcacuucuggcagaagaagaagcagcgcagcggcgugcugugggacacgcccagcccgcccgagguggagcgggccguccucgacgacggcaucuaccgcaucaugcagcgggggcugcugggccgcagccaggugggggugggcgucuuccaggagaacguguuccacaccauguggcacgugacccgcggggccguccugauguaccagggcaagcgccucgagcccuccugggccagcgugaagaaggaccugaucuccuacggcgggggcuggcggcugcaggggagcuggaacaccggcgaggaggugcaggucaucgccguggagcccgggaagaaccccaagaacgugcagacggcccccggcaccuucaagaccuccgagggcgaggucggggccaucgcgcucgacuucaagcccggcaccagcgggagccccaucgugaaccgcgagggcaagaucgugggccuguacgggaacggcgucgugacgaccuccgggaccuacgugagcgccaucgcccaggccaaggcgucccaggagggcccccugccggagaucgaggacgaggucuuccggaagcgcaaccucaccaucauggaccugcaccccgggagcggcaagacgcggcgcuaccugcccgccaucgugcgggaggccaucaagcgcaagcuccggacccugauccuggccccgacccgcguggucgccuccgagauggcggaggcccucaagggcaugcccauccgcuaccagaccacggccgucaagagcgagcacaccgggaaggagaucguggaccugaugugccacgccaccuucaccaugcggcugcucucccccguccgcgugcccaacuacaacaugaucaucauggacgaggcccacuucacggacccgagcuccaucgcggcccggggcuacaucagcacccgcguggggaugggcgaggccgccgccaucuucaugaccgcgacgccgcccggguccgucgaggccuucccccagagcaacgccgugauccaggacgaggagcgggacaucccggagcgcuccuggaacagcggcuacgaguggaucacggacuuccccggcaagaccgugugguucguccccuccaucaagagcgggaacgacaucgccaacugccugcggaagaacggcaagcgcgugauccagcugucccggaagaccuucgacaccgaguaccagaagacgaagaacaacgacugggacuacguggucaccaccgacaucagcgagaugggggcgaacuuccgcgccgaccgggugaucgacccccgccggugccucaagccggugauccugaaggacggccccgagcgcgucauccuggccgggcccaugcccgugaccgucgccuccgccgcgcagcggcgcggccggaucggccgcaaccacaacaaggagggggaccaguacaucuacaugggccagccgcucaacaacgacgaggaccacgcccacuggacggaggccaagaugcugcuggacaacaucaacacccccgaggggaucauccccgcccucuucgagcccgagcgggagaaguccgccgcgaucgacggcgaguaccgccugcgcggggaggcccggaagaccuucguggagcugaugcgccggggcgaccucccgguguggcugagcuacaaggucgccuccgagggcuuccaguacagcgaccgccgguggugcuucgacggggagcgcaacaaccaggugcuggaggagaacauggacguggagaucuggaccaaggagggcgagcggaagaagcuccgcccccgguggcuggacgcccgcacguacuccgacccccuggcccuccgggaguucaaggaguucgcggccgggcgccggagcgucuccggcgaccugauccuggagaucggcaagcucccccagcaccugacccagcgcgcccagaacgcccuggacaaccucgugaugcugcacaacagcgagcagggcgggcgggcguaccgccacgccauggaggagcugccggacaccaucgagacccucaugcugcuggcccucaucgccgugcugaccgggggcgucacgcuguucuuccucuccgggcggggccugggcaagaccagcaucgggcugcucugcgugauggccuccagcgugcugcuguggauggcguccgucgagccccacuggaucgccgccagcaucauccucgaguucuuccugauggugcugcucauccccgagcccgaccgccagcggaccccgcaggacaaccagcuggccuacguggucaucggccuccucuucaugauccugaccguggccgcgaacgagauggggcugcucgagacgaccaagaaggaccugggcaucgggcacguggccgucgagaaccaccaccacgccgccaugcuggacguggaccuccaccccgccuccgcguggacccuguacgccguggccaccacgaucaucacccccaugaugcgccacaccaucgagaacaccacggccaacaucagccugaccgccaucgcgaaccaggccgccauccucaugggccuggacaagggcuggccgaucuccaagauggacaucggggucccccugcucgcccugggcugcuacagccaggugaacccccugacccucaccgcggccgugcugaugcuggucgcccacuacgccaucaucgggcccggccuccaggccaaggcgacgcgggaggcccagaagcgcaccgccgccgggaucaugaagaacccgaccguggacggcaucguggccaucgaccuggaccccgucguguacgacgcgaaguucgagaagcagcugggccagaucaugcuccugauccugugcaccucccagauccuccugaugcgcacgaccugggcccugugcgagagcaucacccucgccaccgggccccugacgacccugugggagggcucccccgggaaguucuggaacaccaccaucgccgugagcauggccaacaucuuccggggcagcuaccucgcgggcgccgggcuggccuucucccugaugaagucccucggcgggggccgccgggggacgggcgcccacggcgagacccugggggagaaguggaagcgccagcugaaccagcucuccaagagcgaguucaacaccuacaagcgguccggcaucauggaggucgaccgcagcgaggcgaaggaggggcugaagcggggcgagaccacgaagcacgccgugucccgcgggaccgccaagcugcggugguucguggagcgcaaccucgucaagccggagggcaaggugaucgaccugggcugcgggcggggcggguggagcuacuacugcgccggccugaagaaggugaccgaggucaagggguacaccaagggcggccccgggcacgaggagcccauccccauggccacguacggcuggaaccuggugaagcuccacuccgggaaggacguguucuucaucccgcccgagaagugcgacacccugcugugcgacaucggcgagagcucccccaaccccaccaucgaggaggggcgcacccuccggguccugaagaugguggagccguggcugcgcggcaaccaguucugcaucaagauccucaaccccuacaugcccagcguggucgagacgcuggagcagaugcagcggaagcacggcgggaugcuggugcgcaacccccucucccggaacagcacccacgagauguacuggguguccugcggcaccgggaacaucgucagcgcggugaacaugaccucccgcaugcugcugaaccgguucaccauggcccaccgcaagccgacguacgagcgcgacguggaccucggcgccggcacccggcacgucgccguggagcccgagguggccaaccuggacaucaucgggcagcgcaucgagaacaucaagcacgagcacaagagcaccuggcacuacgacgaggacaaccccuacaagaccugggcguaccacggcuccuacgaggucaagcccagcgggagcgccuccagcauggugaacggcgucgugaagcugcucacgaagccgugggacgugauccccauggucacccagaucgccaugaccgacaccacgcccuucgggcagcagcggguguucaaggagaagguggacacccgcacccccaaggccaagcggggcaccgcccagaucauggaggucacggcgaaguggcuguggggcuuccugucccgcaacaagaagccgcggaucugcacccgcgaggaguucacccggaaggugcgcagcaacgccgccaucggggccguguucgucgacgagaaccaguggaacuccgcgaaggaggccguggaggacgagcgguucugggaccucgugcaccgcgagcgggagcugcacaagcagggcaagugcgcgaccugcgucuacaacaugauggggaagcgcgagaagaagcugggcgaguucgggaaggccaagggcagccgggccaucugguacauguggcucggcgcgcgcuuccuggaguucgaggcccugggguucaugaacgaggaccacugguucucccgggagaacagccucuccggcguggagggggagggccugcacaagcugggguacauccuccgcgacaucagcaagauccccggcggcaacauguacgccgacgacacggccgggugggacacccggaucaccgaggacgaccugcagaacgaggccaagaucaccgacaucauggagcccgagcacgcgcugcucgccaaguccaucuucaagcugacguaccagaacaaggugguccgcgugcagcggccggccaagaacggcaccgugauggacgucaucagccgccgcgaccagcggggguccggccaggugggcaccuacgggcugaacaccuucacgaacauggaggcccagcucauccgccagauggagagcgagggcaucuucucccccagcgagcuggagacccccaaccuggccgggcgggugcucgacuggcuggagaagcacggcgucgagcgccugaagcggauggcgaucuccggggacgacugcguggugaagcccaucgacgaccgcuucgccaccgcccucaccgcccugaacgacaugggcaagguccggaaggacaucccgcagugggagcccagcaagggcuggaacgacuggcagcagguccccuucugcagccaccacuuccaccagcugaucaugaaggacgggcgcgagaucgugguccccugccggaaccaggacgagcucgugggccgcgcccgggugucccagggggcgggcuggagccugcgcgagacggccugccuggggaaguccuacgcccagauguggcagcucauguacuuccaccggcgcgaccugcggcuggccgcgaacgccaucugcagcgccgucccgguggacugggugcccaccucccgcaccaccuggagcauccacgcccaccaccaguggaugacgaccgaggacaugcucuccgucuggaaccggguguggaucgaggagaaccccuggauggaggacaagacccacaucagcuccuggggcgacgugcccuaccugggcaagcgcgaggaccaguggugcgggagccugaucggccucaccgcccgggcgacgugggccaccaacauccaggucgccaucaaccaggugcgccgccugaucgggaacgagaacuaccuggacuacaugaccuccaugaagcgguucaagaacgagagcgacccggagggcgcccucugguga

SEQ ID NO: 8568 - RNA, 9879 nt, Artificial Sequence
  derived and/or modified CDS sequence (opt1) from DENV-1__FJ898402__SS-prME
agcgugaccaugcugcucaugcugaugcccaccgcccuggccuuccaccucacgacccggggcggggagccccacaugaucgugagcaagcaggagcggggcaagagccugcuguucaagaccagcgcgggggugaacaugugcacccucaucgccauggaccugggcgaguucugcgaggacaccaugaccuacaagugcccccgcaucaccgaggccgagcccgacgacguggacugcuggugcaacgccaccgacacgugggugaccuacgggaccugcagccagaccggcgagcaccggcgggacaagcgguccguggcccuggcgccccacgugggccucgggcuggagacgcgcaccgagaccuggaugagcuccgagggcgccuggaagcagauccagcggguggagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugcccgacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaagaucguccaguacgagaaccugaaguacagcgugaucgugaccguccacaccggcgaccagcaccagguggggaacgaguccacggagcacggcaccaccgcgaccaucacgccccaggcccccagcacggagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccagcggggccuccaccagccaggagaccuggaaccggaaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcauguccuacgucaugugcaccgggagcuucaagcuggagaaggagguggcggagacccagcacggcacggugcucguccagaucaaguacgagggcaccgacgcccccugcaagauccccuucuccacccaggacgagaagggggugacccagaacggccggcugaucacggccaacccgaucgugaccgacaaggagaagcccgucaacaucgaggccgagccgcccuucggggagagcuacaucgugaucggcgcgggcgagaaggcccugaagcuguccugguucaagaaggggagcuccaucggcaagauguucgaggccaccgcccgcggggcccggcgcauggcgauccucggcgacaccgccugggacuucgggagcaucggcggcguguucacguccgucgggaagcuggugcaccagaucuucggcaccgccuacggggugcuguucagcggcgucuccuggaccaugaagaucgggaucggcgugcuccugaccuggcugggccucaacagccgcuccacgagccuguccaugaccugcaucgccguggggcuggucacccucuaccugggcgugauggugcaggccgacagcgggugcgucaucaacuggaagggccgggagcugaagugcgggagcggcaucuucgugaccaacgaggugcacacguggaccgagcaguacaaguuccaggcggacuccccgaagcgccucagcgccgccaucggcaaggccugggaggagggggucugcggcauccgguccgccacccgccuggagaacaucauguggaagcagaucagcaacgagcugaacuacauccuccuggagaacgacaugaaguucaccgugguggucggggacguggcgggcauccuggcccaggggaagaagaugauccggccccagcccauggaguacaaguacuccuggaaguccuggggcaaggccaagaucaucggcgccgacgugcagaacaccacguucaucaucgacgggcccaacaccccggagugccccgacgaccagcgcgcguggaacaucugggaggucgaggacuacggcuucgggaucuucaccaccaacaucuggcucaagcugcgggacuccuacacccaggugugcgaccaccgccugaugagcgccgccaucaaggacuccaaggccgugcacgccgacaugggcuacuggaucgagagcgagaagaacgagaccuggaagcucgcgcgggccuccuucaucgaggucaagaccugcaucuggcccaagagccacacccugugguccaacggcgugcuggagagcgagaugaucauccccaagaucuacgggggcccgaucucccagcacaacuaccgccccggguacuucacgcagaccgccggccccuggcaccucgggaagcuggagcuggacuucgaccucugcgagggcaccaccguggucguggacgagcacugcggcaaccgggggccgagccugcgcacgaccaccgugaccggcaagaucauccacgaguggugcugccgguccugcacgcugccgccccugcgcuucaagggggaggacggcugcugguacgggauggagauccggcccgucaaggagaaggaggagaaccuggucaagagcauggugagcgccggcuccggcgaggucgacagcuucucccuggggcuccugugcaucagcaucaugaucgaggaggugaugcgcucccgguggagccgcaagaugcugaugaccggcacccucgccguguucuuccugcugaucauggggcagcucaccuggaacgaccugauccggcugugcaucauggucggcgcgaacgccuccgaccgcauggggaugggcacgaccuaccucgcccugauggccaccuucaagaugcgcccgauguucgccguggggcuccuguuccggcgccugaccagccgggaggugcugcuccugacgaucgggcugucccucgucgcgagcguggagcugcccaacucccuggaggagcucggcgacgggcuggccaugggcaucaugauccugaagcuccugaccgacuuccagagccaccagcugugggccacccuccugucccugaccuucaucaagacgaccuucagccuccacuacgccuggaagaccauggcgaugguccuguccaucgugagccuguucccccucugccuguccaccacgagccagaagaccaccuggcugcccgugcuccugggcucccuggggugcaagccgcucaccauguuccugaucgccgagaacaagaucuggggccgcaagagcuggccccugaacgaggggaucauggccgucggcaucgugagcauccuccuguccagccugcucaagaacgacgugccccuggccgggccccugaucgccggcggcaugcucaucgcgugcuacgucaucuccgggagcuccgccgaccugagccuggagaaggccgccgagguguccugggaggaggaggccgagcacagcggcgcgucccacaacauccucguggagguccaggacgacgggacgaugaagaucaaggacgaggagcgggacgacacccugaccauccugcucaaggccacccugcuggccgugagcggcguguacccgcucuccauccccgccacccuguucgucugguacuucuggcagaagaagaagcagcgcagcggggugcugugggacacgcccagcccgcccgagguggagcgggccguccucgacgacggcaucuaccgcaucaugcagcggggccugcuggggcgcagccaggugggcgugggggucuuccaggagaacguguuccacaccauguggcacgugacccggggcgcgguccugauguaccaggggaagcgccucgagcccuccugggccagcgugaagaaggaccugaucuccuacggcggcggguggcggcugcagggcagcuggaacaccggggaggaggugcaggucaucgccguggagcccggcaagaaccccaagaacgugcagacggcccccgggaccuucaagaccuccgagggcgaggucggcgccaucgcgcucgacuucaagcccgggaccagcggcagccccaucgugaaccgcgaggggaagaucgugggccuguacggcaacggggucgugacgaccuccggcaccuacgugagcgccaucgcccaggccaaggcgucccaggaggggccccugccggagaucgaggacgaggucuuccggaagcgcaaccucaccaucauggaccugcaccccggcagcgggaagacgcggcgcuaccugcccgccaucgugcgggaggccaucaagcgcaagcuccggacccugauccuggccccgacccgcguggucgccuccgagauggcggaggcccucaagggcaugcccauccgcuaccagaccacggccgucaagagcgagcacaccggcaaggagaucguggaccugaugugccacgccaccuucaccaugcggcugcucucccccguccgcgugcccaacuacaacaugaucaucauggacgaggcccacuucacggacccgagcuccaucgcggcccggggguacaucagcacccgcgugggcaugggggaggccgccgccaucuucaugaccgcgacgccgcccggcuccgucgaggccuucccccagagcaacgccgugauccaggacgaggagcgggacaucccggagcgcuccuggaacagcggguacgaguggaucacggacuuccccggcaagaccgugugguucguccccuccaucaagagcggcaacgacaucgccaacugccugcggaagaacgggaagcgcgugauccagcugucccggaagaccuucgacaccgaguaccagaagacgaagaacaacgacugggacuacguggucaccaccgacaucagcgagaugggcgcgaacuuccgcgccgaccgggugaucgacccccgccggugccucaagccggugauccugaaggacgggcccgagcgcgucauccuggccggccccaugcccgugaccgucgccuccgccgcgcagcggcgcgggcggaucggccgcaaccacaacaaggagggcgaccaguacaucuacauggggcagccgcucaacaacgacgaggaccacgcccacuggacggaggccaagaugcugcuggacaacaucaacacccccgagggcaucauccccgcccucuucgagcccgagcgggagaaguccgccgcgaucgacggggaguaccgccugcgcggcgaggcccggaagaccuucguggagcugaugcgccgcggggaccucccgguguggcugagcuacaaggucgccuccgagggcuuccaguacagcgaccgccgguggugcuucgacggcgagcgcaacaaccaggugcuggaggagaacauggacguggagaucuggaccaaggagggggagcggaagaagcuccgcccccgguggcuggacgcccgcacguacuccgacccccuggcccuccgggaguucaaggaguucgcggccggccgccggagcgucuccggggaccugauccuggagaucggcaagcucccccagcaccugacccagcgcgcccagaacgcccuggacaaccucgugaugcugcacaacagcgagcagggcgggcgggcguaccgccacgccauggaggagcugccggacaccaucgagacccucaugcugcuggcccucaucgccgugcugacgggcggggucacccuguucuuccucuccggccgggggcugggcaagaccagcaucggccugcucugcgugauggccuccagcgugcugcuguggaccgcguccgucgagccccacuggaucgccgccagcaucauccucgaguucuuccugauggugcugcucauccccgagcccgaccgccagcggaccccgcaggacaaccagcuggccuacguggucaucgggcuccucuucaugauccugacgguggccgcgaacgagaugggccugcucgagaccaccaagaaggaccuggggaucggccacguggccgucgagaaccaccaccacgccgccaugcuggacguggaccuccaccccgccuccgcguggacccuguacgccguggccacgaccaucaucacccccaugaugcgccacaccaucgagaacacgaccgccaacaucagccugaccgccaucgcgaaccaggccgccauccucauggggcuggacaagggcuggccgaucuccaagauggacaucggcgucccccugcucgcccuggggugcuacagccaggugaacccccugacccucacggcggccgugcugaugcuggucgcccacuacgccaucaucggccccgggcuccaggccaaggcgacccgggaggcccagaagcgcaccgccgccggcaucaugaagaacccgaccguggacgggaucguggccaucgaccuggaccccgucguguacgacgcgaaguucgagaagcagcugggccagaucaugcuccugauccugugcacgucccagauccuccugaugcgcaccaccugggcccugugcgagagcaucacccucgccacgggcccccugaccacccugugggaggggucccccggcaaguucuggaacaccacgaucgccgugagcauggccaacaucuuccgggggagcuaccucgcgggcgccggccuggccuucucccugaugaagucccucgggggcgggcgccggggcaccggggcccagggcgagacccugggcgagaaguggaagcgccagcugaaccagcucuccaagagcgaguucaacaccuacaagcgguccgggaucauggaggucgaccgcagcgaggcgaaggagggccugaagcgcggggagacgaccaagcacgccgugucccgcggcaccgccaagcugcggugguucguggagcgcaaccucgucaagccggaggggaaggugaucgaccugggcugcggccgcggcggguggagcuacuacugcgccgggcugaagaaggugaccgaggucaagggguacacgaagggcgggcccggccacgaggagcccauccccauggccaccuacggguggaaccuggugaagcuccacuccggcaaggacguguucuucaucccgcccgagaagugcgacacccugcugugcgacaucggggagagcucccccaaccccaccaucgaggagggccgcacgcuccggguccugaagaugguggagccguggcugcgcgggaaccaguucugcaucaagauccucaaccccuacaugcccagcguggucgagacccuggagcagaugcagcggaagcacggcggcaugcuggugcgcaacccccucucccggaacagcacccacgagauguacuggguguccugcgggaccggcaacaucgucagcgcggugaacaugaccucccgcaugcugcugaaccgguucacgauggcccaccgcaagccgaccuacgagcgcgacguggaccucggggccggcacccggcacgucgccguggagcccgagguggccaaccuggacaucaucggccagcgcaucgagaacaucaagcacgagcacaagagcaccuggcacuacgacgaggacaaccccuacaagacgugggcguaccacggguccuacgaggucaagcccagcggcagcgccuccagcauggugaacggggucgugaagcugcucaccaagccgugggacgugauccccauggucacccagaucgccaugaccgacacgacccccuucggccagcagcggguguucaaggagaagguggacacccgcacccccaaggccaagcgggggacggcccagaucauggaggucaccgcgaaguggcuguggggcuuccugucccgcaacaagaagccgcggaucugcacccgcgaggaguucacccggaaggugcgcagcaacgccgccaucggcgccguguucgucgacgagaaccaguggaacuccgcgaaggaggccguggaggacgagcgguucugggaccucgugcaccgcgagcgggagcugcacaagcaggggaagugcgccacgugcgucuacaacaugaugggcaagcgcgagaagaagcugggggaguucggcaaggccaaggggagccgggccaucugguacauguggcucggcgcgcgcuuccuggaguucgaggcccugggcuucaugaacgaggaccacugguucucccgggagaacagccucuccgggguggagggcgaggggcugcacaagcugggcuacauccuccgcgacaucagcaagauccccgggggcaacauguacgccgacgacaccgccggcugggacacccggaucaccgaggacgaccugcagaacgaggccaagaucacggacaucauggagcccgagcacgcgcugcucgccaaguccaucuucaagcugaccuaccagaacaaggugguccgcgugcagcggccggccaagaacgggaccgugauggacgucaucagccgccgcgaccagcggggcuccggccaggugggcaccuacggccugaacacguucaccaacauggaggcccagcucauccgccagauggagagcgaggggaucuucucccccagcgagcuggagacccccaaccuggccggccgggugcucgacuggcuggagaagcacggggucgagcgccugaagcggauggcgaucuccggcgacgacugcguggugaagcccaucgacgaccgcuucgccaccgcccucacggcccugaacgacauggggaagguccggaaggacaucccgcagugggagcccagcaagggcuggaacgacuggcagcagguccccuucugcagccaccacuuccaccagcugaucaugaaggacggccgcgagaucgugguccccugccggaaccaggacgagcucguggggcgcgcccgggugucccagggcgcgggguggagccugcgcgagaccgccugccugggcaaguccuacgcccagauguggcagcucauguacuuccaccggcgcgaccugcggcuggccgcgaacgccaucugcagcgccgucccgguggacugggugcccaccucccgcaccacguggagcauccacgcccaccaccaguggaugaccaccgaggacaugcucuccgucuggaaccggguguggaucgaggagaaccccuggauggaggacaagacccacaucagcuccuggggcgacgugcccuaccugggcaagcgcgaggaccaguggugcggcagccugaucgggcucacggcccgggcgaccugggccaccaacauccaggucgccaucaaccaggugcgccgccugaucggcaacgagaacuaccuggacuacaugaccuccaugaagcgguucaagaacgagagcgacccggagggggcccucugguga

SEQ ID NO: 8569 - RNA, 9879 nt, Artificial Sequence
  derived and/or modified CDS sequence (opt1) from DENV-1__FJ898403__SS-prME
agcgugaccaugcugcucaugcugaugcccaccgcccuggccuuccaccucacgacccggggcggggagccccacaugaucgugagcaagcaggagcggggcaagagccugcuguucaagaccagcgccggggugaacaugugcacccucaucgccauggaccugggcgaguucugcgaggacaccaugaccuacaagugcccccgcaucaccgaggccgagcccgacgacguggacugcuggugcaacgccaccgacacgugggugaccuacgggaccugcagccagaccggcgagcaccggcgggacaagcgguccguggcccuggcgccccacgugggccucgggcuggagacgcgcaccgagaccuggaugagcuccgagggcgccuggaagcagauccagcggguggagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugcccgacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaagaucguccaguacgagaaccugaaguacagcgugaucgugaccguccacaccggcgaccagcaccagguggggaacgaguccacggagcacggcaccaccgcgaccaucacgccccaggcccccagcacggagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccagcggggccuccaccagccaggagaccuggaaccggaaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcauguccuacgucaugugcaccgggagcuucaagcuggagaaggagguggcggagacccagcacggcacggugcucguccagaucaaguacgagggcaccgacgcccccugcaagauccccuucuccacccaggacgagaagggggugacccagaacggccggcugaucacggccaacccgaucgugaccgacaaggagaagcccgucaacaucgaggccgagccgcccuucggggagagcuacaucgugaucggcgcgggcgagaaggcccugaagcuguccugguucaagaaggggagcuccaucggcaagauguucgaggccaccgcccgcggggcccggcgcauggcgauccucggcgacaccgccugggacuucgggagcaucggcggcguguucacguccgucgggaagcuggugcaccagaucuucggcaccgccuacggggugcuguucagcggcgucuccuggaccaugaagaucgggaucggcgugcuccugaccuggcugggccucaacagccgcuccacgagccuguccaugaccugcaucgccguggggcuggucacccucuaccugggcgugauggugcaggccgacagcgggugcgucaucaacuggaagggccgggagcugaagugcgggagcggcaucuucgugaccaacgaggugcacacguggaccgagcaguacaaguuccaggcggacuccccgaagcgccucagcgccgccaucggcaaggccugggaggagggggucugcggcauccgguccgccacccgccuggagaacaucauguggaagcagaucagcaacgagcugaaccacauccuccuggagaacgacaugaaguucaccgugguggucggggacguggcgggcauccuggcccaggggaagaagaugauccggccccagcccauggaguacaaguacuccuggaaguccuggggcaaggccaagaucaucggcgccgacgugcagaacaccacguucaucaucgacgggcccaacaccccggagugccccgacgaccagcgcgcguggaacaucugggaggucgaggacuacggcuucgggaucuucaccaccaacaucuggcucaagcugcgggacuccuacacccaggugugcgaccaccgccugaugagcgccgccaucaaggacuccaaggccgugcacgccgacaugggcuacuggaucgagagcgagaagaacgagaccuggaagcucgcgcgggccuccuucaucgaggucaagaccugcaucuggcccaagagccacacccugugguccaacggcgugcuggagagcgagaugaucauccccaagaucuacgggggcccgaucucccagcacaacuaccgccccggguacuucacgcagaccgccggccccuggcaccucgggaagcuggagcuggacuucgaccucugcgagggcaccaccguggucguggacgagcacugcggcaaccgggggccgagccugcgcacgaccaccgugaccggcaagaucauccacgaguggugcugccgguccugcacgcugccgccccugcgcuucaagggggaggacggcugcugguacgggauggagauccggcccgucaaggagaaggaggagaaccuggucaagagcauggugagcgccggcuccggcgaggucgacagcuucucccuggggcuccugugcaucagcaucaugaucgaggaggugaugcgcucccgguggagccgcaagaugcugaugaccggcacccucgccguguucuuccugcugaucauggggcagcucaccuggaacgaccugauccggcugugcaucauggucggcgcgaacgccuccgaccgcauggggaugggcacgaccuaccucgcccugauggccaccuucaagaugcgcccgauguucgccguggggcuccuguuccggcgccugaccagccgggaggugcugcuccugacgaucgggcugucccucgucgcgagcguggagcugcccaacucccuggaggagcucggcgacgggcuggccaugggcaucaugauccugaagcuccugaccgacuuccagagccaccagcugugggccacccuccugucccugaccuucaucaagacgaccuucagccuccacuacgccuggaagaccauggcgaugguccuguccaucgugagccuguucccccucugccuguccaccacgagccagaagaccaccuggcugcccgugcuccugggcucccuggggugcaagccgcucaccauguuccugaucgccgagaacaagaucuggggccgcaagagcuggccccugaacgaggggaucauggccgucggcaucgugagcauccuccuguccagccugcucaagaacgacgugccccuggccgggccccugaucgccggcggcaugcucaucgcgugcuacgucaucuccgggagcuccgccgaccugagccuggagaaggccgccgagguguccugggaggaggaggccgagcacagcggcgcgucccacaacauccucguggagguccaggacgacgggacgaugaagaucaaggacgaggagcgggacgacacccugaccauccugcucaaggccacccugcuggccgugagcggcguguacccgcucuccauccccgccacccuguucgucugguacuucuggcagaagaagaagcagcgcagcggggugcugugggacacgcccagcccgcccgagguggagcgggccguccucgacgacggcaucuaccgcaucaugcagcggggccugcuggggcgcagccaggugggcgugggggucuuccaggagaacguguuccacaccauguggcacgugacccggggcgcgguccugauguaccaggggaagcgccucgagcccuccugggccagcgugaagaaggaccugaucuccuacggcggcggguggcggcugcagggcagcuggaacaccggggaggaggugcaggucaucgccguggagcccggcaagaaccccaagaacgugcagacggcccccgggaccuucaagaccuccgagggcgaggucggcgccaucgcgcucgacuucaagcccgggaccagcggcagccccaucgugaaccgcgaggggaagaucgugggccuguacggcaacggggucgugacgaccuccggcaccuacgugagcgccaucgcccaggccaaggcgucccaggaggggccccugccggagaucgaggacgaggucuuccggaagcgcaaccucaccaucauggaccugcaccccggcagcgggaagacgcggcgcuaccugcccgccaucgugcgggaggccaucaagcgcaagcuccggacccugauccuggccccgacccgcguggucgccuccgagauggcggaggcccucaagggcaugcccauccgcuaccagaccacggccgucaagagcgagcacaccggcaaggagaucguggaccugaugugccacgccaccuucaccaugcggcugcucucccccguccgcgugcccaacuacaacaugaucaucauggacgaggcccacuucacggacccgagcuccaucgcggcccggggguacaucagcacccgcgugggcaugggggaggccgccgccaucuucaugaccgcgacgccgcccggcuccgucgaggccuucccccagagcaacgccgugauccaggacgaggagcgggacaucccggagcgcuccuggaacagcggguacgaguggaucacggacuuccccggcaagaccgugugguucguccccuccaucaagagcggcaacgacaucgccaacugccugcggaagaacgggaagcgcgugauccagcugucccggaagaccuucgacaccgaguaccagaagacgaagaacaacgacugggacuacguggucaccaccgacaucagcgagaugggcgcgaacuuccgcgccgaccgggugaucgacccccgccggugccucaagccggugauccugaaggacgggcccgagcgcgucauccuggccggccccaugcccgugaccgucgccuccgccgcgcagcggcgcgggcggaucggccgcaaccacaacaaggagggcgaccaguacaucuacauggggcagccgcucaacaacgacgaggaccacgcccacuggacggaggccaagaugcugcuggacaacaucaacacccccgagggcaucauccccgcccucuucgagcccgagcgggagaaguccgccgcgaucgacggggaguaccgccugcgcggcgaggcccggaagaccuucguggagcugaugcgccgcggggaccucccgguguggcugagcuacaaggucgccuccgagggcuuccaguacagcgaccgccgguggugcuucgacggcgagcgcaacaaccaggugcuggaggagaacauggacguggagaucuggaccaaggagggggagcggaagaagcuccgcccccgguggcuggacgcccgcacguacuccgacccccuggcccuccgggaguucaaggaguucgcggccggccgccggagcgucuccggggaccugauccuggagaucggcaagcucccccagcaccugacccagcgcgcccagaacgcccuggacaaccucgugaugcugcacaacagcgagcagggcgggcgggcguaccgccacgccauggaggagcugccggacaccaucgagacccucaugcugcuggcccucaucgccgugcugacgggcggggucacccuguucuuccucuccggccgggggcugggcaagaccagcaucggccugcucugcgugauggccuccagcgugcugcuguggauggcguccgucgagccccacuggaucgccgccagcaucauccucgaguucuuccugauggugcugcucauccccgagcccgaccgccagcggaccccgcaggacaaccagcuggccuacguggucaucgggcuccucuucaugauccugaccguggccgcgaacgagaugggccugcucgagacgaccaagaaggaccuggggaucggccacguggccgucgagaaccaccaccacgccgccaugcuggacguggaccuccaccccgccuccgcguggacccuguacgccguggccaccacgaucaucacccccaugaugcgccacaccaucgagaacaccacggccaacaucagccugaccgccaucgcgaaccaggccgccauccucauggggcuggacaagggcuggccgaucuccaagauggacaucggcgucccccugcucgcccuggggugcuacagccaggugaacccccugacccucaccgcggccgugcugaugcuggucgcccacuacgccaucaucggccccgggcuccaggccaaggcgacgcgggaggcccagaagcgcaccgccgccggcaucaugaagaacccgaccguggacgggaucguggccaucgaccuggaccccgucguguacgacgcgaaguucgagaagcagcugggccagaucaugcuccugauccugugcaccucccagauccuccugaugcgcacgaccugggcccugugcgagagcaucacccucgccaccggcccccugacgacccugugggaggggucccccggcaaguucuggaacaccaccaucgccgugagcauggccaacaucuuccgggggagcuaccucgcgggcgccggccuggccuucucccugaugaagucccucgggggcgggcgccggggcacgggggcccagggcgagacccugggcgagaaguggaagcgccagcugaaccagcucuccaagagcgaguucaacaccuacaagcgguccgggaucauggaggucgaccgcagcgaggcgaaggagggccugaagcgcggggagaccacgaagcacgccgugucccgcggcaccgccaagcugcggugguucguggagcgcaaccucgucaagccggaggggaaggugaucgaccugggcugcggccgcggcggguggagcuacuacugcgccgggcugaagaaggugaccgaggucaagggguacaccaagggcgggcccggccacgaggagcccauccccauggccacguacggguggaaccuggugaagcuccacuccggcaaggacguguucuucaucccgcccgagaagugcgacacccugcugugcgacaucggggagagcucccccaaccccaccaucgaggagggccgcacccuccggguccugaagaugguggagccguggcugcgcgggaaccaguucugcaucaagauccucaaccccuacaugcccagcguggucgagacgcuggagcagaugcagcggaagcacggcggcaugcuggugcgcaacccccucucccggaacagcacccacgagauguacuggguguccugcgggaccggcaacaucgucagcgcggugaacaugaccucccgcaugcugcugaaccgguucaccauggcccaccgcaagccgacguacgagcgcgacguggaccucggggccggcacccggcacgucgccguggagcccgagguggccaaccuggacaucaucggccagcgcaucgagaacaucaagcacgagcacaagagcaccuggcacuacgacgaggacaaccccuacaagaccugggcguaccacggguccuacgaggucaagcccagcggcagcgccuccagcauggugaacggggucgugaagcugcucacgaagccgugggacgugauccccauggucacccagaucgccaugaccgacaccacgcccuucggccagcagcggguguucaaggagaagguggacacccgcacccccaaggccaagcgggggaccgcccagaucauggaggucacggcgaaguggcuguggggcuuccugucccgcaacaagaagccgcggaucugcacccgcgaggaguucacccggaaggugcgcagcaacgccgccaucggcgccguguucgucgacgagaaccaguggaacuccgcgaaggaggccguggaggacgagcgguucugggaccucgugcaccgcgagcgggagcugcacaagcaggggaagugcgcgaccugcgucuacaacaugaugggcaagcgcgagaagaagcugggggaguucggcaaggccaaggggagccgggccaucugguacauguggcucggcgcgcgcuuccuggaguucgaggcccugggcuucaugaacgaggaccacugguucucccgggagaacagccucuccgggguggagggcgaggggcugcacaagcugggcuacauccuccgcgacaucagcaagauccccgggggcaacauguacgccgacgacacggccggcugggacacccggaucaccgaggacgaccugcagaacgaggccaagaucaccgacaucauggagcccgagcacgcgcugcucgccaaguccaucuucaagcugacguaccagaacaaggugguccgcgugcagcggccggccaagaacgggaccgugauggacgucaucagccgccgcgaccagcggggcuccggccaggugggcaccuacggccugaacaccuucacgaacauggaggcccagcucauccgccagauggagagcgaggggaucuucucccccagcgagcuggagacccccaaccuggccggccgggugcucgacuggcuggagaagcacggggucgagcgccugaagcggauggcgaucuccggcgacgacugcguggugaagcccaucgacgaccgcuucgccaccgcccucaccgcccugaacgacauggggaagguccggaaggacgugccgcagugggagcccagcaagggcuggaacgacuggcagcagguccccuucugcagccaccacuuccaccagcugaucaugaaggacggccgcgagaucgucgugcccugccggaaccaggacgagcucguggggcgcgcccgggucucccagggcgcgggguggagccugcgcgagacggccugccugggcaaguccuacgcccagauguggcagcucauguacuuccaccggcgcgaccugcggcuggccgcgaacgccaucugcagcgccgugccgguggacuggguccccaccucccgcaccaccuggagcauccacgcccaccaccaguggaugacgaccgaggacaugcucuccguguggaaccggguguggaucgaggagaaccccuggauggaggacaagacccacaucagcuccuggggcgacguccccuaccugggcaagcgcgaggaccaguggugcggcagccugaucgggcucaccgcccgggcgacgugggccaccaacauccagguggccaucaaccaggugcgccgccugaucggcaacgagaacuaccuggacuacaugaccuccaugaagcgguucaagaacgagagcgacccggagggggcccucugguga

SEQ ID NO: 8570 - RNA, 9879 nt, Artificial Sequence
  derived and/or modified CDS sequence (opt1) from DENV-1__FJ898404__SS-prME
agcgugaccaugcugcucaugcugaugcccaccgcccuggccuuccaccucaccacccggggcggggagccccacaugaucgugaccaagcaggagcggggcaagagccugcuguucaagaccagcgcgggggugaacaugugcacccucaucgccauggaccugggcgagcugugcgaggacaccaugaccuacaagugcccccggaucaccgaggccgagcccgacgacguggacugcuggugcaacgccaccgacaccugggugaccuacgggaccugcagccagacgggcgagcaccggcgcgacaagcggagcguggcccucgcgccccacgugggccuggggcuggagacccgcaccgagaccuggauguccagcgagggcgccuggaagcagauccagcgggucgagacgugggcccuccgccaccccggguucaccgugaucgcccuguuccuggcgcacgccaucggcaccuccaucacccagaaggggaucaucuucauccuccugaugcuggugacgcccagcauggccaugcggugcgucggcaucggcucccgcgacuucguggaggggcucagcggcgccaccuggguggacgucgugcuggagcacggguccugcgugaccaccauggccaaggacaagcccacgcuggacaucgagcuccugaagaccgaggucaccaaccccgcggugcugcggaagcucugcaucgaggccaagaucagcaacaccacgaccgacucccgcugccccacccagggcgaggccacccugauggaggagcaggacgccaacuucgugugccggcgcacguucgucgaccggggcugggggaacggcugcgggcuguucggcaaggggagccucaucacgugcgccaaguucaagugcgugaccaagcuggagggcaagaucgugcaguacgagaaccugaaguacuccgucaucgugaccgugcacacgggcgaccagcaccaggucgggaacgagagcaccgagcacggcaccaccgcgaccaucacgccccaggcccccaccuccgagauccagcucaccgacuacggggcccugacccuggacugcagcccccgcacgggccucgacuucaacgagauggugcugcugaccaugaaggagaaguccuggcucguccacaagcagugguuccuggaccugccgcuccccuggaccagcggggccagcaccucccaggagacguggaaccggcaggaccugcuggugaccuucaagaccgcccacgcgaagaagcaggagguggucgugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgugaugugcaccggguccuucaagcucgagaaggaggucgcggagacgcagcacggcaccgugcuggugcagaucaaguacgagggcaccgacgcccccugcaagauccccuucagcacccaggacgagaagggggucacgcagaacggccggcugaucaccgccaacccgaucgugaccgacaaggagaagcccgugaacaucgaggccgagccgcccuucggggaguccuacaucgucaucggcgcgggcgagaaggcccugaagcucagcugguucaagaagggguccagcaucggcaagauguucgaggccaccgcccgcggggcccggcgcauggcgauccugggcgacacggccugggacuucggguccgugggcggcguguucaccagcgucgggaagcuggugcaccagaucuucggcaccgccuacgggguccuguucuccggcgucagcuggaccaugaagaucgggaucggcgugcugcugacguggcucggccugaacucccgcagcaccucccugagcaugaccugcaucgccguggggcucgucacccuguaccugggcgugauggugcaggccgacuccgggugcgucaucaacuggaagggccgggagcucaagugcgggagcggcaucuucgugacgaacgaggugcacaccuggaccgagcaguacaaguuccaggcggacagcccgaagcgccuguccgccgccaucggcaaggccugggaggagggggucugcggcauccggagcgccacccgccuggagaacaucauguggaagcagaucuccaacgagcucaaccacauccugcuggagaacgacaugaaguucaccgugguggucggggacguggugggcauccucgcgcaggggaagaagaugauccggccccagcccauggagcacaaguacagcuggaaguccuggggcaaggccaagaucaucggcgccgacguccagaacacgaccuucaucaucgacgggcccaacaccccggagugccccgacgaccagcgcgccuggaacaucugggagguggaggacuacggcuucgggaucuucaccacgaacaucuggcugaagcugcgggacagcuacacccaggugugcgaccaccgccucauguccgcggccaucaaggacagcaaggccguccacgccgacaugggcuacuggaucgaguccgagaagaacgagaccuggaagcuggcccgggcgagcuucaucgaggugaagaccugcaucuggcccaagucccacacgcuguggagcaacggcgugcucgaguccgagaugaucauccccaagaucuacgggggcccgaucagccagcacaacuaccgccccggguacuucacccagaccgccggccccuggcaccuggggaagcuggagcucgacuucgaccugugcgagggcaccacggucgugguggacgagcacugcggcaaccgggggccgucccugcgcaccaccaccgucacgggcaagaucauccacgaguggugcugccggagcugcacccugccgccccuccgcuucaagggggaggacggcugcugguacgggauggagauccggcccgugaaggagaaggaggagaaccuggugaaguccauggucagcgccggcagcggcgagguggacuccuucagccucgggcugcugugcaucuccaucaugaucgaggaggugaugcgcagccgguggucccgcaagaugcucaugaccggcacccuggccgucuuccugcuccugaucauggggcagcugacguggaacgaccucauccggcugugcaucauggugggcgccaacgcgagcgaccgcauggggaugggcaccaccuaccuggcccucauggccaccuucaagaugcgcccgauguucgccguggggcugcuguuccggcgccucacgucccgggagguccugcugcucaccaucgggcugagccugguggccuccgucgagcuccccaacagccuggaggagcugggcgacgggcucgcgaugggcaucaugauccugaagcugcucaccgacuuccagucccaccagcugugggccacccugcucagccugacguucaucaagaccacccugucccuccacuacgccuggaagaccauggccauggugcugagcaucgcgucccuguucccccucugccugagcacgaccucccagaagaccaccuggcugcccgugcuccugggcagccuggggugcaagccgcucacgauguuccugaucaccgagaccaagaucuggggccgcaaguccuggccccugaacgaggggaucauggccgucggcguggugagcauccuccugagcucccugcucaagaacgacgucccccuggccgggccccugaucgccggcggcaugcucaucgccugcuacgugaucagcggguccagcgcggaccugucccuggagaaggccgccgaggugagcugggaggaggaggccgagcacuccggcgccagccacaacauccucgucguggugcaggacgacgggaccaugaagaucaaggacgaggagcgggacgacacccugacgauccugcucaaggcgacccugcuggccgucuccggcguguacccgcucagcauccccgccacccuguucgugugguacuucuggcagaagaagaagcagcgcuccgggguccugugggacacccccagcccgcccgagguggagcgggccgugcuggacgacggcaucuaccgcaucaugcagcggggccuccuggggcgcucccaggucggcguggggguguuccaggagaacgucuuccacacgauguggcacgugacccggggcgccgugcugauguaccaggggaagcgccucgagcccagcugggcguccgucaagaaggaccugaucagcuacggcggcggguggcggcugcagggcuccuggaacaccggggaggagguccaggugaucgccgucgagcccggcaagaaccccaagaacgugcagaccgcccccgggacguucaagacccccgagggcgaggugggcgccaucgcccucgacuucaagcccgggaccagcggcucccccaucgucaaccgcgaggggaagaucgugggccuguacggcaacgggguggucaccacgagcggcaccuacgugagcgcgaucgcccaggccaaggccucccaggaggggccgcugcccgagaucgaggacgagguguuccggaagcgcaaccucaccaucauggaccugcaccccggcagcgggaagacccggcgcuaccugccggcgaucguccgggaggccaucaagcgcaagcuccggacgcugauccuggcccccacccgcgugguggccuccgagauggccgaggcgcucaagggcaugcccauccgcuaccagaccaccgccgucaagagcgagcacacgggcaaggagaucguggaccugaugugccacgccaccuucaccaugcggcugcucucccccgugcgcgucccgaacuacaacaugaucaucauggacgaggcccacuucaccgaccccagcuccaucgccgcgcggggguacaucagcacgcgcgugggcaugggggaggccgccgccaucuucaugaccgccacgccgcccggcuccguggaggcguucccgcagagcaacgccgucauccaggacgaggagcgggacauccccgagcgcuccuggaacagcggguacgaguggaucaccgacuuccccggcaagacggugugguucgugcccuccaucaagagcggcaacgacaucgccaacugccugcggaagaacgggaagcgcgucauccagcugucccggaagaccuucgacaccgaguaccagaagaccaagaacaacgacugggacuacguggugacgaccgacaucagcgagaugggcgccaacuuccgcgcggaccgggucaucgacccgcgccggugccucaagcccgugauccugaaggacgggcccgagcgcgucauccuggccggccccaugccggugaccguggccuccgccgcccagcggcgcgggcggaucggccgcaaccacaacaaggagggcgaccaguacaucuacauggggcagccccucaacaacgacgaggaccacgcgcacuggaccgaggccaagaugcugcuggacaacaucaacacgcccgagggcaucauccccgcccucuucgagccggagcgggagaaguccgccgccaucgacggggaguaccgccugcgcggcgaggcgcggaagaccuucgucgagcugaugcgccgcggggaccuccccguguggcuguccuacaagguggccagcgagggcuuccaguacagcgaccgccgguggugcuucgacggcgagcgcaacaaccagguccuggaggagaacauggacguggagaucuggaccaaggagggggagcggaagaagcuccgcccccgguggcuggacgcccgcaccuacuccgacccccuggcccuccgggaguucaaggaguucgccgcgggccgccggagcguguccggggaccugauccuggagaucggcaagcucccgcagcaccugacgcagcgcgcccagaacgcccuggacaaccucgucaugcugcacaacagcgagcagggcgggcgggccuaccgccacgcgauggaggagcugcccgacaccaucgagacccucaugcugcuggcccucaucgccgugcugaccggcggggugacccuguucuuccucuccggccgggggcugggcaagacgagcaucggccugcucugcgucauggccuccagcgugcugcuguggauggccuccguggagccccacuggaucgcggccagcaucauccucgaguucuuccugaugguccugcucauccccgagccggaccgccagcggacgccccaggacaaccagcuggccuacguggugaucgggcuccucuucaugauccugaccgucgccgccaacgagaugggccugcucgagaccacgaagaaggaccuggggaucggccacguggcgguggagaaccaccaccacgccaccaugcuggacgucgaccuccaccccgccuccgccuggacccuguacgccguggcgaccacgaucaucaccccgaugaugcgccacaccaucgagaacaccacggccaacaucagccugaccgccaucgccaaccaggccgcgauccucauggggcuggacaagggcuggcccaucuccaagauggacaucggcgugccccugcucgcccuggggugcuacagccaggucaacccccugacccucaccgccgccgugcugaugcugguggcgcacuacgccaucaucggcccggggcuccaggccaaggccacgcgggaggcccagaagcgcaccgcggccggcaucaugaagaaccccaccgucgacgggaucguggccaucgaccuggaccccguggucuacgacgccaaguucgagaagcagcugggccagaucaugcuccugauccugugcaccucccagauccuccugaugcgcacgaccugggcccugugcgagagcaucacccucgcgaccggcccccugacgacccugugggagggguccccgggcaaguucuggaacaccaccaucgccgugagcauggccaacaucuuccggggguccuaccucgccggcgccggccuggcguucagccugaugaagucccucgggggcgggcgccggggcacgggggcccagggcgagacccugggcgagaaguggaagcgccagcugaaccagcucuccaagagcgaguucaacaucuacaagcgguccgggaucauggagguggaccgcagcgaggccaaggagggccugaagcgcggggagaccacccgccacgccgucucccggggcacggcgaagcugcgcugguucguggagcggaaccuggugaagcccgaggggaaggucaucgaccucggcugcggccgcgggggcuggagcuacuacugcgccgggcugaagaaggugaccgaggugaagggcuacaccaagggcgggcccggccacgaggagcccaucccgauggccaccuacggguggaaccuggucaagcuccacuccggcaaggacguguucuucacgccgcccgagaagugcgacacccugcugugcgacaucggggagagcucccccaacccgaccaucgaggagggccggacccuccgcgugcugaagauggucgagcccuggcugcgggggaaccaguucugcaucaagauccucaaccccuacaugcccagcgugguggagacccuggagcagaugcagcgcaagcacggcggcaugcugguccggaacccgcucucccgcaacagcacgcacgagauguacuggguguccugcgggaccggcaacaucgugagcgccgucaacaugaccucccggaugcugcugaaccgcuucaccauggcccaccgcaagcccacguacgagcgggacguggaccucggggcgggcacccgccacguggccgucgagcccgagguggccaaccuggacaucaucggccagcggaucgagaacaucaagcacgagcacaagagcaccuggcacuacgacgaggacaaccccuacaagaccugggccuaccacggguccuacgaggucaagccgagcggcuccgccagcagcauggugaacgggguggucaagcugcucacgaagcccugggacgugauccccauggugacccagaucgcgaugaccgacaccacgcccuucggccagcagcgcgucuucaaggagaagguggacacccggaccccgaaggccaagcgcgggaccgcccagaucauggaggugacggcccgguggcuguggggcuuccugucccgcaacaagaagccccggaucugcacccgcgaggaguucacccggaagguccgcagcaacgccgcgaucggcgccguguucguggacgagaaccaguggaacuccgccaaggaggccgucgaggacgagcgguucugggaccucgugcagaaggagcgcgagcugcacaagcaggggaagugcgcgaccugcguguacaacaugaugggcaagcgggagaagaagcugggggaguucggcaaggccaaggggagccgcgccaucugguacauguggcucggcgcccgguuccuggaguucgaggcccugggcuucaugaacgaggaccacugguucucccgcgagaacagccucuccggggucgagggcgaggggcugcacaagcugggcuacauccuccgggacaucagcaagauccccgggggcaacauguacgcggacgacacggccggcugggacacccgcaucaccgaggacgaccugcagaacgaggccaagaucaccgacaucauggagccggagcacgcccugcucgccacguccaucuucaagcugaccuaccagaacaagguggugcggguccagcgccccgcgaagaacgggaccgugauggacgugaucagccgccgggaccagcgcggcuccgggcaggucggcaccuacggccugaacacguucaccaacauggaggcccagcucauccggcagauggagagcgaggggaucuuccugcccuccgagcuggagacccccaaccucgccgagcgcgugcuggacuggcuggagaaguacggcguggagcggcucaagcgcauggccaucagcggggacgacugcgucgugaagccgaucgacgaccgguucgccaccgcgcugacggcccugaacgacaugggcaaggugcgcaaggacaucccccagugggagcccuccaagggguggaacgacuggcagcagguccccuucugcagccaccacuuccaccagcucaucaugaaggacggccgggagaucguggugccgugccgcaaccaggacgagcuggucggccgggcccgcgugucccagggggccggcuggagccugcgggagaccgccugccucggcaagagcuacgcgcagauguggcagcugauguacuuccaccgccgggaccugcgccucgccgccaacgccaucugcuccgcggugcccgucgacugggugcccaccagccggaccacgugguccauccacgcccaccaccaguggaugaccaccgaggacaugcugagcguguggaaccgcgucuggaucgaggagaaccccuggauggaggacaagacccacguguccagcuggggcgacgugccguaccuggggaagcgggaggaccaguggugcggcucccucaucggccugaccgcccgcgccacgugggccagcaacauccaggucgcgaucaaccaggugcgccggcugaucgggaacgagaacuaccucgacuacaugaccuccaugaagcgcuucaagaacgagggcgaccccgagggggcccugugguga

SEQ ID NO: 8571 - RNA, 9879 nt, Artificial Sequence
  derived and/or modified CDS sequence (opt1) from DENV-1__GQ199840__SS-prME
agcgugaccaugcugcucaugcugaugcccaccgcccuggccuuccaccucacgacccggggcggggagccccacaugaucgugagcaagcaggagcggggcaagagccugcuguucaagaccagcgccggggugaacaugugcacccucaucgccauggaccugggcgaguucugcgaggacaccaugaccuacaagugcccccgcaucaccgaggccgagcccgacgacguggacugcuggugcaacgccaccgacacgugggugaccuacgggaccugcagccagaccggcgagcaccggcgggacaagcgguccguggcccuggcgccccacgugggccucgggcuggagacgcgcaccgagaccuggaugagcuccgagggcgccuggaagcagauccagcgggucgagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugcccgacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaagaucguccaguacgagaaccugaaguacagcgugaucgugaccguccacaccggcgaccagcaccagguggggaacgaguccacggagcacggcaccaccgcgaccaucacgccccaggcccccagcacggagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccagcggggccuccaccagccaggagaccuggaaccggcaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcauguccuacgucaugugcaccgggagcuucaagcuggagaaggagguggcggagacccagcacggcacggugcucguccagaucaaguacgagggcaccgacgcccccugcaagauccccuucuccacccaggacgagaagggggugacccagaacggccggcugaucacggccaacccgaucgugaccgacaaggagaagcccgucaacaucgaggccgagccgcccuucggggagagcuacaucgugaucggcgcgggcgagaaggcccugaagcuguccugguucaagaaggggagcuccaucggcaagauguucgaggccaccgcccgcggggcccggcgcauggcgauccucggcgacaccgccugggacuucgggagcaucggcggcguguucacguccgucgggaagcuggugcaccagaucuucggcaccgccuacggggugcuguucagcggcgucuccuggaccaugaagaucgggaucggcgugcuccugaccuggcugggccucaacagccgcuccacgagccuguccaugaccugcaucgccguggggcuggucacccucuaccugggcgugauggugcaggccgacagcgggugcgucaucaacuggaagggccgggagcugaagugcgggagcggcaucuucgugaccaacgaggugcacacguggaccgagcaguacaaguuccaggcggacuccccgaagcgccucagcgccgccaucggcaaggccugggaggagggggucugcggcauccgguccgccacccgccuggagaacaucauguggaagcagaucagcaacgagcugaaccacauccuccuggagaacgacaugaaguucaccgugguggucggggacguggcgggcauccuggcccaggggaagaagaugauccggccccagcccauggaguacaaguacuccuggaaguccuggggcaaggccaagaucaucggcgccgacgugcagaacaccacguucaucaucgacgggcccaacaccccggagugccccgacgaccagcgcgcguggaacaucugggaggucgaggacuacggcuucgggaucuucaccaccaacaucuggcucaagcugcgggacuccuacacccaggugugcgaccaccgccugaugagcgccgccaucaaggacuccaaggccgugcacgccgacaugggcuacuggaucgagagcgagaagaacgagaccuggaagcucgcgcgggccuccuucaucgaggucaagaccugcaucuggcccaagagccacacccugugguccaacggcgugcuggagagcgagaugaucauccccaagaucuacgggggcccgaucucccagcacaacuaccgccccggguacuucacgcagaccgccggccccuggcaccucgggaagcuggagcuggacuucgaccucugcgagggcaccaccguggucguggacgagcacugcggcaaccgggggccgagccugcgcacgaccaccgugaccggcaagaucauccacgaguggugcugccgguccugcacgcugccgccccugcgcuucaagggggaggacggcugcugguacgggauggagauccggcccgucaaggagaaggaggagaaccuggucaagagcauggugagcgccggcuccggcgaggucgacagcuucucccuggggcuccugugcaucagcaucaugaucgaggaggugaugcgcucccgguggagccgcaagaugcugaugaccggcacccucgccguguucuuccugcugaucaccgggcagcucacguggaacgaccugauccggcugugcaucauggucggcgcgaacgccuccgaccgcauggggaugggcaccaccuaccucgcccugauggccaccuucaagaugcgcccgauguucgccgugggccuccuguuccggcgccugacgagccgggaggugcugcuccugaccaucgggcugucccucgucgcgagcguggagcugcccaacucccuggaggagcucggcgacgggcuggccaugggcaucaugauccugaagcuccugaccgacuuccagagccaccagcugugggccacccuccugucccugacguucaucaagaccaccuucagccuccacuacgccuggaagaccauggcgaugguccuguccaucgugagccuguucccccucugccuguccacgaccagccagaagaccaccuggcugcccgugcuccugggcucccuggggugcaagccgcucacgauguuccugaucgccgagaacaagaucuggggccgcaagagcuggccccugaacgaggggaucauggccgucggcaucgugagcauccuccuguccagccugcucaagaacgacgugccccuggccgggccccugaucgccggcggcaugcucaucgcgugcuacgucaucuccgggagcuccgccgaccugagccuggagaaggccgccgagguguccugggaggaggaggccgagcacagcggcgcgucccacaacauccucguggagguccaggacgacgggaccaugaagaucaaggacgaggagcgggacgacacccugaccauccugcucaaggccacccugcuggccgugagcggcguguacccgcucuccauccccgccacgcuguucgucugguacuucuggcagaagaagaagcagcgcagcggggugcugugggacauccccagcccgcccgagguggagcgggccguccucgacgacggcaucuaccgcaucaugcagcggggccugcuggggcgcagccaggugggcgugggggucuuccaggagaacguguuccacaccauguggcacgugacccggggcgcgguccugauguaccaggggaagcgccucgagcccuccugggccagcgugaagaaggaccugaucuccuacggcggcggguggcggcugcagggcagcuggaacaccggggaggaggugcaggucaucgccguggagcccggcaagaaccccaagaacgugcagacggcccccgggaccuucaagaccuccgagggcgaggucggcgccaucgcgcucgacuucaagcccgggaccagcggcagccccaucgugaaccgcgaggggaagaucgugggccuguacggcaacggggucgugacgaccuccggcaccuacgugagcgccaucgcccaggccaaggcgucccaggaggggccccugccggagaucgaggacgaggucuuccggaagcgcaaccucaccaucauggaccugcaccccggcagcgggaagacgcggcgcuaccugcccgccaucgugcgggaggccaucaagcgcaagcuccggacccugauccuggccccgacccgcguggucgccuccgagauggcggaggcccucaagggcaugcccauccgcuaccagaccacggccgucaagagcgagcacaccggcaaggagaucguggaccugaugugccacgccaccuucaccaugcggcugcucucccccguccgcgugcccaacuacaacaugaucaucauggacgaggcccacuucacggacccgagcuccaucgcggcccggggguacaucagcacccgcgugggcaugggggaggccgccgccaucuucaugaccgcgacgccgcccggcuccgucgaggccuucccccagagcaacgccgugauccaggacgaggagcgggacaucccggagcgcuccuggaacagcggguacgaguggaucacggacuuccccggcaagaccgugugguucguccccuccaucaagagcggcaacgacaucgccaacugccugcggaagaacgggaagcgcgugauccagcugucccggaagaccuucgacaccgaguaccagaagacgaagaacaacgacugggacuacguggucaccaccgacaucagcgagaugggcgcgaacuuccgcgccgaccgggugaucgacccccgccggugccucaagccggugauccugaaggacgggcccgagcgcgucauccuggccggccccaugcccgugaccgucgccuccgccgcgcagcggcgcgggcggaucggccgcaaccacaacaaggagggcgaccaguacaucuacauggggcagccgcucaacaacgacgaggaccacgcccacuggacggaggccaagaugcugcuggacaacaucaacacccccgagggcaucauccccgcccucuucgagcccgagcgggagaaguccgccgcgaucgacggggaguaccgccugcgcggcgaggcccggaagaccuucguggagcugaugcgccgcggggaccucccgguguggcugagcuacaaggucgccuccgagggcuuccaguacagcgaccgccgguggugcuucgacggcgagcgcaacaaccaggugcuggaggagaacauggacguggagaucuggaccaaggagggggagcggaagaagcuccgcccccgguggcuggacgcccgcacguacuccgacccccuggcccuccgggaguucaaggaguucgcggccggccgccggagcgucuccggggaccugauccuggagaucggcaagcucccccagcaccugacccagcgcgcccagaacgcccuggacaaccucgugaugcugcacaacagcgagcagggcgggcgggcguaccgccacgccauggaggagcugccggacaccaucgagacccucaugcugcuggcccucaucgccgugcugacgggcggggucacccuguucuuccucuccggccgggggcugggcaagaccagcaucggccugcucugcgugauggccuccagcgugcugcuguggauggcguccgucgagccccacuggaucgccgccagcaucauccucgaguucuuccugauggugcugcucauccccgagcccgaccgccagcggaccccgcaggacaaccagcuggccuacguggucaucgggcuccucuucaugauccugaccguggccgcgaacgagaugggccugcucgagacgaccaagaaggaccuggggaucggccacguggccgccgagaaccaccaccacgccgccaugcuggacgucgaccuccaccccgcguccgccuggacccuguacgccguggccaccacgaucaucacccccaugaugcgccacaccaucgagaacaccacggccaacaucagccugaccgcgaucgccaaccaggccgccauccucauggggcuggacaagggcuggccgaucuccaagauggacaucggcgugccccugcucgcgcuggggugcuacagccaggucaacccccugacccucaccgccgccgugcugaugcugguggcccacuacgccaucaucggccccgggcuccaggcgaaggccacgcgggaggcccagaagcgcaccgccgccggcaucaugaagaacccgaccgucgacgggaucguggcgaucgaccuggaccccguggucuacgacgccaaguucgagaagcagcugggccagaucaugcuccugauccugugcaccucccagauccuccugaugcgcacgaccugggcccugugcgagagcaucacccucgccaccggcccccugacgacccugugggaggggucccccggcaaguucuggaacaccaccaucgccgugagcauggcgaacaucuuccgggggagcuaccucgccggcgccggccuggccuucucccugaugaagucccucgggggcgggcgccggggcacgggggcgcagggcgagacccugggcgagaaguggaagcgccagcugaaccagcucuccaagagcgaguucaacaccuacaagcgguccgggaucauggagguggaccgcagcgaggccaaggagggccugaagcgcggggagaccacgaagcacgccgucucccgcggcaccgccaagcugcggugguucguggagcgcaaccucgugaagccggaggggaaggucaucgaccugggcugcggccgcggcggguggagcuacuacugcgccgggcugaagaaggugaccgaggugaagggguacaccaagggcgggcccggccacgaggagcccauccccauggcgacguacggguggaaccuggucaagcuccacuccggcaaggacguguucuucaucccgcccgagaagugcgacacccugcugugcgacaucggggagagcucccccaaccccaccaucgaggagggccgcacccuccgggugcugaagauggucgagccguggcugcgcgggaaccaguucugcaucaagauccucaaccccuacaugcccagcgugguggagacgcuggagcagaugcagcggaagcacggcggcaugcugguccgcaacccccucucccggaacagcacccacgagauguacuggguguccugcgggaccggcaacaucgugagcgccgucaacaugaccucccgcaugcugcugaaccgguucaccauggcccaccgcaagccgacguacgagcgcgacguggaccucggggccggcacccggcacguggccgucgagcccgagguggcgaaccuggacaucaucggccagcgcaucgagaacaucaagcacgagcacaagagcaccuggcacuacgacgaggacaaccccuacaagaccugggccuaccacggguccuacgaggugaagcccagcggcagcgccuccagcauggucaacgggguggucaagcugcucacgaagccgugggacgugauccccauggugacccagaucgccaugaccgacaccacgcccuucggccagcagcgggucuucaaggagaagguggacacccgcacccccaaggccaagcgggggaccgcgcagaucauggaggugacggccaaguggcuguggggcuuccugucccgcaacaagaagccgcggaucugcacccgcgaggaguucacccggaagguccgcagcaacgccgccaucggcgcgguguucguggacgagaaccaguggaacuccgccaaggaggccgucgaggacgagcgguucugggaccucgugcaccgcgagcgggagcugcacaagcaggggaagugcgcgaccugcguguacaacaugaugggcaagcgcgagaagaagcugggggaguucggcaaggccaaggggagccgggcgaucugguacauguggcucggcgcccgcuuccuggaguucgaggcccugggcuucaugaacgaggaccacugguucucccgggagaacagccucuccggggucgagggcgaggggcugcacaagcugggcuacauccuccgcgacaucagcaagauccccgggggcaacauguacgccgacgacacggccggcugggacacccggaucaccgaggacgaccugcagaacgaggcgaagaucaccgacaucauggagcccgagcacgcccugcucgccaaguccaucuucaagcugacguaccagaacaagguggugcgcguccagcggccggccaagaacgggaccgugauggacgugaucagccgccgcgaccagcggggcuccgggcaggucggcaccuacggccugaacaccuucacgaacauggaggcccagcucauccgccagauggagagcgaggggaucuucucccccagcgagcuggagacccccaaccuggcgggccgggugcucgacuggcuggagaaguacgggguggagcgccugaagcggauggccaucuccggcgacgacugcgucgugaagcccaucgacgaccgcuucgccaccgcccucaccgcccugaacgacauggggaaggugcggaaggacaucccgcagugggagcccagcaagggcuggaacgacuggcagcagguccccuucugcagccaccacuuccaccagcugaucaugaaggacggccgcgagaucguggugcccugccggaaccaggacgagcucgucgggcgcgcgcgggugucccagggcgccggguggagccugcgcgagacggccugccugggcaaguccuacgcccagauguggcagcucauguacuuccaccggcgcgaccugcggcuggcggccaacgccaucugcagcgccgugccggucgacugggugcccaccucccgcaccaccuggagcauccacgcccaccaccaguggaugacgaccgaggacaugcucuccguguggaaccgggucuggaucgaggagaaccccuggauggaggacaagacccacaucagcuccuggggcgacgugcccuaccugggcaagcgcgaggaccaguggugcggcagccugaucgggcucaccgcgcgggccacgugggccaccaacauccagguggccaucaaccagguccgccgccugaucggcaacgagaacuaccuggacuacaugaccuccaugaagcgguucaagaacgagagcgacccggagggggcccucugguga

SEQ ID NO: 8572 - RNA, 9879 nt, Artificial Sequence
  derived and/or modified CDS sequence (opt1) from DENV-1__FJ898405__SS-prME
agcgugaccaugcugcucaugcugaugcccaccgcccuggccuuccaccucaccacccggggcggggagccccacaugaucgugaccaagcaggagcggggcaagagccugcuguucaagaccagcgcgggggugaacaugugcacccucaucgccauggaccugggggagcugugcgaggacaccaugaccuacaagugcccccggaucaccgaggccgagcccgacgacguggacugcuggugcaacgccaccgacaccugggugaccuacgggaccugcucccagacgggggagcaccggcgcgacaagcggagcguggcccucgcgccccacgugggccuggggcuggagacccgcaccgagaccuggauguccagcgagggcgccuggaagcagauccagcgggucgagacgugggcccuccgccaccccggguucaccgugaucgcccuguuccuggcgcacgccaucggcaccuccaucacccagaaggggaucaucuucauccuccugaugcuggugacgcccagcauggccaugcggugcgucggcaucggcucccgcgacuucguggaggggcucagcggcgccaccuggguggacgucgugcuggagcacggguccugcgugaccaccauggccaaggacaagcccacgcuggacaucgagcuccugaagaccgaggucaccaaccccgcggugcugcggaagcucugcaucgaggccaagaucagcaacaccacgaccgacucccgcugccccacccagggcgaggccacccugauggaggagcaggacgccaacuucgugugccggcgcacguucgucgaccggggcugggggaacggcugcgggcuguucggcaaggggagccucaucacgugcgccaaguucaagugcgugaccaagcuggagggcaagaucgugcaguacgagaaccugaaguacuccgucaucgugaccgugcacacgggcgaccagcaccaggucgggaacgagagcaccgagcacggcaccaccgcgaccaucacgccccaggcccccaccuccgagauccagcucaccgacuacggggcccugacccuggacugcagcccccgcacgggccucgacuucaacgagauggugcugcugaccaugaaggagaaguccuggcucguccacaagcagugguuccuggaccugccgcuccccuggaccagcggggccagcaccucccaggagacguggaaccggcaggaccugcuggugaccuucaagaccgcccacgcgaagaagcaggagguggucgugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgugaugugcaccggguccuucaagcucgagaaggaggucgcggagacgcagcacggcaccgugcuggugcagaucaaguacgagggcaccgacgcccccugcaagauccccuucagcacccaggacgagaagggggucacgcagaacggccggcugaucaccgccaacccgaucgugaccgacaaggagaagcccgugaacaucgaggccgagccgcccuucggggaguccuacaucgucaucggcgcgggcgagaaggcccugaagcucagcugguucaagaagggguccaacaucggcaagauguucgaggccaccgcccgcggggcccggcgcauggcgauccugggcgacacggccugggacuucgggagcaucggcggcguguucaccuccguggggaagcugguccaccagaucuucggcaccgccuacgggguccuguucagcggcguguccuggaccaugaagaucgggaucggcguccugcugacguggcucggccugaacagccgcuccaccagccuguccaugaccugcaucgccguggggcucgugacccuguaccugggcgucauggugcaggccgacagcgggugcgugaucaacuggaagggccgggagcucaagugcggguccggcaucuucgucacgaacgaggugcacaccuggaccgagcaguacaaguuccaggcggacagcccgaagcgccugagcgccgccaucggcaaggccugggaggagggggugugcggcauccgguccgccacccgccuggagaacaucauguggaagcagaucagcaacgagcucaaccacauccugcuggagaacgacaugaaguucaccgucguggugggggacgucgugggcauccucgcgcaggggaagaagaugauccggccccagcccauggagcacaaguacuccuggaaguccuggggcaaggccaagaucaucggcgccgacgugcagaacacgaccuucaucaucgacgggcccaacaccccggagugccccgacgaccagcgcgccuggaacaucugggaggucgaggacuacggcuucgggaucuucaccacgaacaucuggcugaagcugcgggacuccuacacccaggugugcgaccaccgccucaugagcgcggccaucaaggacuccaaggccgugcacgccgacaugggcuacuggaucgagagcgagaagaacgagaccuggaagcuggcccgggcguccuucaucgaggucaagaccugcaucuggcccaagagccacacgcugugguccaacggcgugcucgagagcgagaugaucauccccaagaucuacgggggcccgaucucccagcacaacuaccgccccggguacuucacccagaccgccggccccuggcaccuggggaagcuggagcucgacuucgaccugugcgagggcaccacgguggucguggacgagcacugcggcaaccgggggccgagccugcgcaccaccaccgugacgggcaagaucauccacgaguggugcugccgguccugcacccugccgccccuccgcuucaagggggaggacggcugcugguacgggauggagauccggcccgucaaggagaaggaggagaaccuggucaagagcaugguguccgccggcagcggcgaggucgacagcuucucccucgggcugcugugcaucagcaucaugaucgaggaggugaugcgcucccgguggagccgcaagaugcucaugaccggcacccuggccguguuccugcuccugaucauggggcagcugacguggaacgaccucauccggcugugcaucauggucggcgccaacgcguccgaccgcauggggaugggcaccaccuaccuggcccucauggccaccuucaagaugcgcccgauguucgccgugggccugcuguuccggcgccucacgagccgggaggugcugcugcucaccaucgggcugucccuggucgccagcguggagcuccccaacucccuggaggagcugggcgacgggcucgcgaugggcaucaugauccugaagcugcucaccgacuuccagagccaccagcugugggccacccugcucucccugacguucaucaagaccacccugagccuccacuacgccuggaagaccauggccaugguccuguccaucgugagccuguucccccucugccuguccacgaccagccagaagaccaccuggcugcccgugcuccugggcucccuggggugcaagccgcucacgauguuccugaucgcggagaacaagaucuggggccgcaagagcuggccccugaacgaggggaucauggccgucggcgugguguccauccuccugagcagccugcucaagaacgacgucccccuggccgggccccugaucgccggcggcaugcucaucgccugcuacgugaucuccgggagcuccgcggaccugagccuggagaaggccgccgagguguccugggaggaggaggccgagcacagcggcgccucccacaacauccucgucgaggugcaggacgacgggaccaugaagaucaaggacgaggagcgggacgacacccugaccauccugcucaaggcgacccugcuggccgugagcggcgucuacccgcucuccauccccgccacgcuguucgugugguacuucuggcagaagaagaagcagcgcagcggggugcugugggacacccccagcccgcccgaggucgagcgggccgugcuggacgacggcaucuaccgcaucaugcagcggggccuccuggggcgcagccaggugggcgucgggguguuccaggagaacguguuccacaccauguggcacgucacccggggcgccgugcugauguaccaggggaagcgccucgagcccuccugggcgagcgugaagaaggaccugaucuccuacggcggcggguggcggcugcagggcagcuggaacacgggggaggagguccaggugaucgccguggagcccggcaagaaccccaagaacguccagaccgcccccgggaccuucaagacccccgagggcgaggugggcgccaucgcccucgacuucaagcccgggacguccggcagccccaucgugaaccgcgaggggaagaucgucggccuguacggcaacgggguggugaccaccuccggcaccuacgucagcgcgaucgcccaggccaaggccagccaggaggggccgcugcccgagaucgaggacgagguguuccggaagcgcaaccucacgaucauggaccugcaccccggcuccgggaagacccggcgcuaccugccggcgaucgugcgggaggccaucaagcgcaagcuccggacccugauccuggcccccacccgcgucguggccagcgagauggccgaggcgcucaagggcaugcccauccgcuaccagacgaccgccgugaaguccgagcacaccggcaaggagaucgucgaccugaugugccacgccaccuucacgaugcggcugcucagccccgugcgcgugccgaacuacaacaugaucaucauggacgaggcccacuucaccgaccccuccagcaucgccgcgcggggguacaucuccacccgcgucggcaugggggaggccgccgccaucuucaugaccgccacgccgcccggcagcguggaggcguucccgcaguccaacgccgugauccaggacgaggagcgggacauccccgagcgcagcuggaacuccggguacgaguggaucaccgacuuccccggcaagaccgucugguucgugcccagcaucaaguccggcaacgacaucgccaacugccugcggaagaacgggaagcgcgugauccagcugagccggaagaccuucgacacggaguaccagaagaccaagaacaacgacugggacuacgucgugaccaccgacaucuccgagaugggcgccaacuuccgcgcggaccgggugaucgacccgcgccggugccucaagcccgucauccugaaggacgggcccgagcgcgugauccuggccggccccaugccggucacgguggccagcgccgcccagcggcgcgggcggaucggccgcaaccacaacaaggagggcgaccaguacaucuacauggggcagccccucaacaacgacgaggaccacgcgcacuggaccgaggccaagaugcugcuggacaacaucaacacccccgagggcaucauccccgcccucuucgagccggagcgggagaaguccgccgccaucgacggggaguaccgccugcgcggcgaggcgcggaagaccuucguggagcugaugcgccgcggggaccuccccgucuggcugagcuacaagguggccuccgagggcuuccaguacagcgaccgccgguggugcuucgacggcgagcgcaacaaccaggugcuggaggagaacauggacgucgagaucuggacgaaggagggggagcggaagaagcuccgcccccgguggcuggacgcccgcaccuacagcgacccccuggcccuccgggaguucaaggaguucgccgcgggccgccgguccgugagcggggaccugauccuggagaucggcaagcucccgcagcaccugacccagcgcgcccagaacgcccuggacaaccucgugaugcugcacaacuccgagcagggcgggcgggccuaccgccacgcgauggaggagcugcccgacaccaucgagacgcucaugcugcuggcccucaucgccguccugaccggcggggugacccuguucuuccucagcggccgggggcugggcaagaccuccaucggccugcucugcgugauggccagcuccguccugcuguggauggccagcguggagccccacuggaucgcggccuccaucauccucgaguucuuccugauggugcugcucauccccgagccggaccgccagcggacgccccaggacaaccagcuggccuacgucgugaucgggcuccucuucaugauccugacgguggccgccaacgagaugggccugcucgagaccaccaagaaggaccuggggaucggccacgucgcgguggagaaccaccaccacgccaccaugcuggacguggaccuccaccccgccagcgccuggacgcuguacgccgucgcgaccaccaucaucaccccgaugaugcgccacacgaucgagaacaccaccgccaacaucucccugaccgccaucgccaaccaggccgcgauccucauggggcuggacaagggcuggcccaucagcaagauggacaucggcgugccccugcucgcccuggggugcuacucccaggugaacccccugacgcucaccgccgccguccugaugcugguggcgcacuacgccaucaucggcccggggcuccaggccaaggccacccgggaggcccagaagcgcaccgcggccggcaucaugaagaaccccacgguggacgggaucgucgccaucgaccuggaccccgugguguacgacgccaaguucgagaagcagcugggccagaucaugcuccugauccugugcaccagccagauccuccugaugcgcaccaccugggcccugugcgaguccaucacgcucgcgaccggcccccugaccacccugugggaggggagcccgggcaaguucuggaacacgaccaucgccgucuccauggccaacaucuuccgggggagcuaccucgccggcgccggccuggcguucucccugaugaagucccucgggggcgggcgccggggcaccggggcccagggcgagacccugggcgagaaguggaagcgccagcugaaccagcucagcaaguccgaguucaacaucuacaagcggagcgggaucauggagguggaccgcuccgaggccaaggagggccugaagcgcggggagacgacccgccacgccgugagccggggcaccgcgaagcugcgcugguucgucgagcggaaccuggugaagcccgaggggaaggugaucgaccucggcugcggccgcgggggcugguccuacuacugcgccgggcugaagaaggucaccgaggugaagggcuacacgaagggcgggcccggccacgaggagcccaucccgauggccaccuacggguggaaccuggugaagcuccacagcggcaaggacgucuucuucacgccgcccgagaagugcgacacccugcugugcgacaucggggaguccagccccaacccgacgaucgaggagggccggacccuccgcgugcugaagaugguggagcccuggcugcgggggaaccaguucugcaucaagauccucaaccccuacaugcccuccgucguggagacccuggagcagaugcagcgcaagcacggcggcaugcuggugcggaacccgcucagccgcaacuccacccacgagauguacugggucagcugcgggaccggcaacaucguguccgccgugaacaugacgagccggaugcugcugaaccgcuucaccauggcccaccgcaagcccaccuacgagcgggacgucgaccucggggcgggcacccgccacguggccguggagcccgaggucgccaaccuggacaucaucggccagcggaucgagaacaucaagcacgagcacaaguccacguggcacuacgacgaggacaaccccuacaagaccugggccuaccacgggagcuacgaggugaagccguccggcagcgccuccagcauggucaacgggguggugaagcugcucaccaagcccugggacgucauccccauggugacccagaucgcgaugacggacaccacccccuucggccagcagcgcguguucaaggagaaggucgacacccggacgccgaaggccaagcgcgggaccgcccagaucauggaggugaccgcccgguggcuguggggcuuccugagccgcaacaagaagccccggaucugcacccgcgaggaguucacgcggaaggugcgcuccaacgccgcgaucggcgccgucuucguggacgagaaccaguggaacagcgccaaggaggccguggaggacgagcgguucugggaccucguccagaaggagcgcgagcugcacaagcaggggaagugcgcgaccugcguguacaacaugaugggcaagcgggagaagaagcugggggaguucggcaaggccaaggggucccgcgccaucugguacauguggcucggcgcccgguuccuggaguucgaggcccugggcuucaugaacgaggaccacugguucagccgcgagaacucccucagcgggguggagggcgaggggcugcacaagcugggcuacauccuccgggacaucuccaagauccccgggggcaacauguacgcggacgacaccgccggcugggacacccgcaucacggaggacgaccugcagaacgaggccaagaucaccgacaucauggagccggagcacgcccugcucgccaccagcaucuucaagcugaccuaccagaacaaggucgugcgggugcagcgccccgcgaagaacgggacggucauggacgugaucucccgccgggaccagcgcggcagcggccaggugggcaccuacggccugaacaccuucaccaacauggaggcccagcucauccggcagauggaguccgaggggaucuucagccccuccgagcuggagauccccaaccuggccgagcgcguccucgacuggcuggagaaguacggcguggagcggcugaagcgcauggccaucagcggggacgacugcguggucaagccgaucgacgaccgguucgccacggcgcucaccgcccugaacgacaugggcaaggugcgcaaggacgugccccagugggagcccuccaagggguggaacgacuggcagcagguccccuucugcagccaccacuuccaccagcugaucaugaaggacggccgggagaucguggugccgugccgcaaccaggacgagcucgucggccgggcccgcgugucccagggggccggcuggagccugcgggagaccgccugccugggcaagagcuacgcgcagauguggcagcucauguacuuccaccgccgggaccugcgccuggccgccaacgccaucugcuccgcggugcccgucgacugggugcccaccagccggacgaccugguccauccacgcccaccaccaguggaugaccaccgaggacaugcucagcguguggaaccgcgucuggaucgaggagaaccccuggauggaggacaagacgcacguguccagcuggggcgacgugccguaccuggggaagcgggaggaccaguggugcggcucccugaucggccucaccgcccgcgccaccugggccagcaacauccaggucgcgaucaaccaggugcgccggcugaucgggaacgagaacuaccuggacuacaugaccuccaugaagcgcuucaagaacgagggcgaccccgagggggcccucugguga

SEQ ID NO: 8573 - RNA, 9879 nt, Artificial Sequence
  derived and/or modified CDS sequence (opt1) from DENV-1__FJ898406__SS-prME
agcgugaccaugcugcucaugcugaugcccaccgcccuggccuuccaccucaccacccggggcggggagccccacaugaucgugaccaagcaggagcggggcaagagccugcuguucaagaccagcgcgggggugaacaugugcacccucaucgccauggaccugggggagcugugcgaggacaccaugaccuacaagugcccccggaucaccgaggccgagcccgacgacguggacugcuggugcaacgccaccgacaccugggugaccuacgggaccugcucccagacgggggagcaccggcgcgacaagcggagcguggcccucgcgccccacgugggccuggggcuggagacccgcaccgagaccuggauguccagcgagggcgccuggaagcagauccagcgggucgagacgugggcccuccgccaccccggguucaccgugaucgcccuguuccuggcgcacgccaucggcaccuccaucacccagaaggggaucaucuucauccuccugaugcuggugacgcccagcauggccaugcggugcgucggcaucggcucccgcgacuucguggaggggcucagcggcgccaccuggguggacgucgugcuggagcacggguccugcgugaccaccauggccaaggacaagcccacgcuggacaucgagcuccugaagaccgaggucaccaaccccgcggugcugcggaagcucugcaucgaggccaagaucagcaacaccacgaccgacucccgcugccccacccagggcgaggccacccugauggaggagcaggacgccaacuucgugugccggcgcacguucgucgaccggggcugggggaacggcugcgggcuguucggcaaggggagccucaucacgugcgccaaguucaagugcgugaccaagcuggagggcaagaucgugcaguacgagaaccugaaguacuccgucaucgugaccgugcacacgggcgaccagcaccaggucgggaacgagagcaccgagcacggcaccaccgcgaccaucacgccccaggcccccaccuccgagauccagcucaccgacuacggggcccugacccuggacugcagcccccgcacgggccucgacuucaacgagauggugcugcugaccaugaaggagaaguccuggcucguccacaagcagugguuccuggaccugccgcuccccuggaccagcggggccagcaccucccaggagacguggaaccggcaggaccugcuggugaccuucaagaccgcccacgcgaagaagcaggagguggucgugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgugaugugcaccggguccuucaagcucgagaaggaggucgcggagacgcagcacggcaccgugcuggugcagaucaaguacgagggcaccgacgcccccugcaagauccccuucagcacccaggacgagaagggggucacgcagaacggccggcugaucaccgccaacccgaucgugaccgacaaggagaagcccgugaacaucgaggccgagccgcccuucggggaguccuacaucgucaucggcgcgggcgagaaggcccugaagcucagcugguucaagaagggguccaacaucggcaagauguucgaggccaccgcccgcggggcccggcgcauggcgauccugggcgacacggccugggacuucgggagcaucggcggcguguucaccuccguggggaagcugguccaccagaucuucggcaccgccuacgggguccuguucagcggcguguccuggaccaugaagaucgggaucggcguccugcugacguggcucggccugaacagccgcuccaccagccuguccaugaccugcaucgccguggggcucgugacccuguaccugggcgucauggugcaggccgacagcgggugcgugaucaacuggaagggccgggagcucaagugcggguccggcaucuucgucacgaacgaggugcacaccuggaccgagcaguacaaguuccaggcggacagcccgaagcgccugagcgccgccaucggcaaggccugggaggagggggugugcggcauccgguccgccacccgccuggagaacaucauguggaagcagaucagcaacgagcucaaccacauccugcuggagaacgacaugaaguucaccgucguggugggggacgucgugggcauccucgcgcaggggaagaagaugauccggccccagcccauggagcacaaguacuccuggaaguccuggggcaaggccaagaucaucggcgccgacgugcagaacacgaccuucaucaucgacgggcccaacaccccggagugccccgacgaccagcgcgccuggaacaucugggaggucgaggacuacggcuucgggaucuucaccacgaacaucuggcugaagcugcgggacuccuacacccaggugugcgaccaccgccucaugagcgcggccaucaaggacuccaaggccgugcacgccgacaugggcuacuggaucgagagcgagaagaacgagaccuggaagcuggcccgggcguccuucaucgaggucaagaccugcaucuggcccaagagccacacgcugugguccaacggcgugcucgagagcgagaugaucauccccaagaucuacgggggcccgaucucccagcacaacuaccgccccggguacuucacccagaccgccggccccuggcaccuggggaagcuggagcucgacuucgaccugugcgagggcaccacgguggucguggacgagcacugcggcaaccgggggccgagccugcgcaccaccaccgugacgggcaagaucauccacgaguggugcugccgguccugcacccugccgccccuccgcuucaagggggaggacggcugcugguacgggauggagauccggcccgucaaggagaaggaggagaaccuggucaagagcaugguguccgccggcagcggcgaggucgacagcuucucccucgggcugcugugcaucagcaucaugaucgaggaggugaugcgcucccgguggagccgcaagaugcucaugaccggcacccuggccguguuccugcuccugaucauggggcagcugacguggaacgaccucauccggcugugcaucauggucggcgccaacgcguccgaccgcauggggaugggcaccaccuaccuggcccucauggccaccuucaagaugcgcccgauguucgccgugggccugcuguuccggcgccucacgagccgggaggugcugcugcucaccaucgggcugucccuggucgccagcguggagcuccccaacucccuggaggagcugggcgacgggcucgcgaugggcaucaugauccugaagcugcucaccgacuuccagagccaccagcugugggccacccugcucucccugacguucaucaagaccacccugagccuccacuacgccuggaagaccauggccaugguccuguccaucgugagccuguucccccucugccuguccacgaccagccagaagaccaccuggcugcccgugcuccugggcucccuggggugcaagccgcucacgauguuccugaucgcggagaacaagaucuggggccgcaagagcuggccccugaacgaggggaucauggccgucggcgugguguccauccuccugagcagccugcucaagaacgacgucccccuggccgggccccugaucgccggcggcaugcucaucgccugcuacgugaucuccgggagcuccgcggaccugagccuggagaaggccgccgagguguccugggaggaggaggccgagcacagcggcgccucccacaacauccucgucgaggugcaggacgacgggaccaugaagaucaaggacgaggagcgggacgacacccugaccauccugcucaaggcgacccugcuggccgugagcggcgucuacccgcucuccauccccgccacgcuguucgugugguacuucuggcagaagaagaagcagcgcagcggggugcugugggacacccccagcccgcccgaggucgagcgggccgugcuggacgacggcaucuaccgcaucaugcagcggggccuccuggggcgcagccaggugggcgucgggguguuccaggagaacguguuccacaccauguggcacgucacccggggcgccgugcugauguaccaggggaagcgccucgagcccuccugggcgagcgugaagaaggaccugaucuccuacggcggcggguggcggcugcagggcagcuggaacacgggggaggagguccaggugaucgccguggagcccggcaagaaccccaagaacguccagaccgcccccgggaccuucaagacccccgagggcgaggugggcgccaucgcccucgacuucaagcccgggacguccggcagccccaucgugaaccgcgaggggaagaucgucggccuguacggcaacgggguggugaccaccuccggcaccuacgucagcgcgaucgcccaggccaaggccagccaggaggggccgcugcccgagaucgaggacgagguguuccggaagcgcaaccucacgaucauggaccugcaccccggcuccgggaagacccggcgcuaccugccggcgaucgugcgggaggccaucaagcgcaagcuccggacccugauccuggcccccacccgcgucguggccagcgagauggccgaggcgcucaagggcaugcccauccgcuaccagacgaccgccgugaaguccgagcacaccggcaaggagaucgucgaccugaugugccacgccaccuucacgaugcggcugcucagccccgugcgcgugccgaacuacaacaugaucaucauggacgaggcccacuucaccgaccccuccagcaucgccgcgcggggguacaucuccacccgcgucggcaugggggaggccgccgccaucuucaugaccgccacgccgcccggcagcguggaggcguucccgcaguccaacgccgugauccaggacgaggagcgggacauccccgagcgcagcuggaacuccggguacgaguggaucaccgacuuccccggcaagaccgucugguucgugcccagcaucaaguccggcaacgacaucgccaacugccugcggaagaacgggaagcgcgugauccagcugagccggaagaccuucgacacggaguaccagaagaccaagaacaacgacugggacuacgucgugaccaccgacaucuccgagaugggcgccaacuuccgcgcggaccgggugaucgacccgcgccggugccucaagcccgucauccugaaggacgggcccgagcgcgugauccuggccggccccaugccggucacgguggccagcgccgcccagcggcgcgggcggaucggccgcaaccacaacaaggagggcgaccaguacaucuacauggggcagccccucaacaacgacgaggaccacgcgcacuggaccgaggccaagaugcugcuggacaacaucaacacccccgagggcaucauccccgcccucuucgagccggagcgggagaaguccgccgccaucgacggggaguaccgccugcgcggcgaggcgcggaagaccuucguggagcugaugcgccgcggggaccuccccgucuggcugagcuacaagguggccuccgagggcuuccaguacagcgaccgccgguggugcuucgacggcgagcgcaacaaccaggugcuggaggagaacauggacgucgagaucuggacgaaggagggggagcggaagaagcuccgcccccgguggcuggacgcccgcaccuacagcgacccccuggcccuccgggaguucaaggaguucgccgcgggccgccgguccgugagcggggaccugauccuggagaucggcaagcucccgcagcaccugacccagcgcgcccagaacgcccuggacaaccucgugaugcugcacaacuccgagcagggcgggcgggccuaccgccacgcgauggaggagcugcccgacaccaucgagacgcucaugcugcuggcccucaucgccguccugaccggcggggugacccuguucuuccucagcggccgggggcugggcaagaccuccaucggccugcucugcgugauggccagcuccguccugcuguggauggccagcguggagccccacuggaucgcggccuccaucauccucgaguucuuccugauggugcugcucauccccgagccggaccgccagcggacgccccaggacaaccagcuggccuacgucgugaucgggcuccucuucaugauccugacgguggccgccaacgagaugggccugcucgagaccaccaagaaggaccuggggaucggccacgucgcgguggagaaccaccaccacgccaccaugcuggacguggaccuccaccccgccagcgccuggacgcuguacgccgucgcgaccaccaucaucaccccgaugaugcgccacacgaucgagaacaccaccgccaacaucucccugaccgccaucgccaaccaggccgcgauccucauggggcuggacaagggcuggcccaucagcaagauggacaucggcgugccccugcucgcccuggggugcuacucccaggugaacccccugacgcucaccgccgccguccugaugcugguggcgcacuacgccaucaucggcccggggcuccaggccaaggccacccgggaggcccagaagcgcaccgcggccggcaucaugaagaaccccacgguggacgggaucgucgccaucgaccuggaccccgugguguacgacgccaaguucgagaagcagcugggccagaucaugcuccugauccugugcaccagccagauccuccugaugcgcaccaccugggcccugugcgaguccaucacgcucgcgaccggcccccugaccacccugugggaggggagcccgggcaaguucuggaacacgaccaucgccgucuccauggccaacaucuuccgggggagcuaccucgccggcgccggccuggcguucucccugaugaagucccucgggggcgggcgccggggcaccggggcccagggcgagacccugggcgagaaguggaagcgccagcugaaccagcucagcaaguccgaguucaacaucuacaagcggagcgggaucauggagguggaccgcuccgaggccaaggagggccugaagcgcggggagacgacccgccacgccgugagccggggcaccgcgaagcugcgcugguucgucgagcggaaccuggugaagcccgaggggaaggugaucgaccucggcugcggccgcgggggcugguccuacuacugcgccgggcugaagaaggucaccgaggugaagggcuacacgaagggcgggcccggccacgaggagcccaucccgauggccaccuacggguggaaccuggugaagcuccacagcggcaaggacgucuucuucacgccgcccgagaagugcgacacccugcugugcgacaucggggaguccagccccaacccgacgaucgaggagggccggacccuccgcgugcugaagaugguggagcccuggcugcgggggaaccaguucugcaucaagauccucaaccccuacaugcccuccgucguggagacccuggagcagaugcagcgcaagcacggcggcaugcuggugcggaacccgcucagccgcaacuccacccacgagauguacugggucagcugcgggaccggcaacaucguguccgccgugaacaugacgagccggaugcugcugaaccgcuucaccauggcccaccgcaagcccaccuacgagcgggacgucgaccucggggcgggcacccgccacguggccguggagcccgaggucgccaaccuggacaucaucggccagcggaucgagaacaucaagcacgagcacaaguccacguggcacuacgacgaggacaaccccuacaagaccugggccuaccacgggagcuacgaggugaagccguccggcagcgccuccagcauggucaacgggguggugaagcugcucaccaagcccugggacgucauccccauggugacccagaucgcgaugacggacaccacccccuucggccagcagcgcguguucaaggagaaggucgacacccggacgccgaaggccaagcgcgggaccgcccagaucauggaggugaccgcccgguggcuguggggcuuccugagccgcaacaagaagccccggaucugcacccgcgaggaguucacgcggaaggugcgcuccaacgccgcgaucggcgccgucuucguggacgagaaccaguggaacagcgccaaggaggccguggaggacgagcgguucugggaccucguccagaaggagcgcgagcugcacaagcaggggaagugcgcgaccugcguguacaacaugaugggcaagcgggagaagaagcugggggaguucggcaaggccaaggggucccgcgccaucugguacauguggcucggcgcccgguuccuggaguucgaggcccugggcuucaugaacgaggaccacugguucagccgcgagaacucccucagcgggguggagggcgaggggcugcacaagcugggcuacauccuccgggacaucuccaagauccccgggggcaacauguacgcggacgacaccgccggcugggacacccgcaucacggaggacgaccugcagaacgaggccaagaucaccgacaucauggagccggagcacgcccugcucgccaccagcaucuucaagcugaccuaccagaacaaggucgugcgggugcagcgccccgcgaagaacgggacggucauggacgugaucucccgccgggaccagcgcggcagcggccaggugggcaccuacggccugaacaccuucaccaacauggaggcccagcucauccggcagauggaguccgaggggaucuucagccccuccgagcuggagauccccaaccuggccgagcgcguccucgacuggcuggagaaguacggcguggagcggcugaagcgcauggccaucagcggggacgacugcguggucaagccgaucgacgaccgguucgccacggcgcucaccgcccugaacgacaugggcaaggugcgcaaggacgugccccagugggagcccuccaagggguggaacgacuggcagcagguccccuucugcagccaccacuuccaccagcugaucaugaaggacggccgggagaucguggugccgugccgcaaccaggacgagcucgucggccgggcccgcgugucccagggggccggcuggagccugcgggagaccgccugccugggcaagagcuacgcgcagauguggcagcucauguacuuccaccgccgggaccugcgccuggccgccaacgccaucugcuccgcggugcccgucgacugggugcccaccagccggacgaccugguccauccacgcccaccaccaguggaugaccaccgaggacaugcucagcguguggaaccgcgucuggaucgaggagaaccccuggauggaggacaagacgcacguguccagcuggggcgacgugccguaccuggggaagcgggaggaccaguggugcggcucccugaucggccucaccgcccgcgccaccugggccagcaacauccaggucgcgaucaaccaggugcgccggcugaucgggaacgagaacuaccuggacuacauggccuccaugaagcgcuucaagaacgagggcgaccccgagggggcccucugguga

SEQ ID NO: 8574 - RNA, 9879 nt, Artificial Sequence
  derived and/or modified CDS sequence (opt1) from DENV-1__GQ199841__SS-prME
agcgugaccaugcugcucaugcugaugcccaccgcccuggccuuccaccucacgacccggggcggggagccccacaugaucgugagcaagcaggagcggggcaagagccugcuguucaagaccagcgcgggggugaacaugugcacccucaucgccauggaccugggcgaguucugcgaggacacgaugaccuacaagugcccccgcaucaccgaggccgagcccgacgacguggacugcuggugcaacgccaccgacacgugggugaccuacgggaccugcagccagaccggcgagcaccggcgggacaagcgguccguggcccuggcgccccacgugggccucgggcuggagacgcgcaccgagaccuggaugagcuccgagggcgccuggaagcagauccagcgggucgagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugcccgacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaagaccguccaguacgagaaccugaaguacagcgugaucgugaccguccacacgggcgaccagcaccagguggggaacgaguccaccgagcacggcaccaccgcgaccaucacgccccaggcccccagcaccgagauccagcugaccgacuacggggcccucacccuggacugcagcccccggacgggccuggacuucaacgagaugguccuccugaccaugaaggagaaguccuggcuggugcacaagcagugguuccucgaccugccgcugcccuggaccagcggggccuccaccagccaggagacguggaaccggaaggaccuccuggugaccuucaagaccgcccacgcgaagaagcaggaggucguggugcugggcucccaggagggcgccaugcacaccgcccucacgggggccaccgagauccagaccagcggcaccacgaccaucuucgccgggcaccugaagugccgccugaagauggacaagcucacccugaagggcauguccuacgucaugugcaccgggagcuucaagcuggagaaggagguggcggagacgcagcacggcaccgugcucguccagaucaaguacgagggcaccgacgcccccugcaagauccccuucuccacccaggacgagaagggggugacgcagaacggccggcugaucaccgccaacccgaucgugaccgacaaggagaagcccgucaacaucgaggccgagccgcccuucggggagagcuacaucgugaucggcgcgggcgagaaggcccugaagcuguccugguucaagaaggggagcuccaucggcaagauguucgaggccaccgcccgcggggcccggcgcauggcgauccucggcgacacggccugggacuucgggagcaucggcggcguguucaccuccgucgggaagcuggugcaccagaucuucggcaccgccuacggggugcuguucagcggcgucuccuggaccaugaagaucgggaucggcgugcuccugacguggcugggccucaacagccgcuccaccagccuguccaugaccugcaucgccguggggcuggucacccucuaccugggcgugauggugcaggccgacagcgggugcgucaucaacuggaagggccgggagcugaagugcgggagcggcaucuucgugacgaacgaggugcacaccuggaccgagcaguacaaguuccaggcggacuccccgaagcgccucagcgccgccaucggcaaggccugggaggagggggucugcggcauccgguccgccacccgccuggagaacaucauguggaagcagaucagcaacgagcugaaccacauccuccuggagaacgacaugaaguucaccgugguggucggggacguggcgggcauccuggcccaggggaagaagaugauccggccccagcccauggaguacaaguacuccuggaaguccuggggcaaggccaagaucaucggcgccgacgugcagaacacgaccuucaucaucgacgggcccaacaccccggagugccccgacgaccagcgcgcguggaacaucugggaggucgaggacuacggcuucgggaucuucaccacgaacaucuggcucaagcugcgggacuccuacacccaggugugcgaccaccgccugaugagcgccgccaucaaggacuccaaggccgugcacgccgacaugggcuacuggaucgagagcgagaagaacgagaccuggaagcucgcgcgggccuccuucaucgaggucaagaccugcaucuggcccaagagccacacgcugugguccaacggcgugcuggagagcgagaugaucauccccaagaucuacgggggcccgaucucccagcacaacuaccgccccggguacuucacccagaccgccggccccuggcaccucgggaagcuggagcuggacuucgaccucugcgagggcaccacgguggucguggacgagcacugcggcaaccgggggccgagccugcgcaccaccaccgugacgggcaagaucauccacgaguggugcugccgguccugcacccugccgccccugcgcuucaagggggaggacggcugcugguacgggauggagauccggcccgucaaggagaaggaggagaaccuggucaagagcauggugagcgccggcuccggcgaggucgacagcuucucccuggggcuccugugcaucagcaucaugaucgaggaggugaugcgcucccgguggagccgcaagaugcugaugaccggcacccucgccguguucuuccugcugaucauggggcagcucacguggaacgaccugauccggcugugcaucauggucggcgcgaacgccuccgaccgcauggggaugggcaccaccuaccucgcccugauggccaccuucaagaugcgcccgauguucgccgugggccuccuguuccggcgccugacgagccgggaggugcugcuccugaccaucgggcugucccucgucgcgagcguggagcugcccaacucccuggaggagcucggcgacgggcuggccaugggcaucaugauccugaagcuccugaccgacuuccagagccaccagcugugggccacccuccugucccugacguucaucaagaccaccuucagccuccacuacgccuggaagaccauggcgaugguccuguccaucgugagccuguucccccucugccuguccacgaccagccagaagaccaccuggcugcccgugcuccugggcucccuggggugcaagccgcucacgauguuccugaucgccgagaacaagaucuggggccgcaagagcuggccccugaacgaggggaucauggccgucggcaucgugagcauccuccuguccagccugcucaagaacgacgugccccuggccgggccccugaucgccggcggcaugcucaucgcgugcuacgucaucuccgggagcuccgccgaccugagccuggagaaggccgccgagguguccugggaggaggaggccgagcacagcggcgcgucccacaacauccucguggagguccaggacgacgggaccaugaagaucaaggacgaggagcgggacgacacccugaccauccugcucaaggccacccugcuggccgugagcggcguguacccgcucuccauccccgccacgcuguucgucugguacuucuggcagaagaagaagcagcgcagcggggugcugugggacacccccagcccgcccgagguggagcgggccguccucgacgacggcaucuaccgcaucaugcagcggggccugcuggggcgcagccaggugggcgugggggucuuccaggagaacguguuccacaccauguggcacgugacccggggcgcgguccugauguaccaggggaagcgccucgagcccuccugggccagcgugaagaaggaccugaucuccuacggcggcggguggcggcugcagggcagcuggaacacgggggaggaggugcaggucaucgccguggagcccggcaagaaccccaagaacgugcagaccgcccccgggaccuucaagaccuccgagggcgaggucggcgccaucgcgcucgacuucaagcccgggacgagcggcagccccaucgugaaccgcgaggggaagaucgugggccuguacggcaacggggucgugaccaccuccggcaccuacgugagcgccaucgcccaggccaaggcgucccaggaggggccccugccggagaucgaggacgaggucuuccggaagcgcaaccucacgaucauggaccugcaccccggcagcgggaagacccggcgcuaccugcccgccaucgugcgggaggccaucaagcgcaagcuccggacccugauccuggccccgacccgcguggucgccuccgagauggcggaggcccucaagggcaugcccauccgcuaccagacgaccgccgucaagagcgagcacaccggcaaggagaucguggaccugaugugccacgccaccuucacgaugcggcugcucucccccguccgcgugcccaacuacaacaugaucaucauggacgaggcccacuucaccgacccgagcuccaucgcggcccggggguacaucagcacccgcgugggcaugggggaggccgccgccaucuucaugaccgcgacgccgcccggcuccgucgaggccuucccccagagcaacgccgugauccaggacgaggagcgggacaucccggagcgcuccuggaacagcggguacgaguggaucaccgacuuccccggcaagaccgugugguucguccccuccaucaagagcggcaacgacaucgccaacugccugcggaagaacgggaagcgcgugauccagcugucccggaagaccuucgacacggaguaccagaagaccaagaacaacgacugggacuacguggucaccaccgacaucagcgagaugggcgcgaacuuccgcgccgaccgggugaucgacccccgccggugccucaagccggugauccugaaggacgggcccgagcgcgucauccuggccggccccaugcccgugacggucgccuccgccgcgcagcggcgcgggcggaucggccgcaaccacaacaaggagggcgaccaguacaucuacauggggcagccgcucaacaacgacgaggaccacgcccacuggaccgaggccaagaugcugcuggacaacaucaacacccccgagggcaucauccccgcccucuucgagcccgagcgggagaaguccgccgcgaucgacggggaguaccgccugcgcggcgaggcccggaagaccuucguggagcugaugcgccgcggggaccucccgguguggcugagcuacaaggucgccuccgagggcuuccaguacagcgaccgccgguggugcuucgacggcgagcgcaacaaccaggugcuggaggagaacauggacguggagaucuggacgaaggagggggagcggaagaagcuccgcccccgguggcuggacgcccgcaccuacuccgacccccuggcccuccgggaguucaaggaguucgcggccggccgccggagcgucuccggggaccugauccuggagaucggcaagcucccccagcaccugacccagcgcgcccagaacgcccuggacaaccucgugaugcugcacaacagcgagcagggcgggcgggcguaccgccacgccauggaggagcugccggacaccaucgagacgcucaugcugcuggcccucaucgccgugcugaccggcggggucacccuguucuuccucuccggccgggggcugggcaagaccagcaucggccugcucugcgugauggccuccagcgcgcugcuguggauggccuccguggagccccacuggaucgccgccagcaucauccucgaguucuuccugaugguccugcucauccccgagcccgaccgccagcggaccccgcaggacaaccagcuggccuacguggugaucgggcuccucuucaugauccugacggucgcggccaacgagaugggccugcucgagaccaccaagaaggaccuggggaucggccacguggccguggagaaccaccaccacgccgccaugcuggacgucgaccuccaccccgcguccgccuggacccuguacgccguggccacgaccaucaucacccccaugaugcgccacaccaucgagaacacgaccgccaacaucagccugaccgcgaucgccaaccaggccgccauccucauggggcuggacaagggcuggccgaucuccaagauggacaucggcgugccccugcucgcgcuggggugcuacagccaggucaacccccugacccucacggccgccgugcugaugcugguggcccacuacgccaucaucggccccgggcuccaggcgaaggccacccgggaggcccagaagcgcaccgccgccggcaucaugaagaacccgaccgucgacgggaucguggcgaucgaccuggaccccguggucuacgacgccaaguucgagaagcagcugggccagaucaugcuccugauccugugcacgucccagauccuccugaugcgcaccaccugggcccugugcgagagcaucacccucgccacgggcccccugaccacccugugggaggggucccccggcaaguucuggaacaccacgaucgccgugagcauggcgaacaucuuccgggggagcuaccucgccggcgccggccuggccuucucccugaugaagucccucgggggcgggcgccggggcaccggggcgcagggcgagacccugggcgagaaguggaagcgccagcugaaccagcucuccaagagcgaguucaacaccuacaagcgguccgggaucauggagguggaccgcagcgaggccaaggagggccugaagcgcggggagacgaccaagcacgccgucucccgcggcaccgccaagcugcggugguucguggagcgcaaccucgugaagccggaggggaaggucaucgaccugggcugcggccgcggcggguggagcuacuacugcgccgggcugaagaaggugaccgaggugaagggguacacgaagggcgggcccggccacgaggagcccauccccauggcgaccuacggguggaaccuggucaagcuccacuccggcaaggacguguucuucaucccgcccgagaagugcgacacccugcugugcgacaucggggagagcucccccaaccccaccaucgaggagggccgcacgcuccgggugcugaagauggucgagccguggcugcgcgggaaccaguucugcaucaagauccucaaccccuacaugcccagcgugguggagacccuggagcagaugcagcggaagcacggcggcaugcugguccgcaacccccucucccggaacagcacccacgagauguacuggguguccugcgggaccggcaacaucgugagcgccgucaacaugaccucccgcaugcugcugaaccgguucacgauggcccaccgcaagccgaccuacgagcgcgacguggaccucggggccggcacccggcacguggccgucgagcccgagguggcgaaccuggacaucaucggccagcgcaucgagaacaucaagcacgagcacaagagcaccuggcacuacgacgaggacaaccccuacaagacgugggccuaccacggguccuacgaggugaagcccagcggcagcgccuccagcauggucaacgggguggucaagcugcucaccaagccgugggacgugauccccauggugacccagaucgccaugaccgacacgacccccuucggccagcagcgggucuucaaggagaagguggacacccgcacccccaaggccaagcgggggacggcgcagaucauggaggugaccgccaaguggcuguggggcuuccugucccgcaacaagaagccgcggaucugcacccgcgaggaguucacccggaagguccgcagcaacgccgccaucggcgcgguguucguggacgagaaccaguggaacuccgccaaggaggccgucgaggacgagcgguucugggaccucgugcaccgcgagcgggagcugcacaagcaggggaagugcgccacgugcguguacaacaugaugggcaagcgcgagaagaagcugggggaguucggcaaggccaaggggagccgggcgaucugguacauguggcucggcgcccgcuuccuggaguucgaggcccugggcuucaugaacgaggaccacugguucucccgggagaacagccucuccggggucgagggcgaggggcugcacaagcugggcuacauccuccgcgacaucagcaagauccccgggggcaacauguacgccgacgacaccgccggcugggacacccggaucaccgaggacgaccugcagaacgaggcgaagaucacggacaucauggagcccgagcacgcccugcucgccaaguccaucuucaagcugaccuaccagaacaagguggugcgcguccagcggccggccaagaacgggaccgugauggacgugaucagccgccgcgaccagcggggcuccgggcaggucggcaccuacggccugaacacguucaccaacauggaggcccagcucauccgccagauggagagcgaggggaucuucucccccagcgagcuggagacccccaaccuggcgggccgggugcucgacuggcuggagaagcacgggguggagcgccugaagcggauggccaucuccggcgacgacugcgucgugaagcccaucgacgaccgcuucgccaccgcccucacggcccugaacgacauggggaaggugcggaaggacaucccgcagugggagcccagcaagggcuggaacgacuggcagcagguccccuucugcagccaccacuuccaccagcugaucaugaaggacggccgcgagaucguggugcccugccggaaccaggacgagcucgucgggcgcgcgcgggugucccagggcgccggguggagccugcgcgagaccgccugccugggcaaguccuacgcccagauguggcagcucauguacuuccaccggcgcgaccugcggcuggcggccaacgccaucugcagcgccgugccggucgacugggugcccaccucccgcaccacguggagcauccacgcccaccaccaguggaugaccaccgaggacaugcucuccguguggaaccgggucuggaucgaggagaaccccuggauggaggacaagacccacaucagcuccuggggcgacgugcccuaccugggcaagcgcgaggaccaguggugcggcagccugaucgggcucacggcgcgggccaccugggccaccaacauccagguggccaucaaccagguccgccgccugaucggcaacgagaacuaccuggacuacaugaccuccaugaagcgguucaagaacgagagcgacccggagggggcccucugguga

SEQ ID NO: 8575 - RNA, 9879 nt, Artificial Sequence
  derived and/or modified CDS sequence (opt1) from DENV-1__FJ898407__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgagguggagcccgacgacguggacugcuggugcaacaccacggacaccugggugaccuacgggaccugcagccagacgggcgagcaccggcgcgacaagcggagcguggcccucgcgccccacgucggccuggggcuggagacccgggccgagaccuggaugagcuccgagggcgccuggaagcagauccagaagguggagaccugggcccuccggcaccccggguucacggugaucgcccuguuccuggcccacgcgaucggcaccagcaucacccagaaggggaucaucuucauccuccugaugcuggucacccccuccauggccaugcgcugcgugggcaucggcagccgggacuucguggaggggcucuccggcgccacgugggucgacguggugcuggagcacgggagcugcgucaccaccauggccaaggacaagcccacccuggacaucgagcuccugaagacggaggugaccaaccccgccgugcugcgcaagcucugcaucgaggcgaagaucuccaacaccaccacggacagccggugcccgacccagggcgaggccacccuggucgaggagcaggacgccaacuucgugugccgccggaccuucguggaccgcggcugggggaacggcugcgggcuguucggcaaggggucccucaucacgugcgccaaguucaagugcgucaccaagcuggagggcaagaucgugcaguacgagaaccugaaguacagcgugaucgucaccgugcacaccggcgaccagcaccaggucgggaacgaguccacggagcacggcaccaccgccaccaucacgccccaggcgcccacgagcgagauccagcucaccgacuacggggcccugacccuggacugcagcccccggaccggccucgacuucaacgagauggugcugcugacgaugaaggagaaguccuggcucgugcacaagcagugguuccuggaccugccccuccccuggaccagcggggccuccaccagccaggagaccuggaaccgccaggaccugcuggucacguucaagaccgcccacgccaagaagcaggagguggugguccucggcucccaggagggcgcgaugcacaccgcccugaccggggccacggagauccagaccagcggcaccaccacgaucuucgccgggcaccugaagugccggcucaagauggacaagcugacccugaagggcauguccuacgugaugugcaccgggagcuucaagcucgagaaggagguggccgagacccagcacggcacgguccuggugcagaucaaguacgagggcaccgacgcgcccugcaagauccccuucuccacccaggacgagaagggggugacccagaacggccgccugaucacggccaacccgaucgucaccgacaaggagaagcccgugaacaucgaggccgagccgcccuucggggagagcuacaucgugaucggcgccggcgagaaggcgcugaagcucuccugguucaagaaggggagcuccaucggcaagauguucgaggccaccgcccgcggggcccgccggauggccauccugggcgacaccgcgugggacuucgggagcaucggcggcgucuucacguccguggggaagcuggugcaccagaucuucggcaccgccuacgggguccucuucagcggcguguccuggaccaugaagaucgggaucggcgugcugcugaccuggcucggccugaacagccgcuccacgagccuguccaugaccugcaucgccgucgggcucgugacccuguaccugggcgugaugguccaggccgacagcgggugcgugaucaacuggaagggccgcgagcucaagugcgggagcggcaucuucgugaccaacgagguccacacguggaccgagcaguacaaguuccaggccgacuccccgaagcggcugagcgcggccaucggcaaggccugggaggagggggugugcggcauccgcuccgccacccggcuggagaacaucauguggcgccagaucagcaacgagcucaaccacauccugcuggagaacgacaugaaguucaccguggucgugggggacguggucggcauccucgcccaggggaagaagaugauccggccccagcccauggagcacaaguacuccuggaaguccuggggcaaggcgaagaucaucggcgccgacgugcagaacaccacguucaucaucgacgggcccaacaccccggagugccccgacgaccagcgcgccuggaacaucugggagguggaggacuacggcuucgggaucuucaccaccaacaucuggcugaagcugcgggacuccuacacgcaggucugcgaccaccgccucaugagcgccgcgaucaaggacuccaaggccgugcacgccgacaugggcuacuggaucgagagcgagaagaacgagaccuggaagcuggcccgggccuccuucaucgaggugaagaccugcaucuggcccaagagccacacccugugguccaacggcguccucgagagcgagaugaucauccccaagaucuacgggggcccgaucucccagcacaacuaccgccccggguacuucacgcagaccgcgggccccuggcaccuggggaagcuggagcucgacuucgaccugugcgagggcaccaccgugguggucgacgagcacugcggcaaccgggggccgagccugcgcacgaccaccgugaccggcaagaucauccacgaguggugcugccgguccugcacgcugccgccccuccgcuucaagggggaggacggcugcugguacgggauggagauccggcccgugaaggagaaggaggagaaccuggucaagagcauggugagcgccggcuccggcgagguggacagcuucucccucgggcugcugugcaucagcaucaugaucgaggaggucaugcgcucccgguggagccgcaagaugcucaugaccggcacccuggccguguucuuccugcucaucauggggcagcugaccuggaacgaccugauccgguccugcaucauggugggcgccaacgccagcgaccgcauggggaugggcacgaccuaccucgcgcugauggccaccuucaagaugcgcccgauguucgccgucggccugcuguuccggcgccugaccucccgggaggugcugcuccugacgaucgggcugagccucgucgccuccguggagcugcccaacagccuggaggagcucggcgacgggcuggccaugggcaucaugauccugaagcuccugaccgacuuccaguccuaccagcugugggcgacccuccugagccugaccuucaucaagacgaccuucucccuccacuacgccuggaagaccauggccauggugcugagcaucgucucccugcucccccugugccugagcaccacgucccagaagaccaccuggcuccccgugcugcugggcagccucgggugcaagccgcugaccauguuccugaucgccgagaacaagaucuggggccgcaagagcuggccccucaacgaggggaucauggcggugggcaucgucuccauccugcugagcucccuccugaagaacgacgugccccuggccgggccccucaucgccggcggcaugcugaucgccugcuacgugaucagcggguccagcgccgaccugucccucgagaaggcggccgaggucagcugggaggaggaggccgagcacuccggcgccagccacaacauccugguggaggugcaggacgacgggacgaugaagaucaaggacgaggagcgggacgacacccugaccauccuccugaaggccacccugcucgcggucuccggcguguacccgcugagcauccccgccacccuguucgugugguacuucuggcagaagaagaagcagcgcuccgggguccucugggacacgcccagcccgcccgagguggagcgggccgugcuggacgacggcaucuaccgcaucaugcagcggggccugcuggggcgcucccaggucggcguggggguguuccaggagaacgucuuccacaccauguggcacgugacccggggcgccgugcucauguaccaggggaagcgccuggagcccagcugggccuccgucaagaaggaccugaucagcuacggcggcggguggcggcuccagggcuccuggaacaccggggaggagguccaggugaucgcggucgagcccggcaagaaccccaagaacgugcagacggcccccgggaccuucaagacccccgagggcgaggugggcgccaucgcccuggacuucaagcccgggaccagcggcagccccaucgucaaccgcgaggggaagaucgugggccuguacggcaacgggguggucacgaccuccggcaccuacgugagcgccaucgcgcagaccaaggccucccaggaggggccgcuccccgagaucgaggacgagguguuccggaagcgcaaccugacgaucauggaccugcaccccggcagcgggaagacccggcgcuaccucccggccaucguccgggaggccaucaagcgcaagcugcggacccugauccucgcgcccacccgcgugguggccuccgagauggccgaggcccugaagggcaugcccauccgcuaccagacgaccgccgucaagagcgagcacaccggccgggagaucguggaccugaugugccacgcgaccuucacgaugcgccuccugucccccgugcgggucccgaacuacaacaugaucaucauggacgaggcccacuucaccgaccccagcuccaucgccgcccgcggguacaucagcacccgggugggcaugggggaggccgcggccaucuucaugaccgccacgccgcccggcuccguggaggccuucccgcagagcaacgccgucauccaggacgaggagcgcgacauccccgagcgguccuggaacagcggguacgaguggaucaccgacuuccccggcaagaccgugugguucgugcccuccaucaagagcggcaacgacaucgcgaacugccugcgcaagaacgggaagcgggucauccagcucucccgcaagaccuucgacacggaguaccagaagaccaagaacaacgacugggacuacguggugaccaccgacaucagcgagaugggcgccaacuuccgggccgaccgcgucaucgacccgcggcgcugccugaagcccgugauccugaaggacgggcccgagcgggucauccucgccggccccaugccggugacgguggcguccgccgcccagcgccgggggcgcaucggccggaaccacaacaaggagggcgaccaguacaucuacauggggcagccccugaacaacgacgaggaccacgcccacuggaccgaggccaagaugcugcucgacaacaucaacacccccgagggcaucauccccgcgcuguucgagccggagcgcgagaaguccgccgccaucgacggggaguaccgccugcggggcgaggcccgcaagaccuucgucgagcucaugcggcgcggggaccugcccguguggcugagcuacaagguggccuccgagggcuuccaguacagcgaccggcgcuggugcuucgacggcgagcggaacaaccagguccucgaggagaacauggacguggagaucuggacgaaggagggggagcgcaagaagcugcggccccgcuggcuggacgcgcggaccuacuccgacccccucgcccugcgcgaguucaaggaguucgccgccggccggcgcagcguguccggggaccugauccucgagaucggcaagcugccgcagcaccugacccagcgggcccagaacgcgcucgacaaccuggucaugcugcacaacagcgagcagggcgggcgcgccuaccggcacgccauggaggagcuccccgacaccaucgagacgcugaugcugcucgcccugaucgcggugcugaccggcggggugacccucuucuuccuguccggccgcgggcugggcaagaccagcaucggccuccugugcgucauggccuccagcgcccugcucuggauggccuccguggagccccacuggaucgccgcgagcaucauccuggaguucuuccugauggugcuccugauccccgagccggaccggcagcgcacgccccaggacaaccagcuggccuacgucgugaucgggcuccuguucaugauccugacgguggccgccaacgagaugggccuccuggagaccaccaagaaggaccuggggaucggccacgucgccguggagaaccaccaccacgcgaccaugcucgacguggaccugcaccccgccuccgccuggacgcuguacgccgucgccaccaccaucaucaccccgaugaugcggcacacgaucgagaacaccaccgcgaacaucagccucaccgccaucgccaaccaggccgccauccugauggggcuggacaagggcuggcccaucuccaagauggacaucggcgugccccuccuggcgcuggggugcuacagccaggugaacccccucacgcugaccgccgccguccugaugcucguggcccacuacgcgaucaucggcccggggcugcaggccaaggccacccgcgaggcccagaagcgcaccgccgcgggcaucaugaagaaccccacgguggacgggaucgucgccaucgaccuggaccccgugguguacgacgccaaguucgagaagcagcucggccagaucaugcugcugauccucugcaccucccagauccugcugaugcggaccaccugggcccucugcgagagcaucacgcuggccaccggcccccugaccacccucugggagggguccccgggcaaguucuggaacacgaccaucgcggucagcauggccaacaucuuccgcgggagcuaccuggccggcgccggccuggccuucucccucaugaagucccucgggggcgggcggcgcgggaccggggcgcagggcgagacccugggcgagaaguggaagcggcagcucaaccagcuguccaagagcgaguucaacacguacaagcgcuccgggaucauggagguggaccggagcgaggccaaggagggccugcgccgcggggagaccaccaagcacgccgugucccgcggcaccgccaagcuccggugguucgucgagcgcaaccuggugaagcccgaggggaaggugaucgaccugggcugcggccgcggcggguggagcuacuacugcgcggggcugaagaaggucacggaggugaagggguacaccaagggcgggcccggccacgaggagcccaucccgauggccaccuacggguggaaccucgugaagcugcacuccggcaaggacgucuucuucaucccgcccgagaagugcgacacccugcucugcgacaucggggagagcucccccaacccgacgaucgaggagggccgcacccugcgggugcugaagaugguggagcccuggcuccgcgggaaccaguucugcaucaagauccugaaccccuacaugcccagcgucguggagacccuggagcagaugcagcggaagcacggcggcaugcucgugcgcaacccgcugucccggaacagcacccacgagauguacugggucuccugcgggaccggcaacaucgugagcgccgugaacaugacgucccgcaugcugcucaaccgcuucaccauggcccaccggaagcccaccuacgagcgcgacgucgaccugggggccggcacccggcacguggcgguggagcccgaggucgccaaccuggacaucaucggccagcgcaucgagaacaucaagcacgagcacaagagcacguggcacuacgacgaggacaaccccuacaagaccugggccuaccacggguccuacgaggugaagccgagcggcagcgccuccagcauggucaacgggguggugaagcuccugaccaagcccugggacgucauccccauggugacccagaucgccaugacggacaccacccccuucggccagcagcggguguucaaggagaaggucgacacccgcacgccgaaggcgaagcgggggaccgcccagaucauggaggugaccgcccgcuggcuguggggcuuccucucccggaacaagaagccccgcaucugcacccgggaggaguucacgcgcaaggugcggagcaacgccgccaucggcgcggucuucguggacgagaaccaguggaacuccgccaaggaggccguggaggacgagcgcuucugggaccugguccaccgggagcgcgagcugcacaagcaggggaagugcgcgaccugcguguacaacaugaugggcaagcgggagaagaagcucggggaguucggcaaggcgaaggggagccgcgccaucugguacauguggcugggcgcccgguuccuggaguucgaggcccucggcuucaugaacgaggaccacugguucucccgcgagaacagccuguccgggguggagggcgaggggcugcacaagcucggcuacauccugcgggacaucagcaagauccccgggggcaacauguacgccgacgacaccgcgggcugggacacccgcaucacggaggacgaccugcagaacgaggccaagaucaccgacaucauggagccggagcacgcccuccuggccaccuccaucuucaagcugaccuaccagaacaaggucgugcgcgugcagcggcccgcccgcaacgggacggucauggacgugaucagccggcgcgaccagcggggcuccggccaggugggcaccuacggccucaacaccuucaccaacauggaggcgcagcugauccgccagauggagagcgaggggaucuucucccccagcgagcuggagacgcccaaccucgccgagcggguccuggacuggcuggagaagcacggcguggagcgccucaagcggauggccaucuccggggacgacugcguggucaagccgaucgacgaccgcuucgccaccgcccugagcgcgcugaacgacaugggcaaggugcggaaggacaucccccagugggagcccagcaagggguggaacgacuggcagcagguccccuucugcucccaccacuuccaccagcucaucaugaaggacggccgcgagaucgucgugccgugccggaaccaggacgagcuggugggccgcgcccgggucagccagggggccggcuggucccugcgcgagaccgccugccucggcaagagcuacgcccagauguggcagcugauguacuuccaccggcgcgaccugcggcucgcggccaacgccaucugcuccgccgugcccguggacuggguccccaccagccgcacgaccugguccauccacgcgcaccaccaguggaugaccaccgaggacaugcugagcguguggaaccgcguguggaucgaggagaaccccuggauggaggacaagacgcacaucuccagcuggggcgacgucccguaccuggggaagcgggaggaccaguggugcggcucccucaucggccugaccgcccgcgccaccugggccaccaacauccagguggccaucaaccaggugcggcgccugaucgggaacgagaacuaccucgacuacaugaccagcaugaagcgguucaagaacgaguccgaccccgagggcgcgcugugguga

SEQ ID NO: 8576 - RNA, 9879 nt, Artificial Sequence
  derived and/or modified CDS sequence (opt1) from DENV-1__FJ898408__SS-prME
agcgugaccaugcugcucaugcugaugcccaccgcccuggccuuccaccucaccacccggggcggggagccccacaugaucgugaccaagcaggagcggggcaagagccugcuguucaagaccagcgcgggggugaacaugugcacccucaucgccauggaccugggcgagcugugcgaggacaccaugaccuacaagugcccccgcaucaccgaggccgagcccgacgacguggacugcuggugcaacgccaccgacaccugggugaccuacgggaccugcagccagacgggcgagcaccggcgcgacaagcggagcguggcccucgcgccccacgugggccuggggcuggagacccgcaccgagaccuggauguccagcgagggcgccuggaagcagauccagcggguggagacgugggcccuccgccaccccggguucaccgugaucgcccuguuccuggcgcacgccaucggcaccuccaucacccagaaggggaucaucuucauccuccugaugcuggugacgcccagcauggccaugcggugcgucggcaucggcucccgcgacuucguggaggggcucagcggcgccaccuggguggacgucgugcuggagcacggguccugcgugaccaccauggccaaggacaagcccacgcuggacaucgagcuccugaagaccgaggucaccaaccccgcggugcugcggaagcucugcaucgaggccaagaucagcaacaccacgaccgacucccgcugccccacccagggcgaggccacccugauggaggagcaggacgccaacuucgugugccggcgcacguucgucgaccggggcugggggaacggcugcgggcuguucggcaaggggagccucaucacgugcgccaaguucaagugcgugaccaagcuggagggcaagaucgugcaguacgagaaccugaaguacuccgucaucgugaccgugcacacgggcgaccagcaccaggucgggaacgagagcaccgagcacggcaccaccgcgaccaucacgccccaggcccccaccuccgagauccagcucaccgacuacggggcccugacccuggacugcagcccccgcacgggccucgacuucaacgagauggugcugcugaccaugaaggagaaguccuggcucguccacaagcagugguuccuggaccugccgcuccccuggaccagcggggccagcaccucccaggagacguggaaccggcaggaccugcuggugaccuucaagaccgcccacgcgaagaagcaggagguggucgugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgugaugugcaccggguccuucaagcucgagaaggaggucgcggagacgcagcacggcaccgugcuggugcagaucaaguacgagggcaccgacgcccccugcaagauccccuucagcacccaggacgagaagggggucacgcagaacggccggcugaucaccgccaacccgaucgugaccgacaaggagaagcccgugaacaucgaggccgagccgcccuucggggaguccuacaucgucaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcguggggaagcugguccaccagaucuucggcaccgccuacgggguccuguucuccggcgugagcuggaccaugaagaucgggaucggcguccugcugacguggcucggccugaacucccgcagcaccucccugagcaugaccugcaucgccguggggcucgugacccuguaccugggcgucauggugcaggccgacuccgggugcgugaucaacuggaagggccgggagcucaagugcgggagcggcaucuucgucacgaacgaggugcacaccuggaccgagcaguacaaguuccaggcggacagcccgaagcgccuguccgccgccaucggcaaggccugggaggagggggugugcggcauccggagcgccacccgccuggagaacaucauguggaagcagaucuccaacgagcucaaccacauccugcuggagaacgggaugaaguucaccgucguggugggcgacgucguggggauccucgcgcagggcaagaagaugauccggccccagcccauggagcacaaguacagcuggaaguccuggggcaaggccaagaucaucggggccgacgugcagaacacgaccuucaucaucgacggccccaacaccccggagugccccgacgaccagcgcgccuggaacaucugggaggucgaggacuacggguucggcaucuucaccacgaacaucuggcugaagcugcgggacagcuacacccaggugugcgaccaccgccucauguccgcggccaucaaggacagcaaggccgugcacgccgacaugggcuacuggaucgaguccgagaagaacgagaccuggaagcuggcccgggcgagcuucaucgaggucaagaccugcaucuggcccaagucccacacgcuguggagcaacggggugcucgaguccgagaugaucauccccaagaucuacggcgggccgaucagccagcacaacuaccgccccggcuacuucacccagaccgccgggcccuggcaccugggcaagcuggagcucgacuucgaccugugcgagggcaccacgguggucguggacgagcacugcgggaaccggggcccgucccugcgcaccaccaccgugacggggaagaucauccacgaguggugcugccggagcugcacccugccgccccuccgcuucaagggcgaggacgggugcugguacggcauggagauccggcccgucaaggagaaggaggagaaccuggugaaguccauggugagcgccggcagcggggaggucgacuccuucagccucggccugcugugcaccuccaucaugaucgaggaggugaugcgcagccgguggucccgcaagaugcucaugaccgggacgcuggccguguuccugcuccugaucaugggccagcugaccuggaacgaccucauccggcugugcaucauggucggggccaacgcgagcgaccgcaugggcaugggcaccaccuaccuggcccucauggccacguucaagaugcgcccgauguucgccguggggcugcuguuccggcgccucaccucccgggaggugcugcugcucaccaucggccugagccuggucgccuccguggagcuccccaacagccuggaggagcugggggacggccucgcgaugggcaucaugauccugaagcugcucaccgacuuccagucccaccagcugugggccacgcugcucagccugaccuucaucaagaccacccugucccuccacuacgccuggaagacgauggccaugguccugagcaucgugucccuguucccccucugccugagcaccaccucccagaagaccacguggcugcccgugcuccuggggagccugggcugcaagccgcucaccauguuccugaucgcggagaacaagaucugggggcgcaaguccuggccccugaacgagggcaucauggccgucgggguggugagcauccuccugagcucccugcucaagaacgacgucccccuggccggcccccugaucgccggcgggaugcucaucgccugcuacgugaucagcggcuccagcgcggaccugucccuggagaaggccgccgaggugagcugggaggaggaggccgagcacuccggggccagccacaacauccucgucgaggugcaggacgacggcaccaugaagaucaaggacgaggagcgggacgacacccugaccauccugcucaaggcgacgcugcuggccguguccggggucuacccgcucagcauccccgccacccuguucgugugguacuucuggcagaagaagaagcagcgcuccggcgugcugugggacacccccagcccgcccgaggucgagcgggccgugcuggacgacggcaucuaccgcaucaugcagcgggggcuccugggccgcucccaggugggggucggcguguuccaggagaacguguuccacaccauguggcacgucacgcgcggggccgugcugauguaccagggcaagcgccucgagcccagcugggcguccgugaagaaggaccugaucagcuacggcgggggcuggcggcugcagggguccuggaacaccggcgaggagguccaggugaucgccguggagcccgggaagaaccccaagaacguccagaccgcccccggcaccuucaagacgcccgagggcgaggugggggccaucgcccucgacuucaagcccggcaccagcgggucccccaucgugaaccgcgagggcaagaucgucggccuguacgggaacggcguggugaccaccagcgggacguacgucagcgcgaucgcccaggccaaggccucccaggagggcccgcugcccgagaucgaggacgagguguuccggaagcgcaaccucaccaucauggaccugcaccccgggagcggcaagacccggcgcuaccugccggcgaucgugcgggaggccaucaagcgcaagcuccggacccugauccuggcccccacgcgcgucguggccuccgagauggccgaggcgcucaagggcaugcccauccgcuaccagaccaccgccgucaagagcgagcacaccgggaaggagaucgucgaccugaugugccacgccacguucaccaugcggcugcucucccccgugcgcgugccgaacuacaacaugaucaucauggacgaggcccacuucaccgaccccagcuccaucgccgcgcggggcuacaucagcacccgcgucgggaugggcgaggccgccgccaucuucaugacggccacgccgcccggguccguggaggcguucccgcagagcaacgccgugauccaggacgaggagcgggacauccccgagcgcuccuggaacagcggcuacgaguggaucaccgacuuccccggcaagaccgucugguucgugcccuccaucaagagcgggaacgacaucgccaacugccugcggaagaacggcaagcgcgugauccagcugucccggaagacguucgacaccgaguaccagaagaccaagaacaacgacugggacuacgucgugaccacggacaucagcgagaugggggccaacuuccgcgcggaccgggugaucgacccgcgccggugccucaagcccgucauccugaaggacggccccgagcgcgugauccuggccgggcccaugccggucaccguggccuccgccgcccagcggcgcggccggaucggccgcaaccacaacaaggagggggaccaguacaucuacaugggccagccccucaacaacgacgaggaccacgcgcacuggaccgaggccaagaugcugcuggacaacaucaacacccccgaggggaucauccccgcccucuucgagccggagcgggagaaguccgccgccaucgacggcgaguaccgccugcgcggggaggcgcggaagacguucguggagcugaugcgccggggcgaccuccccgucuggcuguccuacaagguggccagcgagggcuuccaguacagcgaccgccgguggugcuucgacggggagcgcaacaaccaggugcuggaggagaacauggacgucgagaucuggaccaaggagggcgagcggaagaagcuccgcccccgguggcuggacgcccgcaccuacuccgacccccuggcccuccgggaguucaaggaguucgccgcggggcgccggagcguguccggcgaccugauccuggagaucggcaagcucccgcagcaccugacccagcgcgcccagaacgcccuggacaaccucgugaugcugcacaacagcgagcagggcgggcgggccuaccgccacgcgauggaggagcugcccgacacgaucgagacccucaugcugcuggcccucaucgccguccugaccgggggcgugacccuguucuuccucuccgggcggggccugggcaagaccagcaucgggcugcucugcgugauggccuccagcguccugcuguggauggccuccguggagccccacuggaucgcggccagcaucauccucgaguucuuccugauggugcugcucauccccgagccggaccgccagcggacgccccaggacaaccagcuggccuacgucgugaucggccuccucuucaucauccugaccguggccgccaacgagauggggcugcucgagaccaccaagaaggaccugggcaucgggcacgucgcgguggagaaccaccaccacgccacgaugcuggacguggaccuccaccccgccuccgccuggacccuguacgccgucgcgaccaccaucaucacgccgaugaugcgccacaccaucgagaacaccaccgccaacaucagccugacggccaucgccaaccaggccgcgauccucaugggccuggacaagggcuggcccaucuccaagauggacaucggggugccccugcucgcccugggcugcuacagccaggugaacccccugacccucaccgccgccguccugaugcugguggcgcacuacgccaucaucgggccgggccuccaggccaaggccacccgggaggcccagaagcgcacggcggccgggaucaugaagaaccccaccguggacggcaucgucgccaucgaccuggaccccgugguguacgacgccaaguucgagaagcagcugggccagaucaugcuccugauccugugcaccucccagauccuccugaugcgcaccacgugggcccugugcgagagcaucacccucgcgaccgggccccugaccacgcugugggagggcuccccggggaaguucuggaacaccaccaucgccgucagcauggccaacaucuuccggggcuccuaccucgccggcgccgggcuggcguucagccugaugaagucccucggcgggggccgccgggggaccggcgcccagggcgagacgcugggggagaaguggaagcgccagcugaaccagcucuccaagagcgaguucaacaucuacaagcgguccggcaucauggagguggaccgcagcgaggccaaggaggggcugaagcggggcgagaccacccgccacgccgugucccgggggaccgcgaagcugcgcugguucgucgagcggaaccuggugaagcccgagggcaaggugaucgaccucggcugcgggcgcggcggguggagcuacuacugcgccggccugaagaaggucacggaggugaagggguacaccaagggcggccccgggcacgaggagcccaucccgauggccaccuacggcuggaaccuggugaagcuccacuccgggaaggacgucuucuucacgccgcccgagaagugcgacacgcugcugugcgacaucggcgagagcucccccaacccgaccaucgaggaggggcggacccuccgcgugcugaagaugguggagcccuggcugcggggcaaccaguucugcaucaagauccucaaccccuacaugcccagcgucguggagacccuggagcagaugcagcgcaagcacggcgggaugcuggugcggaacccgcucucccgcaacagcacccacgagauguacugggucuccugcggcacggggaacaucgugagcgccgugaacaugaccucccggaugcugcugaaccgcuucaccauggcccaccgcaagcccaccuacgagcgggacgucgaccucggcgcgggcacgcgccacguggccguggagcccgaggucgccaaccuggacaucaucgggcagcggaucgagaacaucaagcacgagcacaagagcaccuggcacuacgacgaggacaaccccuacaagaccugggccuaccacggcuccuacgaggugaagccgagcggguccgccagcagcauggucaacggcguggugaagcugcucaccaagcccugggacgucauccccauggugacgcagaucgcgaugaccgacaccacccccuucgggcagcagcgcguguucaaggagaaggucgacacgcggaccccgaaggccaagcgcggcaccgcccagaucauggaggugaccgcccgguggcuguggggcuuccugucccgcaacaagaagccccggaucugcacgcgcgaggaguucacccggaaggugcgcagcaacgccgcgaucggggccgucuucguggacgagaaccaguggaacuccgccaaggaggccguggaggacgagcgguucugggaccucguccagaaggagcgcgagcugcacaagcagggcaagugcgcgaccugcguguacaacaugauggggaagcgggagaagaagcugggcgaguucgggaaggccaagggcagccgcgccaucugguacauguggcucggcgcccgguuccuggaguucgaggcccugggguucaugaacgaggaccacugguucucccgcgagaacagccucuccggcguggagggggagggccugcacaagcugggguacauccuccgggacaucagcaagauccccggcggcaacauguacgcggacgacaccgccgggugggacacgcgcaucaccgaggacgaccugcagaacgaggccaagaucaccgacaucauggagccggagcacgcccugcucgccaccuccaucuucaagcugacguaccagaacaaggucgugcgggugcagcgccccgcgaagaacggcaccgucauggacgugaucagccgccgggaccagcgcggguccggccaggugggcaccuacgggcugaacaccuucacgaacauggaggcccagcucauccggcagauggagagcgagggcaucuuccugcccuccgagcuggagacccccaaccucgccgagcgcguccuggacuggcuggagaaguacgggguggagcggcucaagcgcauggccaucagcggcgacgacugcguggucaagccgaucgacgaccgguucgccaccgcgcugaccgcccugaacgacauggggaaggugcgcaaggacaucccccagugggagcccuccaagggcuggaacgacuggcagcagguccccuucugcagccaccacuuccaccagcucaucaugaaggacggccgggagaucgucgugccgugccgcaaccaggacgagcugguggggcgggcccgcgucucccagggcgccggguggagccugcgggagacggccugccucggcaagagcuacgcgcagauguggcagcugauguacuuccaccgccgggaccugcgccucgccgccaacgccaucugcuccgcggaccccggggacugggugcccaccagccggaccaccugguccauccacgcccaccaccaguggaugacgaccgaggacaugcugagcguguggaaccgcgucuggaucgaggagaaccccuggauggaggacaagacccacguguccagcuggggcgacgugccguaccugggcaagcgggaggaccaguggugcgggucccucaucggccugaccgcccgcgccaccugggccagcaacauccaggucgcgaucaaccaggugcgccggcugaucgggaacgagaacuaccucgacuacaugacguccaugaagcgcuucaagaacgagggcgaccccgagggggcccugugguga

SEQ ID NO: 8577 - RNA, 9879 nt, Artificial Sequence
  derived and/or modified CDS sequence (opt1) from DENV-1__GQ199843__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgagguggagcccgacgacguggacugcuggugcaacaccaccgacaccugggugaccuacgggaccugcagccagacgggcgagcaccggcgcgacaagcggagcguggcccucgcgccccacgucggccuggggcuggagacccgggccgagaccuggaugagcuccgagggcgcguggaagcagauccagaagguggagaccugggcccuccggcaccccggguucacggugaucgcccuguuccuggcccacgcgaucggcaccagcaucacccagaaggggaucaucuucauccuccugaugcuggucacccccuccauggccaugcgcugcgugggcaucggcagccgggacuucguggaggggcucuccggcgccacgugggucgacguggugcuggagcacgggagcugcgucaccaccauggccaaggacaagcccacccuggacaucgagcuccugaagacggaggugaccaaccccgccgugcugcgcaagcucugcaucgaggcgaagaucuccaacaccaccacggacagccggugcccgacccagggcgaggccacccuggucgaggagcaggacgccaacuucgugugccgccggaccuucguggaccgcggcugggggaacggcugcgggcuguucggcaaggggucccucaucacgugcgccaaguucaagugcgucaccaagcuggagggcaagaucgugcaguacgagaaccugaaguacagcgugaucgucaccgugcacaccggcgaccagcaccaggucgggaacgaguccacggagcacggcaccaccgccaccaucacgccccaggcgcccacgagcgagauccagcucaccgacuacggggcccugacccuggacugcagcccccggaccggccucgacuucaacgagauggugcugcugacgaugaaggagaaguccuggcucgugcacaagcagugguuccuggaccugccccuccccuggaccagcggggccuccaccagccaggagaccuggaaccgccaggaccugcuggucacguucaagaccgcccacgccaagaagcaggagguggugguccucggcucccaggagggcgcgaugcacaccgcccugaccggggccacggagauccagaccagcggcaccaccacgaucuucgccgggcaccugaagugccggcucaagauggacaagcugacccugaagggcauguccuacgugaugugcaccgggagcuucaagcucgagaaggagguggccgagacccagcacggcacgguccuggugcagaucaaguacgagggcaccgacgcgcccugcaagauccccuucuccacccaggacgagaagggggugacccagaacggccgccugaucacggccaacccgaucgucaccgacaaggagaagcccgugaacaucgaggccgagccgcccuucggggagagcuacaucgugaucggcgccggcgagaaggcgcugaagcucuccugguucaagaaggggagcuccaucggcaagauguucgaggccaccgcccgcggggcccgccggauggccauccugggcgacaccgcgugggacuucgggagcaucggcggcgucuucacguccguggggaagcuggugcaccagaucuucggcaccgccuacgggguccucuucagcggcguguccuggaccaugaagaucgggaucggcgugcugcugaccuggcucggccugaacagccgcuccacgagccuguccaugaccugcaucgccgucgggcucgugacccuguaccugggcgugaugguccaggccgacagcgggugcgugaucaacuggaagggccgcgagcucaagugcgggagcggcaucuucgugaccaacgagguccacacguggaccgagcaguacaaguuccaggccgacuccccgaagcggcugagcgcggccaucggcaaggccugggaggagggggugugcggcauccgcuccgccacccggcuggagaacaucauguggcgccagaucagcaacgagcucaaccacauccugcuggagaacgacaugaaguucaccguggucgugggggacguggucggcauccucgcccaggggaagaagaugauccggccccagcccauggagcacaaguacuccuggaaguccuggggcaaggcgaagaucaucggcgccgacgugcagaacaccacguucaucaucgacgggcccaacaccccggagugccccgacgaccagcgcgccuggaacaucugggagguggaggacuacggcuucgggaucuucaccaccaacaucuggcugaagcugcgggacuccuacacgcaggucugcgaccaccgccucaugagcgccgcgaucaaggacuccaaggccgugcacgccgacaugggcuacuggaucgagagcgagaagaacgagaccuggaagcuggcccgggccuccuucaucgaggugaagaccugcaucuggcccaagagccacacccugugguccaacggcguccucgagagcgagaugaucauccccaagaucuacgggggcccgaucucccagcacaacuaccgccccggguacuucacgcagaccgcgggccccuggcaccuggggaagcuggagcucgacuucgaccugugcgagggcaccaccgugguggucgacgagcacugcggcaaccgggggccgagccugcgcacgaccaccgugaccggcaagaucauccacgaguggugcugccgguccugcacgcugccgccccuccgcuucaagggggaggacggcugcugguacgggauggagauccggcccgugaaggagaaggaggagaaccuggucaagagcauggugagcgccggcuccggcgagguggacagcuucucccucgggcugcugugcaucagcaucaugaucgaggaggucaugcgcucccgguggagccgcaagaugcucaugaccggcacccuggccguguucuuccugcucaucauggggcagcugaccuggaacgaccugauccgguccugcaucauggugggcgccaacgccagcgaccgcauggggaugggcacgaccuaccucgcgcugauggccaccuucaagaugcgcccgauguucgccgucggccugcuguuccggcgccugaccucccgggaggugcugcuccugacgaucgggcugagccucgucgccuccguggagcugcccaacagccuggaggagcucggcgacgggcuggccaugggcaucaugauccugaagcuccugaccgacuuccaguccuaccagcugugggcgacccuccugagccugaccuucaucaagacgaccuucucccuccacuacgccuggaagaccauggccauggugcugagcaucgucucccugcucccccugugccugagcaccacgucccagaagaccaccuggcuccccgugcugcugggcagccucgggugcaagccgcugaccauguuccugaucgccgagaacaagaucuggggccgcaagagcuggccccucaacgaggggaucauggcggugggcaucgucuccauccugcugagcucccuccugaagaacgacgugccccuggccgggccccucaucgccggcggcaugcugaucgccugcuacgugaucagcggguccagcgccgaccugucccucgagaaggcggccgaggucagcugggaggaggaggccgagcacuccggcgccagccacaacauccugguggaggugcaggacgacgggacgaugaagaucaaggacgaggagcgggacgacacccugaccauccuccugaaggccacccugcucgcggucuccggcguguacccgcugagcauccccgccacccuguucgugugguacuucuggcagaagaagaagcagcgcuccgggguccucugggacacgcccagcccgcccgagguggagcgggccgugcuggacgacggcaucuaccgcaucaugcagcggggccugcuggggcgcucccaggucggcguggggguguuccaggagaacgucuuccacaccauguggcacgugacccggggcgccgugcucauguaccaggggaagcgccuggagcccagcugggccuccgucaagaaggaccugaucagcuacggcggcggguggcggcuccagggcuccuggaacaccggggaggagguccaggugaucgcggucgagcccggcaagaaccccaagaacgugcagacggcccccgggaccuucaagacccccgagggcgaggugggcgccaucgcccuggacuucaagcccgggaccagcggcagccccaucgucaaccgcgaggggaagaucgugggccuguacggcaacgggguggucacgaccuccggcaccuacgugagcgccaucgcgcaggccaaggccucccaggaggggccgcuccccgagaucgaggacgagguguuccggaagcgcaaccugaccaucauggaccugcaccccggcagcgggaagacgcggcgcuaccucccggccaucguccgggaggcgaucaagcgcaagcugcggacccugauccucgcccccacccgcgugguggccuccgagauggccgaggcccugaagggcaugcccauccgcuaccagaccacggcggucaagagcgagcacaccggccgggagaucguggaccugaugugccacgccaccuucaccaugcgccuccugucccccgugcgggucccgaacuacaacaugaucaucauggacgaggcccacuucacggaccccagcuccaucgccgcccgcggguacaucagcacccgggugggcaugggggaggcggccgccaucuucaugaccgccacgccgcccggcuccguggaggccuucccgcagagcaacgcggucauccaggacgaggagcgcgacauccccgagcgguccuggaacagcggguacgaguggaucacggacuuccccggcaagaccgugugguucgugcccuccaucaagagcggcaacgacaucgccaacugccugcgcaagaacgggaagcgggucauccagcucucccgcaagaccuucgacaccgaguaccagaagacgaagaacaacgacugggacuacguggugaccaccgacaucagcgagaugggcgccaacuuccgggccgaccgcgucaucgacccgcggcgcugccugaagcccgugauccugaaggacgggcccgagcgggucauccucgcgggccccaugccggugaccguggccuccgccgcccagcgccgggggcgcaucggccggaaccacaacaaggagggcgaccaguacaucuacauggggcagccccugaacaacgacgaggaccacgcccacuggacggaggcgaagaugcugcucgacaacaucaacacccccgagggcaucauccccgcccuguucgagccggagcgcgagaaguccgccgccaucgacggggaguaccgccugcggggcgaggcccgcaagaccuucgucgagcucaugcggcgcggggaccugcccguguggcugagcuacaagguggcguccgagggcuuccaguacagcgaccggcgcuggugcuucgacggcgagcggaacaaccagguccucgaggagaacauggacguggagaucuggaccaaggagggggagcgcaagaagcugcggccccgcuggcuggacgcccggacguacuccgacccccucgcccugcgcgaguucaaggaguucgccgccggccggcgcagcguguccggggaccugauccucgagaucggcaagcugccgcagcaccugacccagcgggcgcagaacgcccucgacaaccuggucaugcugcacaacagcgagcagggcgggcgcgccuaccggcacgccauggaggagcuccccgacaccaucgagacccugaugcugcucgcgcugaucgccgugcugacgggcggggugacccucuucuuccuguccggccgcgggcugggcaagaccagcaucggccuccugugcgucauggccuccagcgcccugcucuggauggccuccguggagccccacuggaucgcggccagcaucauccuggaguucuuccugauggugcuccugauccccgagccggaccggcagcgcacgccccaggacaaccagcuggccuacgucgugaucgggcuccuguucaugauccugaccguggccgccaacgagaugggccuccuggagacgaccaagaaggaccuggggaucggccacgcggccgucgagaaccaccaccacgccaccaugcucgacguggaccugcaccccgccuccgccuggacccuguacgcgguggccacgaccaucaucaccccgaugaugcggcacaccaucgagaacacgaccgccaacaucagccucaccgccaucgccaaccaggcggccauccugauggggcuggacaagggcuggcccaucuccaagauggacaucggcgucccccuccuggcccuggggugcuacagccaggugaacccccucacccugacggccgcggugcugaugcucgucgcccacuacgccaucaucggcccggggcugcaggccaaggccacccgcgaggcgcagaagcgcaccgccgccggcaucaugaagaaccccaccguggacgggaucguggccaucgaccuggaccccgucguguacgacgccaaguucgagaagcagcucggccagaucaugcugcugauccucugcacgucccagauccugcugaugcggaccaccugggcgcucugcgagagcaucacccuggccacgggcccccugaccacccucugggagggguccccgggcaaguucuggaacaccacgaucgccgugagcauggccaacaucuuccgcgggagcuaccuggccggcgcgggccuggccuucucccucaugaagucccucgggggcgggcggcgcgggaccggggcccagggcgagacccugggcgagaaguggaagcggcagcucaaccagcuguccaagagcgaguucaacaccuacaagcgcuccgggaucauggaggucgaccggagcgaggccaaggagggccugcgccgcggggagacgaccaagcacgcggugucccgcggcaccgccaagcuccggugguucguggagcgcaaccuggucaagcccgaggggaaggugaucgaccugggcugcggccgcggcggguggagcuacuacugcgccgggcugaagaaggugaccgaggucaagggguacacgaagggcgggcccggccacgaggagcccaucccgauggccaccuacggguggaaccucgugaagcugcacuccggcaaggacguguucuucaucccgcccgagaagugcgacacccugcucugcgacaucggggagagcucccccaacccgaccaucgaggagggccgcacgcugcggguccugaagaugguggagcccuggcuccgcgggaaccaguucugcaucaagauccugaaccccuacaugcccagcguggucgagacccuggagcagaugcagcggaagcacggcggcaugcucgugcgcaacccgcugucccggaacagcacccacgagauguacuggguguccugcgggaccggcaacaucgucagcgccgugaacaugaccucccgcaugcugcucaaccgcuucacgauggcgcaccggaagcccaccuacgagcgcgacguggaccugggggccggcacccggcacgucgccguggagcccgagguggccaaccuggacaucaucggccagcgcaucgagaacaucaagcacgagcacaagagcaccuggcacuacgacgaggacaaccccuacaagacgugggccuaccacggguccuacgaggucaagccgagcggcagcgcguccagcauggugaacggggucgugaagcuccugaccaagcccugggacgugauccccauggucacccagaucgccaugaccgacacgacccccuucggccagcagcggguguucaaggagaagguggacacccgcaccccgaaggccaagcgggggacggcccagaucauggaggucaccgcccgcuggcuguggggcuuccucucccggaacaagaagccccgcaucugcacccgggaggaguucacccgcaaggugcggagcaacgcggccaucggcgccguguucgucgacgagaaccaguggaacuccgccaaggaggcgguggaggacgagcgcuucugggaccuggugcaccgggagcgcgagcugcacaagcaggggaagugcgccacgugcgucuacaacaugaugggcaagcgggagaagaagcucggggaguucggcaaggccaaggggagccgcgccaucugguacauguggcugggcgcccgguuccuggaguucgaggcgcucggcuucaugaacgaggaccacugguucucccgcgagaacagccuguccgggguggagggcgaggggcugcacaagcucggcuacauccugcgggacaucagcaagauccccgggggcaacauguacgccgacgacaccgccggcugggacacccgcaucaccgaggacgaccugcagaacgaggccaagaucacggacaucauggagccggagcacgcccuccuggcgaccuccaucuucaagcugaccuaccagaacaaggugguccgcgugcagcggcccgcccgcaacgggaccgugauggacgucaucagccggcgcgaccagcggggcuccggccaggugggcacguacggccucaacaccuucaccaacauggaggcccagcugauccgccagauggagagcgaggggaucuucucccccagcgagcuggagacccccaaccucgccgagcgggugcuggacuggcuggagaagcacggcgucgagcgccucaagcggauggccaucuccggggacgacugcguggugaagccgaucgacgaccgcuucgcgacggcccugagcgcccugaacgacaugggcaagguccggaaggacaucccccagugggagcccagcaagggguggaacgacuggcagcagguccccuucugcucccaccacuuccaccagcucaucaugaaggacggccgcgagaucguggucccgugccggaaccaggacgagcuggugggccgcgcccgggugagccagggggccggcuggucccugcgcgagaccgcgugccucggcaagagcuacgcccagauguggcagcugauguacuuccaccggcgcgaccugcggcucgccgccaacgcgaucugcuccgccguccccguggacugggugcccaccagccgcaccacgugguccauccacgcccaccaccaguggaugaccaccgaggacaugcugagcgucuggaaccgcguguggaucgaggagaaccccuggauggaggacaagacccacaucuccagcuggggcgacgugccguaccuggggaagcgggaggaccaguggugcggcucccucaucggccugacggcccgcgccaccugggcgaccaacauccaggucgccaucaaccaggugcggcgccugaucgggaacgagaacuaccucgacuacaugaccagcaugaagcgguucaagaacgaguccgaccccgagggcgcccugugguga

SEQ ID NO: 8578 - RNA, 9879 nt, Artificial Sequence
  derived and/or modified CDS sequence (opt1) from DENV-1__GQ199844__SS-prME
agcgugaccaugcugcucaugcugaugcccaccgcccuggccuuccaccucaccacccggggcggggagccccacaugaucgugaccaagcaggagcggggcaagagccugcuguucaagaccagcgcgggggugaacaugugcacccucaucgccauggaccugggcgagcugugcgaggacaccaugaccuacaagugcccccggaucaccgaggccgagcccgacgacguggacugcuggugcaacgccaccgacaccugggugaccuacgggaccugcagccagacgggcgagcaccggcgcgacaagcggagcguggcccucgcgccccacgugggccuggggcuggagacccgcaccgagaccuggauguccagcgagggcgccuggaagcagauccagcgggucgagacgugggcccuccgccaccccggguucaccgugaucgcccuguuccuggcgcacgccaucggcaccuccaucacccagaaggggaucaucuucauccuccugaugcuggugacgcccagcauggccaugcggugcgucggcaucggcucccgcgacuucguggaggggcucagcggcgccaccuggguggacgucgugcuggagcacggguccugcgugaccaccauggccaaggacaagcccacgcuggacaucgagcuccugaagaccgaggucaccaaccccgcggugcugcggaagcucugcaucgaggccaagaucagcaacaccacgaccgacucccgcugccccacccagggcgaggccacccugauggaggagcaggacgccaacuucgugugccggcgcacguucgucgaccggggcugggggaacggcugcgggcuguucggcaaggggagccucaucacgugcgccaaguucaagugcgugaccaagcuggagggcaagaucgugcaguacgagaaccugaaguacuccgucaucgugaccgugcacacgggcgaccagcaccaggucgggaacgagagcaccgagcacggcaccaucgcgaccaucacgccccaggcccccacguccgagauccagcucaccgacuacggggcccugacccuggacugcagcccccgcaccggccucgacuucaacgagauggugcugcugacgaugaaggagaaguccuggcucguccacaagcagugguuccuggaccugccgcuccccuggaccagcggggccagcaccucccaggagaccuggaaccggcaggaccugcuggugacguucaagaccgcccacgcgaagaagcaggagguggucgugcucggcagccaggagggcgccaugcacaccgcccugaccggggccacggagauccagaccuccggcaccaccacgaucuucgccgggcaccugaagugccgccucaagauggacaagcugacccugaagggcaugagcuacgugaugugcaccggguccuucaagcucgagaaggaggucgcggagacccagcacggcacggugcuggugcagaucaaguacgagggcaccgacgcccccugcaagauccccuucagcacccaggacgagaagggggucacccagaacggccggcugaucacggccaacccgaucgugaccgacaaggagaagcccgugaacaucgaggccgagccgcccuucggggaguccuacaucgucaucggcgcgggcgagaaggcccugaagcucagcugguucaagaagggguccagcaucggcaagauguucgaggccaccgcccgcggggcccggcgcauggcgauccugggcgacaccgccugggacuucggguccgugggcggcguguucacgagcgucgggaagcuggugcaccagaucuucggcaccgccuacgggguccuguucuccggcgucagcuggaccaugaagaucgggaucggcgugcugcugaccuggcucggccugaacucccgcagcacgucccugagcaugaccugcaucgccguggggcucgucacccuguaccugggcgugauggugcaggccgacuccgggugcgucaucaacuggaagggccgggagcucaagugcgggagcggcaucuucgugaccaacgaggugcacacguggaccgagcaguacaaguuccaggcggacagcccgaagcgccuguccgccgccaucggcaaggccugggaggagggggucugcggcauccggagcgccacccgccuggagaacaucauguggaagcagaucuccaacgagcucaaccacauccugcuggagaacgacaugaaguucaccgugguggucggggacguggugggcauccucgcgcaggggaagaagaugauccggccccagcccauggagcacaaguacagcuggaaguccuggggcaaggccaagaucaucggcgccgacguccagaacaccacguucaucaucgacgggcccaacaccccggagugccccgacgaccagcgcgccuggaacaucugggagguggaggacuacggcuucgggaucuucaccaccaacaucuggcugaagcugcgggacagcuacacccaggugugcgaccaccgccucauguccgcggccaucaaggacagcaaggccguccacgccgacaugggcuacuggaucgaguccgagaagaacgagaccuggaagcuggcccgggcgagcuucaucgaggugaagaccugcaucuggcccaagucccacacccuguggagcaacggcgugcucgaguccgagaugaucauccccaagaucuacgggggcccgaucagccagcacaacuaccgccccggguacuucacgcagaccgccggccccuggcaccuggggaagcuggagcucgacuucgaccugugcgagggcaccaccgucgugguggacgagcacugcggcaaccgggggccgucccugcgcacgaccaccgucaccggcaagaucauccacgaguggugcugccggagcugcacgcugccgccccuccgcuucaagggggaggacggcugcugguacgggauggagauccggcccgugaaggagaaggaggagaaccuggugaaguccauggucagcgccggcagcggcgagguggacuccuucagccucgggcugcugugcaucuccaucaugaucgaggaggugaugcgcagccgguggucccgcaagaugcucaugaccggcacccuggccgucuuccugcuccugaucauggggcagcugaccuggaacgaccucauccggcugugcaucauggugggcgccaacgcgagcgaccgcauggggaugggcacgaccuaccuggcccucauggccaccuucaagaugcgcccgauguucgccguggggcugcuguuccggcgccucaccucccgggagguccugcugcucacgaucgggcugagccugguggccuccgucgagcuccccaacagccuggaggagcugggcgacgggcucgcgaugggcaucaugauccugaagcugcucaccgacuuccagucccaccagcugugggccacccugcucagccugaccuucaucaagacgacccugucccuccacuacgccuggaagaccauggccauggugcugagcaucgcgucccuguucccccucugccugagcaccacgucccagaagaccaccuggcugcccgugcuccugggcagccuggggugcaagccgcucaccauguuccugaucacggagaccaagaucuggggccgcaaguccuggccccugaacgaggggaucauggccgucggcguggugagcauccuccugagcucccugcucaagaacgacgucccccuggccgggccccugaucgccggcggcaugcucaucgccugcuacgugaucagcggguccagcgcggaccugucccuggagaaggccgccgaggugagcugggaggaggaggccgagcacuccggcgccagccacaacauccucgucguggugcaggacgacgggaccaugaagaucaaggacgaggagcgggacgacacccugaccauccugcucaaggcgacgcugcuggccgucuccggcguguacccgcucagcauccccgccacccuguucgugugguacuucuggcagaagaagaagcagcgcuccgggguccugugggacacccccagcccgcccgagguggagcgggccgugcuggacgacggcaucuaccgcaucaugcagcggggccuccuggggcgcucccaggucggcguggggguguuccaggagaacgucuuccacaccauguggcacgugacgcggggcgccgugcugauguaccaggggaagcgccucgagcccagcugggcguccgucaagaaggaccugaucagcuacggcggcggguggcggcugcagggcuccuggaacaccggggaggagguccaggugaucgccgucgagcccggcaagaaccccaagaacgugcagaccgcccccgggaccuucaagacgcccgagggcgaggugggcgccaucgcccucgacuucaagcccgggaccagcggcucccccaucgucaaccgcgaggggaagaucgugggccuguacggcaacgggguggucaccaccagcggcacguacgugagcgcgaucgcccaggccaaggccucccaggaggggccgcugcccgagaucgaggacgagguguuccggaagcgcaaccucaccaucauggaccugcaccccggcagcgggaagacccggcgcuaccugccggcgaucguccgggaggccaucaagcgcaagcuccggacccugauccuggcccccacgcgcgugguggccuccgagauggccgaggcgcucaagggcaugcccauccgcuaccagaccaccgccgucaagagcgagcacaccggcaaggagaucguggaccugaugugccacgccacguucaccaugcggcugcucucccccgugcgcgucccgaacuacaacaugaucaucauggacgaggcccacuucaccgaccccagcuccaucgccgcgcggggguacaucagcacccgcgugggcaugggggaggccgccgccaucuucaugacggccacgccgcccggcuccguggaggcguucccgcagagcaacgccgucauccaggacgaggagcgggacauccccgagcgcuccuggaacagcggguacgaguggaucaccgacuuccccggcaagaccgugugguucgugcccuccaucaagagcggcaacgacaucgccaacugccugcggaagaacgggaagcgcgucauccagcugucccggaagacguucgacaccgaguaccagaagaccaagaacaacgacugggacuacguggugaccacggacaucagcgagaugggcgccaacuuccgcgcggaccgggucaucgacccgcgccggugccucaagcccgugauccugaaggacgggcccgagcgcgucauccuggccggccccaugccggugaccguggccuccgccgcccagcggcgcgggcggaucggccgcaaccacaacaaggagggcgaccaguacaucuacauggggcagccccucaacaacgacgaggaccacgcgcacuggaccgaggccaagaugcugcuggacaacaucaacacccccgagggcaucauccccgcccucuucgagccggagcgggagaaguccgccgccaucgacggggaguaccgccugcgcggcgaggcgcggaagacguucgucgagcugaugcgccgcggggaccuccccguguggcuguccuacaagguggccagcgagggcuuccaguacagcgaccgccgguggugcuucgacggcgagcgcaacaaccagguccuggaggagaacauggacguggagaucuggaccaaggagggggagcggaagaagcuccgcccccgguggcuggacgcccgcaccuacuccgacccccuggcccuccgggaguucaaggaguucgccgcgggccgccggagcguguccggggaccugauccuggagaucggcaagcucccgcagcaccugacccagcgcgcccagaacgcccuggacaaccucgucaugcugcacaacagcgagcagggcgggcgggccuaccgccacgcgauggaggagcugcccgacacgaucgagacccucaugcugcuggcccucaucgccgugcugaccggcggggugacccuguucuuccucuccggccgggggcugggcaagaccagcaucggccugcucugcgucauggccuccagcgugcugcuguggauggccuccguggagccccacuggaucgcggccagcaucauccucgaguucuuccugaugguccugcucauccccgagccggaccgccagcggacgccccaggacaaccagcuggccuacguggugaucgggcuccucuucaugauccugaccgucgccgccaacgagaugggccugcucgagaccaccaagaaggaccuggggaucggccacguggcgguggagaaccaccaccacgccacgaugcuggacgucgaccuccaccccgccuccgccuggacccuguacgccguggcgaccaccaucaucacgccgaugaugcgccacaccaucgagaacaccaccgccaacaucagccugacggccaucgccaaccaggccgcgauccucauggggcuggacaagggcuggcccaucuccaagauggacaucggcgugccccugcucgcccuggggugcuacagccaggucaacccccugacccucaccgccgccgugcugaugcugguggcgcacuacgccaucaucggcccggggcuccaggccaaggccacccgggaggcccagaagcgcacggcggccggcaucaugaagaaccccaccgucgacgggaucguggccaucgaccuggaccccguggucuacgacgccaaguucgagaagcagcugggccagaucaugcuccugauccugugcaccucccagauccuccugaugcgcaccacgugggcccugugcgagagcaucacccucgcgaccggcccccugaccacgcugugggagggguccccgggcaaguucuggaacaccaccaucgccgugagcauggccaacaucuuccggggguccuaccucgccggcgccggccuggcguucagccugaugaagucccucgggggcgggcgccggggcaccggggcccagggcgagacgcugggcgagaaguggaagcgccagcugaaccagcucuccaagagcgaguucaacaucuacaagcgguccgggaucauggagguggaccgcagcgaggccaaggagggccugaagcgcggggagaccacccgccacgccgucucccggggcaccgcgaagcugcgcugguucguggagcggaaccuggugaagcccgaggggaaggucaucgaccucggcugcggccgcgggggcuggagcuacuacugcgccgggcugaagaaggugacggaggugaagggcuacaccaagggcgggcccggccacgaggagcccaucccgauggccaccuacggguggaaccuggucaagcuccacuccggcaaggacguguucuucacgccgcccgagaagugcgacacgcugcugugcgacaucggggagagcucccccaacccgaccaucgaggagggccggacccuccgcgugcugaagauggucgagcccuggcugcgggggaaccaguucugcaucaagauccucaaccccuacaugcccagcgugguggagacccuggagcagaugcagcgcaagcacggcggcaugcugguccggaacccgcucucccgcaacagcacccacgagauguacuggguguccugcgggacgggcaacaucgugagcgccgucaacaugaccucccggaugcugcugaaccgcuucaccauggcccaccgcaagcccaccuacgagcgggacguggaccucggggcgggcacgcgccacguggccgucgagcccgagguggccaaccuggacaucaucggccagcggaucgagaacaucaagcacgagcacaagagcaccuggcacuacgacgaggacaaccccuacaagaccugggccuaccacggguccuacgaggucaagccgagcggcuccgccagcagcauggugaacgggguggucaagcugcucaccaagcccugggacgugauccccauggugacgcagaucgcgaugaccgacaccacccccuucggccagcagcgcgucuucaaggagaagguggacacgcggaccccgaaggccaagcgcgggaccgcccagaucauggaggugaccgcccgguggcuguggggcuuccugucccgcaacaagaagccccggaucugcacgcgcgaggaguucacccggaagguccgcagcaacgccgcgaucggcgccguguucguggacgagaaccaguggaacuccgccaaggaggccgucgaggacgagcgguucugggaccucgugcagaaggagcgcgagcugcacaagcaggggaagugcgcgaccugcguguacaacaugaugggcaagcgggagaagaagcugggggaguucggcaaggccaaggggagccgcgccaucugguacauguggcucggcgcccgguuccuggaguucgaggcccugggcuucaugaacgaggaccacugguucucccgcgagaacagccucuccggggucgagggcgaggggcugcacaagcugggcuacauccuccgggacaucagcaagauccccgggggcaacauguacgcggacgacaccgccggcugggacacgcgcaucaccgaggacgaccugcagaacgaggccaagaucaccgacaucauggagccggagcacgcccugcucgccaccuccaucuucaagcugacguaccagaacaagguggugcggguccagcgccccgcgaagaacgggaccgugauggacgugaucagccgccgggaccagcgcggcuccgggcaggucggcaccuacggccugaacaccuucacgaacauggaggcccagcucauccggcagauggagagcgaggggaucuuccugcccuccgagcuggagacccccaaccucgccgagcgcgugcuggacuggcuggagaaguacggcguggagcggcucaagcgcauggccaucagcggggacgacugcgucgugaagccgaucgacgaccgguucgccaccgcgcugaccgcccugaacgacaugggcaaggugcgcaaggacaucccccagugggagcccuccaagggguggaacgacuggcagcagguccccuucugcagccaccacuuccaccagcucaucaugaaggacggccgggagaucguggugccgugccgcaaccaggacgagcuggucggccgggcccgcgugucccagggggccggcuggagccugcgggagacggccugccucggcaagagcuacgcgcagauguggcagcugauguacuuccaccgccgggaccugcgccucgccgccaacgccaucugcuccgcggugcccgucgacugggugcccaccagccggaccaccugguccauccacgcccaccaccaguggaugacgaccgaggacaugcugagcguguggaaccgcgucuggaucgaggagaaccccuggauggaggacaagacccacguguccagcuggggcgacgugccguaccuggggaagcgggaggaccaguggugcggcucccucaucggccugaccgcccgcgccaccugggccagcaacauccaggucgcgaucaaccaggugcgccggcugaucgggaacgagaacuaccucgacuacaugacguccaugaagcgcuucaagaacgagggcgaccccgagggggcccugugguga

SEQ ID NO: 8579 - RNA, 9879 nt, Artificial Sequence
  derived and/or modified CDS sequence (opt1) from DENV-1__GQ199845__SS-prME
agcgugaccaugcugcugaugcugaugcccaccgcccuggccuuccaccucaccacccggggcggggagccccacaugaucguguccaagcaggagcggggcaagagccugcuguucaagaccuccgcgggggugaacaugugcacccucaucgccauggaccugggcgaguucugcgaggacacgaugaccuacaagugcccccgcaucaccgaggccgagcccgacgacguggacugcuggugcaacgccaccgacacgugggucaccuacgggaccugcagccagaccggcgagcaccggcgggacaagcgguccguggcccuggcgccccacgugggccucgggcuggagacgcgcaccgagaccuggaugagcuccgagggcgccuggaagcagauccagcgggucgagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugcccgacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaagaucguccaguacgagaaccugaaguacagcgugaucgugaccguccacaccggcgaccagcaccagguggggaacgaguccacggagcacggcaccaccgcgaccaucacgccccaggcccccagcacggagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccagcggggccuccaccagccaggagaccuggaaccggcaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcauguccuacgucaugugcaccgggagcuucaagcuggagaaggagguggcggagacccagcacggcacggugcucguccagaucaaguacgagggcaccgacgcccccugcaagauccccuucuccacccaggacgagaagggggugacccagaacggccggcugaucacggccaacccgaucgugaccgacaaggagaagcccgucaacaucgaggccgagccgcccuucggggagagcuacaucgugaucggcgcgggcgagaaggcccugaagcuguccugguucaagaaggggagcuccaucggcaagauguucgaggccaccgcccgcggggcccggcgcauggcgauccucggcgacaccgccugggacuucgggagcaucggcggcauguucacguccguggggaagcugguccaccagaucuucggcaccgccuacggggugcuguucagcggcguguccuggaccaugaagaucgggaucggcguccuccugaccuggcugggccucaacagccgcuccacgagccuguccaugaccugcaucgccguggggcuggugacccucuaccugggcgucauggugcaggccgacagcgggugcgugaucaacuggaagggccgggagcugaagugcgggagcggcaucuucgucaccaacgaggugcacacguggaccgagcaguacaaguuccaggcggacuccccgaagcgccucagcgccgccaucggcaaggccugggaggagggggugugcggcauccgguccgccacccgccuggagaacaucauguggaagcagaucagcaacgagcugaaccacauccuccuggagaacgacaugaagcugaccgucguggugggggacgucgcgggcauccucgcccaggggaagaagaugauccggccccagcccauggaguacaaguacuccuggaagaucuggggcaaggccaagaucaucggcgccgacgugcagaacaccacguucaucaucgacgggcccaacaccccggagugccccgacgaccagcgcgcguggaacaucugggagguggaggacuacggcuucgggaucuucaccaccaacaucuggcugaagcugcgggacagcuacacgcaggucugcgaccaccgccucauguccgccgccaucaaggacagcaaggccgugcacgccgacaugggcuacuggaucgaguccgagaagaacgagaccuggaagcuggcgcgggccagcuucaucgaggugaagaccugcaucuggcccaagucccacacccuguggagcaacggcguccucgaguccgagaugaucauccccaagaucuacgggggcccgaucagccagcacaacuaccgccccggguacuucacgcagaccgccggccccuggcaccuggggaagcuggagcucgacuucgaccugugcgagggcaccaccgugguggucgacgagcacugcggcaaccgggggccgucccugcgcacgaccaccgugaccggcaagaucauccacgaguggugcugccggagcugcacgcugccgccccuccgcuucaagggggaggacggcugcugguacgggauggagauccggcccgugaaggagaaggaggagaaccuggucaaguccauggugagcgccggcagcggcgagguggacuccuucagccucgggcugcugugcaucuccaucaugaucgaggaggucaugcgcagccgguggucccgcaagaugcucaugaccggcacccuggccguguucuuccugcucaucauggggcagcugaccuggaacgaccugauccggcucugcaucauggugggcgcgaacgccagcgaccgcauggggaugggcacgaccuaccuggcccugauggccaccuucaagaugcgcccgauguucgccgucggccuccuguuccggcgccugaccucccgggaggugcuccugcugacgaucgggcucagccugguggcguccgucgagcugcccaacagccucgaggagcugggcgacgggcuggccaugggcaucaugauccucaagcugcugaccgacuuccagucccaccagcucugggccacccugcugagccucaccuucauccgcacgaccuucucccugcacuacgccuggaagaccauggcgauggugcugagcaucgucucccucuucccccugugccugagcaccacgucccagaagaccaccuggcuccccgugcugcugggcagccucgggugcaagccgcugaccauguuccugaucgccgagaacaagaucuggggccggaaguccuggccccucaacgaggggaucauggccgugggcaucgucagcauccugcugagcucccuccugaagaacgacgugccccuggccgggccccucaucgccggcggcaugcugaucgcgugcuacgugaucagcggguccagcgccgaccugucccucgagaaggccgccgaggucagcugggaggaggaggccgagcacuccggcgcgagccacaacauccugguggaggugcaggacgacgggacgaugaagaucaaggacgaggagcgcgacgacacccugaccauccuccugaaggccacccugcucgccgucuccggcguguacccgcugagcauccccgccacccuguucgugugguacuucuggcagaagaagaagcagcgguccgggguccucugggacacgcccagcccgcccgagguggagcgcgccgugcuggacgacggcaucuaccggaucaugcagcgcggccugcuggggcggucccaggucggcguggggguguuccaggagaacgucuuccacaccauguggcacgugacccgcggcgcggugcucauguaccaggggaagcggcuggagcccagcugggccuccgucaagaaggaccugaucagcuacggcggcggguggcgccuccagggcuccuggaacaccggggaggagguccaggugaucgccgucgagcccggcaagaaccccaagaacgugcagacggcccccgggaccuucaagaccagcgagggcgaggugggcgccaucgcgcuggacuucaagcccgggaccuccggcagccccaucgucaaccgggaggggaagaucgugggccuguacggcaacgggguggucacgaccagcggcaccuacguguccgccaucgcccaggccaaggcgagccaggaggggccccucccggagaucgaggacgagguguuccgcaagcggaaccugaccaucauggaccugcaccccggcuccgggaagacgcgccgguaccuccccgccaucguccgcgaggccaccaagcggcgccugcgcacccugauccucgccccgacccgggugguggccagcgagauggcggaggcccugaagggcaugcccauccgcuaccagacgaccgccgucaaguccgagcacaccggcaaggagaucguggaccugaugugccacgccaccuucacgaugcggcuccugagccccgugcgcguccccaacuacaacaugaucaucauggacgaggcccacuucaccgacccguccagcaucgcggcccggggguacaucuccacccgcgugggcaugggggaggccgccgccaucuucaugaccgcgacgccgcccggcagcguggaggccuucccccaguccaacgccgucauccaggacgaggagcgggacaucccggagcgcagcuggaacuccggguacgaguggaucaccgacuuccccggcaagaccgugugguucgugcccagcaucaaguccggcaacgacaucgccaacugccugcggaagaacgggaagcgcgucauccagcucagccggaagaccuucgacacggaguaccagaagaccaagaacaacgacugggacuacguggugaccaccgacaucuccgagaugggcgcgaacuuccgcgccgaccgggucaucgacccccgccggugccugaagccggugauccugaaggacgggcccgagcgcgugauccucgccggccccaugcccgucacgguggccagcgccgcgcagcggcgcgggcggaucggccgcaaccacaacaaggagggcgaccaguacaucuacauggggcagccgcugaacaacgacgaggaccacgcccacuggaccgaggccaagaugcugcucgacaacaucaacacccccgagggcaucauccccgcccuguucgagcccgagcgcgagaaguccgccgcgaucgacggggaguaccggcugcgcggcgaggcccggaagaccuucgucgagcucaugcgccgcggggaccugccgguguggcugagcuacaagguggccagcgagggcuuccaguacuccgaccgccgguggugcuucgacggcgagcgcaacaaccagguccucgaggagaacauggacguggagaucuggacgaaggagggggagcggaagaagcugcgcccccgguggcuggacgcccgcaccuacagcgacccccucgcccugcgggaguucaaggaguucgcggccggccgccgguccgugagcggggaccugauccucgagaucggcaagcugccccagcaccugacccagcgcgcccagaacgcccucgacaaccuggucaugcugcacaacuccgagcagggcgggcgggcguaccgccacgccauggaggagcucccggacaccaucgagacgcugaugcugcucgcccugaucgccgugcugaccggcggggugacccucuucuuccugagcggccgggggcugggcaagaccuccaucggccuccugugcgucauggccagcuccgugcugcucuggauggcgagcguggagccccacuggaucgccgccuccaucauccuggaguucuuccugaugguccuccugauccccgagcccgaccgccagcggaccccgcaggacaaccagcuggccuacguggugaucgggcuccuguucaugauccugacggucgccgcgaacgagaugggccuccuggagaccaccaagaaggaccuggggaucggccacguggccguggagaaccaccaccacgccgccaugcucgacgucgaccugcaccccgccagcgcguggacccuguacgccguggccacgaccaucaucacccccaugaugcgccacaccaucgagaacacgaccgccaacaucucccucaccgccaucgcgaaccaggccgccauccugauggggcuggacaagggcuggccgaucagcaagauggacaucggcgugccccuccuggcccuggggugcuacucccaggucaacccccucacccugacggcggccgugcugaugcucguggcccacuacgccaucaucggccccgggcugcaggccaaggcgacccgcgaggcccagaagcggaccgccgccggcaucaugaagaacccgaccgucgacgggaucguggccaucgaccuggaccccguggucuacgacgcgaaguucgagaagcagcucggccagaucaugcugcugauccucugcacgagccagauccugcugaugcgcaccaccugggcccucugcgaguccaucacccuggccacgggcccccugaccacccucugggaggggagccccggcaaguucuggaacaccacgaucgccguguccauggccaacaucuuccgggggagcuaccuggcgggcgccggccuggccuucagccucaugaagucccucgggggcgggcgccgggggaccggggcccagggcgagacccugggcgagaaguggaagcgccagcucaaccagcugagcaaguccgaguucaacaccuacaagcggagcgggaucauggagguggaccgcuccgaggcgaaggagggccugaagcgcggggagacgaccaagcacgccgucagccgcggcaccgccaagcuccggugguucguggagcgcaaccuggugaagccggaggggaaggucaucgaccugggcugcggccgcggcgggugguccuacuacugcgccgggcugaagaaggugaccgaggugaagggguacacgaagggcggccccggccacgaggagcccauccccauggccaccuacggguggaaccucgucaagcugcacagcggcaaggacguguucuucaucccgcccgagaagugcgacacccugcucugcgacaucggggaguccagccccaaccccaccaucgaggagggccgcacgcugcgggugcugaagauggucgagccguggcuccgcgggaaccaguucugcaucaagauccugaaccccuacaugcccuccgugguggagacccuggagcagaugcagcggaagcacggcggcaugcucguccgcaacccccugagccggaacuccacccacgagauguacugggugagcugcgggaccggcaacaucguguccgcggucaacaugaccagccgcaugcugcucaaccgcuucacgauggcccaccggaagccgaccuacgagcgcgacguggaccugggggccggcacccggcacguggccgucgagcccgagguggccaaccuggacaucaucggccagcgcaucgagaacaucaagcacgagcacaaguccaccuggcacuacgacgaggacaaccccuacaagacgugggcguaccacgggagcuacgaggugaagcccuccggcagcgccagcuccauggucaacgggguggucaagcuccugaccaagccgugggacgugauccccauggugacccagaucgccaugaccgacacgacccccuucggccagcagcgggucuucaaggagaagguggacacccgcacccccaaggccaagcgggggacggcccagaucauggaggugaccgcgaaguggcuguggggcuuccucagccgcaacaagaagccgcggaucugcacccgcgaggaguucacccggaagguccgcuccaacgccgccaucggcgccguguucguggacgagaaccaguggaacagcgcgaaggaggccgucgaggacgagcgguucugggaccuggugcaccgcgagcgggagcugcacaagcaggggaagugcgccacgugcguguacaacaugaugggcaagcgcgagaagaagcucggggaguucggcaaggccaaggggucccgggccaucugguacauguggcugggcgcgcgcuuccuggaguucgaggcccucggcuucaugaacgaggaccacugguucagccgggagaacucccugagcggggucgagggcgaggggcugcacaagcucggcuacauccugcgcgacaucuccaagauccccgggggcaacauguacgccgacgacaccgccggcugggacacccggaucaccgaggacgaccugcagaacgaggccaagaucacggacaucauggagcccgagcacgcgcuccuggccaagagcaucuucaagcugaccuaccagaacaagguggugcgcguccagcgcccggccaagaacgggaccgugauggacgugaucucccggcgcgaccagcggggcagcgggcaggucggcaccuacggccucaacacguucaccaacauggaggcccagcugauccgccagauggaguccgaggggaucuucagccccuccgagcuggagacccccaaccucgccggccgggugcuggacuggcuggagaagcacgggguggagcgccucaagcggauggcgaucagcggcgacgacugcgucgugaagcccaucgacgaccgcuucgccaccgcccugacggcccugaacgacauggggaaggugcggaaggacaucccgcagugggagcccuccaagggcuggaacgacuggcagcagguccccuucugcagccaccacuuccaccagcucaucaugaaggacggccgcgagaucguggugcccugccggaaccaggacgagcuggucgggcgcgcccgggugagccagggcgcgggguggucccugcgcgagaccgccugccucggcaagagcuacgcccagauguggcagcugauguacuuccaccggcgcgaccugcggcucgccgcgaacgccaucugcuccgccgugccggucgacugggugcccaccagccgcaccacgugguccauccacgcccaccaccaguggaugaccaccgaggacaugcugagcguguggaaccgggucuggaucgaggagaaccccuggauggaggacaagacccacguguccagcuggggcgacgugcccuaccugggcaagcgcgaggaccaguggugcggcucccucaucgggcugacggcccgcgcgaccugggccaccaacauccaggucgccaucaaccaggugcggcgccugcucggcaacgagaacuaccuggacuacaugaccagcaugaagcgguucaagaacgaguccgacccggagggggcccugugguga

SEQ ID NO: 8580 - RNA, 9879 nt, Artificial Sequence
  derived and/or modified CDS sequence (opt1) from DENV-1__GQ199846__SS-prME
agcgugaccaugcugcucaugcugaugcccaccgcccuggccuuccaccucacgacccggggcggggagccccacaugaucgugaccaagcaggagcggggcaagagccugcuguucaagaccagcgcgggggugaacaugugcacccucaucgccauggaccugggcgagcugugcgaggacaccaugaccuacaagugcccccgcaucaccgaggccgagcccgacgacguggacugcuggugcaacgccaccgacaccugggugaccuacgggaccugcagccagacgggcgagcaccggcgggacaagcggagcguggcccucgcgccccacgugggccuggggcuggagacccgcaccgagaccuggauguccagcgagggcgccuggaagcagauccagcgggucgagacgugggcccuccgccaccccggguucaccgugaucgcccuguuccuggcgcacgccaucggcaccuccaucacccagaaggggaucaucuucauccuccugaugcuggugacgcccagcauggccaugcggugcgucggcaucggcucccgcgacuucguggaggggcucagcggcgccaccuggguggacgucgugcuggagcacggguccugcgugaccaucauggcccgggacaagcccacccuggacaucgagcuccugaagacggaggucaccaaccccgcggugcugcgcaagcucugcaucgaggccaagaucagcaacaccaccacggacucccggugccccacccagggcgaggccacccugauggaggagcaggacgccaacuucgugugccgccggaccuucgucgaccgcggcugggggaacggcugcgggcuguucggcaaggggagccucaucacgugcgccaaguucaagugcgugaccaagcuggagggcaagaucgugcaguacgagaaccugaaguacuccgucaucgugaccgugcacaccggcgaccagcaccaggucgggaacgagagcacggagcacggcaccaccgcgaccaucacgccccaggcccccacguccgagauccagcucaccgacuacggggcccugacccuggacugcagcccccggaccggccucgacuucaacgagauggugcugcugacgaugaaggagaaguccuggcucguccacaagcagugguuccuggaccugccgcuccccuggaccagcggggccagcaccucccaggagaccuggaaccgccaggaccugcuggugacguucaagaccgcccacgcgaagaagcaggagguggucgugcucggcagccaggagggcgccaugcacaccgcccugaccggggccacggagauccagaccuccggcaccaccacgaucuucgccgggcaccugaagugccggcucaagauggacaagcugacccugaagggcaugagcuacgugaugugcaccggguccuucaagcucgagaaggaggucgcggagacccagcacggcacggugcuggugcagaucaaguacgagggcaccgacgcccccugcaagauccccuucagcacccaggacgagaagggggucacccagaacggccgccugaucacggccaacccgaucgugaccgacaaggagaagcccgugaacaucgaggccgagccgcccuucggggaguccuacaucgucaucggcgcgggcgagaaggcccugaagcucagcugguucaagaagggguccagcaucggcaagauguucgaggccaccgcccgcggggcccgccgcauggcgauccugggcgacaccgccugggacuucggguccgugggcggcguguucacgagcgucgggaagcuggugcaccagaucuucggcaccgccuacgggguccuguucuccggcgucagcuggaccaugaagaucgggaucggcgugcugcugaccuggcucggccugaacucccggagcacgucccugagcaugaccugcaucgccguggggcucgucacccuguaccugggcgugauggugcaggccgacuccgggugcgucaucaacuggaagggccgcgagcucaagugcgggagcggcaucuucgugaccaacgaggugcacacguggaccgagcaguacaaguuccaggcggacagcccgaagcggcuguccgccgccaucggcaaggccugggaggagggggucugcggcauccgcagcgccacccggcuggagaacaucauguggaagcagaucuccaacgagcucaaccacauccugcuggagaacgacaugaaguucaccgugguggucggggacguggugggcauccucgcgcaggggaagaagaugauccgcccccagcccauggagcacaaguacagcuggaaguccuggggcaaggccaagaucaucggcgccgacguccagaacaccacguucaucaucgacgggcccaacaccccggagugccccgacgaccagcgggccuggaacaucugggagguggaggacuacggcuucgggaucuucaccaccaacaucuggcugaagcugcgcgacagcuacacccaggugugcgaccaccggcucauguccgcggccaucaaggacagcaaggccguccacgccgacaugggcuacuggaucgaguccgagaagaacgagaccuggaagcuggcccgcgcgagcuucaucgaggugaagaccugcaucuggcccaagucccacacccuguggagcaacggcgugcucgaguccgagaugaucauccccaagaucuacgggggcccgaucagccagcacaacuaccggcccggguacuucacgcagaccgccggccccuggcaccuggggaagcuggagcucgacuucgaccugugcgagggcaccaccgucgugguggacgagcacugcggcaaccgcgggccgucccugcggacgaccaccgucaccggcaagaucauccacgaguggugcugccgcagcugcacgcugccgccccuccgguucaagggggaggacggcugcugguacgggauggagauccgccccgugaaggagaaggaggagaaccuggugaaguccauggucagcgccggcagcggcgagguggacuccuucagccucgggcugcugugcaucuccaucaugaucgaggaggugaugcggagccgcuggucccggaagaugcucaugaccggcacccuggccgucuuccugcuccugaucauggggcagcugaccuggaacgaccucauccgccugugcaucauggugggcgccaacgcgagcgaccgcauggggaugggcacgaccuaccuggcccucauggccaccuucaagaugcggccgauguucgccgugggccugcuguuccgccggcucaccucccgcgagguccugcugcucacgaucgggcugagccugguggccuccgucgagcuccccaacagccuggaggagcugggcgacgggcucgcgaugggcaucaugauccugaagcugcucaccgacuuccagucccaccagcugugggccacccugcucagccugaccuucaucaagacgacccugucccuccacuacgccuggaagaccauggccauggugcugagcaucgcgucccuguucccccucugccugagcaccacgucccagaagaccaccuggcugcccgugcuccugggcagccuggggugcaagccgcucaccauguuccugaucacggagaccaagaucuggggccggaaguccuggccccugaacgaggggaucauggccgucggcguggugagcauccuccugagcucccugcucaagaacgacgucccccuggccgggccccugaucgccggcggcaugcucaucgccugcuacgugaucagcggguccagcgcggaccugucccuggagaaggccgccgaggugagcugggaggaggaggccgagcacuccggcgccagccacaacauccucgucguggugcaggacgacgggaccaugaagaucaaggacgaggagcgcgacgacacccugaccauccugcucaaggcgacgcugcuggccgucuccggcguguacccgcucagcauccccgccacccuguucgugugguacuucuggcagaagaagaagcagcgguccgggguccugugggacacccccagcccgcccgagguggagcgcgccgugcuggacgacggcaucuaccggaucaugcagcgcggccuccuggggcggucccaggucggcguggggguguuccaggagaacgucuuccacaccauguggcacgugacgcgcggcgccgugcugauguaccaggggaagcggcucgagcccagcugggcguccgucaagaaggaccugaucagcuacggcggcggguggcgccugcagggcuccuggaacaccggggaggagguccaggugaucgccgucgagcccggcaagaaccccaagaacgugcagaccgcccccgggaccuucaagacgcccgagggcgaggugggcgccaucgcccucgacuucaagcccgggaccagcggcucccccaucgucaaccgggaggggaagaucgugggccuguacggcaacgggguggucaccaccagcggcacguacgugagcgcgaucgcccaggccaaggccucccaggaggggccgcugcccgagaucgaggacgagguguuccgcaagcggaaccucaccaucauggaccugcaccccggcagcgggaagacccgccgguaccugccggcgaucguccgcgaggccaucaagcggaagcuccgcacccugauccuggcccccacgcgcgugguggccuccgagauggccgaggcgcucaagggcaugcccauccgguaccagaccaccgccgucaagagcgagcacaccggcaaggagaucguggaccugaugugccacgccacguucaccaugcgccugcucucccccgugcgggucccgaacuacaacaugaucaucauggacgaggcccacuucaccgaccccagcuccaucgccgcgcgcggguacaucagcacccgggugggcaugggggaggccgccgccaucuucaugacggccacgccgcccggcuccguggaggcguucccgcagagcaacgccgucauccaggacgaggagcgcgacauccccgagcgguccuggaacagcggguacgaguggaucaccgacuuccccggcaagaccgugugguucgugcccuccaucaagagcggcaacgacaucgccaacugccugcgcaagaacgggaagcgggucauccagcugucccgcaagacguucgacaccgaguaccagaagaccaagaacaacgacugggacuacguggugaccacggacaucagcgagaugggcgccaacuuccgggcggaccgcgucaucgacccgcggcgcugccucaagcccgugauccugaaggacgggcccgagcgggucauccuggccggccccaugccggugaccguggccuccgccgcccagcgccgggggcgcaucggccggaaccacaacaaggagggcgaccaguacaucuacauggggcagccccucaacaacgacgaggaccacgcgcacuggaccgaggccaagaugcugcuggacaacaucaacacccccgagggcaucauccccgcccucuucgagccggagcgcgagaaguccgccgccaucgacggggaguaccgccugcggggcgaggcgcgcaagacguucgucgagcugaugcggcgcggggaccuccccguguggcuguccuacaagguggccagcgagggcuuccaguacagcgaccggcgcuggugcuucgacggcgagcggaacaaccagguccuggaggagaacauggacguggagaucuggaccaaggagggggagcgcaagaagcuccggccccgcuggcuggacgcccggaccuacuccgacccccuggcccuccgcgaguucaaggaguucgccgcgggccggcgcagcguguccggggaccugauccuggagaucggcaagcucccgcagcaccugacccagcgggcccagaacgcccuggacaaccucgucaugcugcacaacagcgagcagggcgggcgcgccuaccggcacgcgauggaggagcugcccgacacgaucgagacccucaugcugcuggcccucaucgccgugcugaccggcggggugacccuguucuuccucuccggccgcgggcugggcaagaccagcaucggccugcucugcgucauggccuccagcgugcugcuguggauggccuccguggagccccacuggaucgcggccagcaucauccucgaguucuuccugaugguccugcucauccccgagccggaccggcagcgcacgccccaggacaaccagcuggccuacguggugaucgggcuccucuucaugauccugaccgucgccgccaacgagaugggccugcucgagaccaccaagaaggaccuggggaucggccacguggcgguggagaaccaccaccacgccacgaugcuggacgucgaccuccaccccgccuccgccuggacccuguacgccguggcgaccaccaucaucacgccgaugaugcggcacaccaucgagaacaccaccgccaacaucagccugacggccaucgccaaccaggccgcgauccucauggggcuggacaagggcuggcccaucuccaagauggacaucggcgugccccugcucgcccuggggugcuacagccaggucaacccccugacccucaccgccgccgugcugaugcugguggcgcacuacgccaucaucggcccggggcuccaggccaaggccacccgcgaggcccagaagcgcacggcggccggcaucaugaagaaccccaccgucgacgggaucguggccaucgaccuggaccccguggucuacgacgccaaguucgagaagcagcugggccagaucaugcuccugauccugugcaccucccagauccuccugaugcggaccacgugggcccugugcgagagcaucacccucgcgaccggcccccugaccacgcugugggagggguccccgggcaaguucuggaacaccaccaucgccgugagcauggccaacaucuuccgcggguccuaccucgccggcgccggccuggcguucagccugaugaagucccucgggggcgggcggcgcggcaccggggcccagggcgagacgcugggcgagaaguggaagcggcagcugaaccagcucuccaagagcgaguucaacaucuacaagcgcuccgggaucauggagguggaccggagcgaggccaaggagggccugaagcgcggggagaccacccggcacgccgucucccgcggcaccgcgaagcugcggugguucguggagcgcaaccuggugaagcccgaggggaaggucaucgaccucggcugcggccgcggcggguggagcuacuacugcgccgggcugaagaaggugacggaggugaagggguacaccaagggcgggcccggccacgaggagcccaucccgauggccaccuacggguggaaccuggucaagcuccacuccggcaaggacguguucuucacgccgcccgagaagugcgacacgcugcugugcgacaucggggagagcucccccaacccgaccaucgaggagggccgcacccuccgggugcugaagauggucgagcccuggcugcgcgggaaccaguucugcaucaagauccucaaccccuacaugcccagcgugguggagacccuggagcagaugcagcggaagcacggcggcaugcugguccgcaacccgcucucccggaacagcacccacgagauguacuggguguccugcgggacgggcaacaucgugagcgccgucaacaugaccucccgcaugcugcugaaccgcuucaccauggcccaccggaagcccaccuacgagcgcgacguggaccucggggcgggcacgcggcacguggccgucgagcccgagguggccaaccuggacaucaucggccagcgcaucgagaacaucaagcacgagcacaagagcaccuggcacuacgacgaggacaaccccuacaagaccugggccuaccacggguccuacgaggucaagccgagcggcuccgccagcagcauggugaacgggguggucaagcugcucaccaagcccugggacgugauccccauggugacgcagaucgcgaugaccgacaccacccccuucggccagcagcgggucuucaaggagaagguggacacgcgcaccccgaaggccaagcgggggaccgcccagaucauggaggugaccgcccgcuggcuguggggcuuccugucccggaacaagaagccccgcaucugcacgcgggaggaguucacccgcaagguccggagcaacgccgcgaucggcgccguguucguggacgagaaccaguggaacuccgccaaggaggccgucgaggacgagcgcuucugggaccucgugcagaaggagcgggagcugcacaagcaggggaagugcgcgaccugcguguacaacaugaugggcaagcgcgagaagaagcugggggaguucggcaaggccaaggggagccgggccaucugguacauguggcucggcgcccgcuuccuggaguucgaggcccugggcuucaugaacgaggaccacugguucucccgggagaacagccucuccggggucgagggcgaggggcugcacaagcugggcuacauccuccgcgacaucagcaagauccccgggggcaacauguacgcggacgacaccgccggcugggacacgcggaucaccgaggacgaccugcagaacgaggccaagaucaccgacaucauggagccggagcacgcccugcucgccaccuccaucuucaagcugacguaccagaacaagguggugcgcguccagcgccccgcgaagaacgggaccgugauggacgugaucagccggcgcgaccagcggggcuccgggcaggucggcaccuacggccugaacaccuucacgaacauggaggcccagcucauccgccagauggagagcgaggggaucuuccugcccuccgagcuggagacccccaaccucgccgagcgggugcuggacuggcuggagaaguacggcguggagcgccucaagcggauggccaucagcggggacgacugcgucgugaagccgaucgacgaccgcuucgccaccgcgcugaccgcccugaacgacaugggcaaggugcggaaggacaucccccagugggagcccuccaagggguggaacgacuggcagcagguccccuucugcagccaccacuuccaccagcucaucaugaaggacggccgcgagaucguggugccgugccggaaccaggacgagcuggucggccgcgcccgggugucccagggggccggcuggagccugcgcgagacggccugccucggcaagagcuacgcgcagauguggcagcugauguacuuccaccggcgcgaccugcggcucgccgccaacgccaucugcuccgcggugcccgucgacugggugcccaccagccgcaccaccugguccauccacgcccaccaccaguggaugacgaccgaggacaugcugagcguguggaaccgggucuggaucgaggagaaccccuggauggaggacaagacccacguguccagcuggggcgacgugccguaccuggggaagcgcgaggaccaguggugcggcucccucaucggccugaccgcccgcgccaccugggccagcaacauccaggucgcgaucaaccaggugcggcgccugaucgggaacgagaacuaccucgacuacaugacguccaugaagcgguucaagaacgagggcgaccccgagggggcccugugguga

SEQ ID NO: 8581 - RNA, 9879 nt, Artificial Sequence
  derived and/or modified CDS sequence (opt1) from DENV-1__GQ199847__SS-prME
agcgugaccaugcugcucaugcugaugcccaccgcccuggccuuccaccucacgacccggggcggggagccccacaugaucgugagcaagcaggagcggggcaagagccugcuguucaagaccuccgccggggugaacaugugcacccucaucgccauggaccugggcgaguucugcgaggacaccaugaccuacaagugcccccgcaucaccgaggccgagcccgacgacguggacugcuggugcaacgccaccgacacgugggugaccuacgggaccugcagccagaccggcgagcaccggcgggacaagcgguccguggcccuggcgccccacgugggccucgggcuggagacgcgcaccgagaccuggaugagcuccgagggcgccuggaagcagauccagcgggucgagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugcccgacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaagaucguccaguacgagaaccugaaguacagcgugaucgugaccguccacaccggcgaccagcaccagguggggaacgaguccacggagcacggcaccaccgcgaccaucacgccccaggcccccagcacggagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccagcggggccuccaccagccaggagaccuggaaccggaaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcauguccuacgucaugugcaccgggagcuucaagcuggagaaggagguggcggagacccagcacggcacggugcucguccagaucaaguacgagggcaccgacgcccccugcaagauccccuucuccacccaggacgagaagggggugacccagaacggccggcugaucacggccaacccgaucgugaccgacaaggagaagcccgucaacaucgaggccgagccgcccuucggggagagcuacaucgugaucggcgcgggcgagaaggcccugaagcuguccugguucaagaaggggagcuccaucggcaagauguucgaggccaccgcccgcggggcccggcgcauggcgauccucggcgacaccgccugggacuucgggagcaucggcggcguguucacguccgucgggaagcuggugcaccagaucuucggcaccgccuacggggugcuguucagcggcgucuccuggaccaugaagaucgggaucggcgugcuccugaccuggcugggccucaacagccgcuccacgagccuguccaugaccugcaucgccguggggcuggucacccucuaccugggcgugauggugcaggccgacagcgggugcgucaucaacuggaagggccgggagcugaagugcgggagcggcaucuucgugaccaacgaggugcacacguggaccgagcaguacaaguuccaggcggacuccccgaagcgccucagcgccgccaucggcaaggccugggaggagggggucugcggcauccgguccgccacccgccuggagaacaucauguggaagcagaucagcaacgagcugaaccacauccuccuggagaacgacaugaaguucaccgugguggucggggacguggcgggcauccuggcccaggggaagaagaugauccggccccagcccauggaguacaaguacuccuggaaguccuggggcaaggccaagaucaucggcgccgacgugcagaacaccacguucaucaucgacgggcccaacaccccggagugccccgacgaccagcgcgcguggaacaucugggaggucgaggacuacggcuucgggaucuucaccaccaacaucuggcucaagcugcgggacuccuacacccaggugugcgaccaccgccugaugagcgccgccaucaaggacuccaaggccgugcacgccgacaugggcuacuggaucgagagcgagaagaacgagaccuggaagcucgcgcgggccuccuucaucgaggucaagaccugcaucuggcccaagagccacacccugugguccaacggcgugcuggagagcgagaugaucauccccaagaucuacgggggcccgaucucccagcacaacuaccgccccggguacuucacgcagaccgccggccccuggcaccucgggaagcuggagcuggacuucgaccucugcgagggcaccaccguggucguggacgagcacugcggcaaccgggggccgagccugcgcacgaccaccgugaccggcaagaucauccacgaguggugcugccgguccugcacgcugccgccccugcgcuucaagggggaggacggcugcugguacgggauggagauccggcccgucaaggagaaggaggagaaccuggucaagagcauggugagcgccggcuccggcgaggucgacagcuucucccuggggcuccugugcaucagcaucaugaucgaggaggugaugcgcucccgguggagccgcaagaugcugaugaccggcacccucgccguguucuuccugcugaucauggggcagcucaccuggaacgaccugauccggcugugcaucauggucggcgcgaacgccuccgaccgcauggggaugggcacgaccuaccucgcccugauggccaccuucaagaugcgcccgauguucgccguggggcuccuguuccggcgccugaccagccgggaggugcugcuccugacgaucgggcugucccucgucgcgagcguggagcugcccaacucccuggaggagcucggcgacgggcuggccaugggcaucaugauccugaagcuccugaccgacuuccagagccaccagcugugggccacccuccugucccugaccuucaucaagacgaccuucagccuccacuacgccuggaagaccauggcgaugguccuguccaucgugagccuguucccccucugccuguccaccacgagccagaagaccaccuggcugcccgugcuccugggcucccuggggugcaagccgcucaccauguuccugaucgccgagaacaagaucuggggccgcaagagcuggccccugaacgaggggaucauggccgucggcaucgugagcauccuccuguccgcccugcucaagaacgacgugccccuggccgggccccugaucgcgggcggcaugcucaucgccugcuacgucaucagcggguccagcgccgaccugucccuggagaaggccgccgaggugagcugggaggaggaggcggagcacuccggcgccagccacaacauccucguggagguccaggacgacgggacgaugaagaucaaggacgaggagcgggacgacacccugaccauccugcucaaggccacccugcuggccguguccggcguguacccgcucagcauccccgccacccuguucgucugguacuucuggcagaagaagaagcagcgcuccggggugcugugggacacgcccagcccgcccgagguggagcgggcgguccucgacgacggcaucuaccgcaucaugcagcggggccugcuggggcgcucccaggugggcgugggggucuuccaggagaacguguuccacaccauguggcacgugacccggggcgccguccugauguaccaggggaagcgccucgagcccagcugggccuccgugaagaaggaccugaucagcuacggcggcggguggcggcugcagggcuccuggaacaccggggaggaggugcaggucaucgccguggagcccggcaagaaccccaagaacgugcagacggcccccgggaccuucaagaccagcgagggcgaggucggcgcgaucgcccucgacuucaagcccgggaccuccggcagccccaucgugaaccgcgaggggaagaucgugggccuguacggcaacggggucgugacgaccagcggcaccuacguguccgccaucgcccaggcgaaggccagccaggaggggccccugccggagaucgaggacgaggucuuccggaagcgcaaccucaccaucauggaccugcaccccggcuccgggaagacgcggcgcuaccugcccgccaucgugcgggaggccaucaagcgcaagcuccggacccugauccuggccccgacccgcguggucgcgagcgagauggccgaggcccucaagggcaugcccauccgcuaccagaccacggccgugaaguccgagcacaccggcaaggagaucguggaccugaugugccacgccaccuucaccaugcggcugcucagccccguccgcgugcccaacuacaacaugaucaucauggacgaggcgcacuucacggacccguccagcaucgccgcccggggguacaucuccacccgcgugggcaugggggaggccgccgcgaucuucaugaccgccacgccgcccggcagcgucgaggccuucccccaguccaacgccgugauccaggacgaggagcgggacaucccggagcgcagcuggaacuccggguacgaguggaucacggacuuccccggcaagaccgugugguucguccccagcaucaaguccggcaacgacaucgcgaacugccugcggaagaacgggaagcgcgugauccagcugagccggaagaccuucgacaccgaguaccagaagacgaagaacaacgacugggacuacguggucaccaccgacaucuccgagaugggcgccaacuuccgcgccgaccgggugaucgacccccgccggugccucaagccggugauccugaaggacgggcccgagcgcgucauccuggccggccccaugcccgugaccgucgccagcgcggcccagcggcgcgggcggaucggccgcaaccacaacaaggagggcgaccaguacaucuacauggggcagccgcucaacaacgacgaggaccacgcccacuggacggaggccaagaugcugcuggacaacaucaacacccccgagggcaucauccccgcccucuucgagcccgagcgggagaaguccgcggccaucgacggggaguaccgccugcgcggcgaggcccggaagaccuucguggagcugaugcgccgcggggaccucccgguguggcugagcuacaaggucgccagcgagggcuuccaguacuccgaccgccgguggugcuucgacggcgagcgcaacaaccaggugcuggaggagaacauggacguggagaucuggaccaaggagggggagcggaagaagcuccgcccccgguggcuggacgcccgcacguacagcgacccccuggcgcuccgggaguucaaggaguucgccgccggccgccgguccgucagcggggaccugauccuggagaucggcaagcucccccagcaccugacccagcgcgcccagaacgcgcuggacaaccucgugaugcugcacaacuccgagcagggcgggcgggccuaccgccacgccauggaggagcugccggacaccaucgagacccucaugcugcuggcccucaucgccgugcugacgggcggggucacccuguucuuccucagcggccgggggcugggcaagaccuccaucggccugcucugcgugauggcgagcuccgugcugcuguggauggccagcgucgagccccacuggaucgccgccuccaucauccucgaguucuuccugauggugcugcucauccccgagcccgaccgccagcggaccccgcaggacaaccagcuggccuacguggucaucgggcuccucuucaugauccugaccguggcggccaacgagaugggccugcucgagacgaccaagaaggaccuggggaucggccacguggccgucgagaaccaccaccacgccgccaugcuggacguggaccuccaccccgcgagcgccuggacccuguacgccguggccaccacgaucaucacccccaugaugcgccacaccaucgagaacaccacggccaacaucucccugaccgcgaucgccaaccaggccgccauccucauggggcuggacaagggcuggccgaucagcaagauggacaucggcgucccccugcucgcgcuggggugcuacucccaggugaacccccugacccucaccgccgccgugcugaugcuggucgcccacuacgccaucaucggccccgggcuccaggcgaaggccacgcgggaggcccagaagcgcaccgccgccggcaucaugaagaacccgaccguggacgggaucguggcgaucgaccuggaccccgucguguacgacgccaaguucgagaagcagcugggccagaucaugcuccugauccugugcaccagccagauccuccugaugcgcacgaccugggcccugugcgaguccaucacccucgccaccggcccccugacgacccugugggaggggagccccggcaaguucuggaacaccaccaucgccguguccauggcgaacaucuuccgggggagcuaccucgccggcgccggccuggccuucagccugaugaagucccucgggggcgggcgccggggcacgggggcgcagggcgagacccugggcgagaaguggaagcgccagcugaaccagcucagcaaguccgaguucaacaccuacaagcggagcgggaucauggaggucgaccgcuccgaggccaaggagggccugaagcgcggggagaccacgaagcacgccgugagccgcggcaccgccaagcugcggugguucguggagcgcaaccucgucaagccggaggggaaggugaucgaccugggcugcggccgcggcgggugguccuacuacugcgccgggcugaagaaggugaccgaggucaagggguacaccaagggcgggcccggccacgaggagcccauccccauggcgacguacggguggaaccuggugaagcuccacagcggcaaggacguguucuucaucccgcccgagaagugcgacacccugcugugcgacaucggggaguccagccccaaccccaccaucgaggagggccgcacccuccggguccugaagaugguggagccguggcugcgcgggaaccaguucugcaucaagauccucaaccccuacaugcccuccguggucgagacgcuggagcagaugcagcggaagcacggcggcaugcuggugcgcaacccccucagccggaacuccacccacgagauguacugggugagcugcgggaccggcaacaucgucuccgccgugaacaugaccagccgcaugcugcugaaccgguucaccauggcccaccgcaagccgacguacgagcgcgacguggaccucggggccggcacccggcacgucgccguggagcccgagguggcgaaccuggacaucaucggccagcgcaucgagaacaucaagcacgagcacaaguccaccuggcacuacgacgaggacaaccccuacaagaccugggccuaccacgggagcuacgaggucaagcccuccggcagcgccagcuccauggugaacggggucgugaagcugcucacgaagccgugggacgugauccccauggucacccagaucgccaugaccgacaccacgcccuucggccagcagcggguguucaaggagaagguggacacccgcacccccaaggccaagcgggggaccgcgcagaucauggaggucacggccaaguggcuguggggcuuccugagccgcaacaagaagccgcggaucugcacccgcgaggaguucacccggaaggugcgcuccaacgccgccaucggcgcgguguucgucgacgagaaccaguggaacagcgccaaggaggccguggaggacgagcgguucugggaccucgugcaccgcgagcgggagcugcacaagcaggggaagugcgcgaccugcgucuacaacaugaugggcaagcgcgagaagaagcugggggaguucggcaaggccaaggggucccgggcgaucugguacauguggcucggcgcccgcuuccuggaguucgaggcccugggcuucaugaacgaggaccacugguucagccgggagaacucccucagcgggguggagggcgaggggcugcacaagcugggcuacauccuccgcgacaucuccaagauccccgggggcaacauguacgccgacgacacggccggcugggacacccggaucaccgaggacgaccugcagaacgaggcgaagaucaccgacaucauggagcccgagcacgcccugcucgccaagagcaucuucaagcugacguaccagaacaaggugguccgcgugcagcggccggccaagaacgggaccgugauggacgucaucucccgccgcgaccagcggggcagcggccaggugggcaccuacggccugaacaccuucacgaacauggaggcccagcucauccgccagauggaguccgaggggaucuucagccccuccgagcuggagacccccaaccuggcgggccgggugcucgacuggcuggagaagcacggggucgagcgccugaagcggauggccaucagcggcgacgacugcguggugaagcccaucgacgaccgcuucgccaccgcccucaccgcccugaacgacauggggaagguccggaaggacaucccgcagugggagcccuccaagggcuggaacgacuggcagcagguccccuucugcagccaccacuuccaccagcugaucaugaaggacggccgcgagaucgugguccccugccggaaccaggacgagcucguggggcgcgcgcgggugagccagggcgccggguggucccugcgcgagacggccugccugggcaagagcuacgcccagauguggcagcucauguacuuccaccggcgcgaccugcggcuggcggccaacgccaucugcuccgccgacccggacgacuggguccccaccagccgcaccaccugguccauccacgcccaccaccaguggaugacgaccgaggacaugcucagcguguggaaccggguguggaucgaggagaaccccuggauggaggacaagacccacaucuccagcuggggcgacguccccuaccugggcaagcgcgaggaccaguggugcggcucccugaucgggcucaccgcgcgggccacgugggccaccaacauccagguggccaucaaccaggugcgccgccugaucggcaacgagaacuaccuggacuacaugaccagcaugaagcgguucaagaacgaguccgacccggagggggcccucugguga

SEQ ID NO: 8582 - RNA, 9879 nt, Artificial Sequence
  derived and/or modified CDS sequence (opt1) from DENV-1__GQ199849__SS-prME
agcgugaccaugcugcucaugcugaugcccaccgcccuggccuuccaccucaccacccggggcggggagccccacaugaucgugaccaagcaggagcggggcaagagccugcuguucaagaccagcgcgggggugaacaugugcacccucaucgccauggaccugggcgagcugugcgaggacaccaugaccuacaagugcccccggaucaccgaggccgagcccgacgacguggacugcuggugcaacgccacggacaccugggugaccuacgggaccugcagccggacgggcgagcaccgccgggacaagcgcagcguggcccucgcgccccacgugggccuggggcuggagacccggaccgagaccuggauguccagcgagggcgccuggaagcagauccagcgcguggagacgugggcccuccggcaccccggguucaccgugaucgcccuguuccuggcgcacgccaucggcaccuccaucacccagaaggggaucaucuucauccuccugaugcuggugacgcccagcauggccaugcgcugcgucggcaucggcucccgggacuucguggaggggcucagcggcgccaccuggguggacgucgugcuggagcacggguccugcgugaccaccauggccaaggacaagcccacgcuggacaucgagcuccugaagaccgaggucaccaaccccgcggugcugcgcaagcucugcaucgaggccaagaucagcaacaccacgaccgacucccggugccccacccagggcgaggccacccugauggaggagcaggacgccaacuucgugugccgccggacguucgucgaccgcggcugggggaacggcugcgggcuguucggcaaggggagccucaucacgugcgccaaguucaagugcgugaccaagcuggagggcaagaucgugcaguacgagaaccugaaguacuccgucaucgugaccgugcacacgggcgaccagcaccaggucgggaacgagagcaccgagcacggcaccaccgcgaccaucacgccccaggcccccaccuccgagauccagcucaccgacuacggggcccugacccuggacugcagcccccggacgggccucgacuucaacgagauggugcugcugaccaugaaggagaaguccuggcucguccacaagcagugguuccuggaccugccgcuccccuggaccagcggggccagcaccucccaggagacguggaaccgccaggaccugcuggugaccuucaagaccgcccacgcgaagaagcaggagguggucgugcucggcagccaggagggcgccaugcacaccgcccugacgggggccaccgagauccagaccuccggcaccacgaccaucuucgccgggcaccugaagugccggcucaagauggacaagcuggcgcugaagggcaugagcuacgugaugugcaccggguccuucaagcucgagaaggaggucgccgagacccagcacggcacggugcuggugcagaucaaguacgagggcaccgacgcccccugcaagauccccuucagcacccaggacgagaagggggucacccagaacggccgccugaucacggccaacccgaucgugaccgacaaggagaagcccgugaacaucgaggcggagccgcccuucggggaguccuacaucgucaucggcgccggcgagaaggcccugaagcucagcugguucaagaagggguccagcaucggcaagauguucgaggccaccgcccgcggggcccgccgcauggccauccugggcgacaccgccugggacuucggguccaucggcggcguguucacgagcguggggaagcugguccaccagaucuucggcaccgccuacgggguccuguucuccggcgugagcuggaccaugaagaucgggaucggcguccugcugaccuggcucggccugaacucccggagcacgucccugagcaugaccugcaucgccguggggcucgugacccuguaccugggcgucauggugcaggcggacuccgggugcgugaucaacuggaagggccgcgagcucaagugcgggagcggcaucuucgucaccaacgaggugcacacguggaccgagcaguacaaguuccaggccgacagcccgaagcggcuguccgccgccaucggcaaggccugggaggagggggugugcggcauccgcagcgcgacccggcuggagaacaucauguggaagcagaucuccaacgagcucaaccacauccugcuggagaacgggcucaaguucaccgucguggugggcgacgucguggggauccuggcccagggcaagaagaugauccgcccccagcccauggagcacaaguacagcuggaaguccuggggcaaggccaagaucaucggggccgacgugcagaacaccacguucaucaucgacggccccaacaccccggagugccccgacgaccagcgggcguggaacaucugggaggucgaggacuacggguucggcaucuucaccaccaacaucuggcugaagcuccgcgacagcuacacccaggugugcgaccaccggcugauguccgccgccaucaaggacagcaaggccgugcacgccgacaugggcuacuggaucgaguccgagcgcaacgagaccuggaagcuggcgcgggccagcuucaucgaggucaagaccugcaucuggcccaagucccacacccucuggagcaacggggugcuggaguccgagaugaucauccccaagaucuacggcgggccgaucagccagcacaacuaccgccccggcuacuucacgcagaccgccgggcccuggcaccugggcaagcucgagcuggacuucgaccugugcgagggcaccaccguggucguggacgagcacugcgggaaccggggcccgucccuccgcacgaccaccgugaccgggaagaucauccacgaguggugcugccggagcugcacgcugccgccccugcgcuucaagggcgaggacgggugcugguacggcauggagauccggcccgucaaggagaaggaggagaaccucgugaaguccauggugagcgccggcagcggggaggucgacuccuucagccugggccugcucugcaccuccaucaugaucgaggaggugaugcgcagccgguggucccgcaagaugcugaugaccgggacccuggccguguuccuccugcugaucaugggccagcucacguggaacgaccugauccgccugugcaucauggucggggcgaacgccagcgaccggaugggcaugggcaccaccuaccucgcccugauggccaccuucaagaugcgcccgauguucgccguggggcuccuguuccggcgccugacgucccgggaggugcugcuccugaccaucgggcugagccucgucgcguccguggagcugcccaacagccuggaggagcucggggacggccuggccaugggcaucaugauccugaagcuccugaccgacuuccagucccaccagcugugggccacccuccugagccugacguucaucaagaccacccucucccugcacuacgccuggaagaccauggcgaugguccugagcaucgugucccucuucccccugugccugagcacgaccucccagaagaccaccuggcuccccgugcugcuggggagccucggcugcaagccgcugacgauguuccugaucgccgagaacaagaucugggggcgcaaguccuggccccucaacgagggcaucauggccgucgggguggugagcauccugcugagcucccuccugaagaacgacgucccccuggccggcccccucaucgccggcgggaugcugaucgcgugcuacgugaucagcggcuccagcgccgaccugucccucgagaaggccgccgaggugagcugggaggaggaggccgagcacuccggggcgagccacaacaucuucgucgaggugcaggacgacggcaccaugaagaucaaggacgaggagcgggacgacacccugaccauccugcucaaggccacccugcuggccguguccggggucuacccgcucagcauccccgccacgcuguucgugugguacuucuggcagaagaagaagcagcgcuccggcgugcugugggacacccccagcccgcccgaggucgagcgggccgcgcuggacgacggcaucuaccgcaucaugcagcgggggcuccugggccgcucccaggugggggugggcgucuuccaggagaacguguuccacaccauguggcacgugacccgcggggccguccugauguaccagggcaagcgccucgagcccagcugggccuccgugaagaaggaccugaucagcuacggcgggggcuggcggcugcagggguccuggaacacgggcgaggaggugcaggucaucgccguggagcccgggaagaaccccaagaacgugcagaccgcccccggcaccuucaagacccccgagggcgaggucggggcgaucgcccucgacuucaagcccggcacgagcgggucccccaucgugaaccgcgagggcaagaucgugggccuguacgggaacggcgucgugaccaccagcgggaccuacgugagcgccaucgcccagacgaaggcgucccaggagggcccgcugcccgagaucgaggacgaggucuuccggaagcgcaaccucaccaucauggaccugcaccccgggagcggcaagacccggcgcuaccugccggccaucgugcgggaggccaucaagcgcaagcuccgcacccugauccuggcccccacgcggguggucgccuccgagauggcggaggcccucaagggcaugcccauccgcuaccagaccaccgccgucaagagcgagcacaccgggaaggagaucguggaccugaugugccacgccacguucaccaugcggcugcucucccccguccgcgugccgaacuacaacaugaucaucauggacgaggcccacuucaccgaccccagcuccaucgcggcccggggcuacaucagcacccgcguggggaugggcgaggccgccgccaucuucaugacggcgacgccgcccggguccgucgaggccuucccgcagagcaacgccgugauccaggacgaggagcgggacauccccgagcgcuccuggaacagcggcuacgaguggaucaccgacuuccccggcaagaccgugugguucguccccuccaucaagagcgggaacgacaucgccaacugccugcggaagaacggcaagcgcgugauccagcugucccggaagacguucgacaccgaguaccagaagaccaagaacaacgacugggacuacguggucaccacggacaucagcgagaugggggcgaacuuccgcgccgaccgggugaucgacccgcgccggugccucaagcccgugauccugaaggacggccccgagcgcgucauccuggccgggcccaugccggugaccgucgccuccgccgcgcagcggcgcggccggaucggccgcaaccacaacaaggagggggaccaguacaucuacaugggccagccccucaacaacgacgaggaccacgcccacuggaccgaggccaagaugcugcuggacaacaucaacacccccgaggggaucauccccgcccucuucgagccggagcgcgagaaguccgccgcgaucgacggcgaguaccggcugcgcggggaggcccggaagacguucguggagcugaugcgccggggcgaccuccccguguggcuguccuacaaggucgccagcgagggcuuccaguacagcgaccgccgguggugcuucgacggggagcgcaacaaccaggugcuggaggagaacauggacguggagaucuggaccaaggagggcgagcggaagaagcuccgcccccgguggcuggacgcccgcaccuacuccgacccccuggcccuccgggaguucaaggaguucgcggccgggcgccggagcgucuccggcgaccugauccuggagaucggcaagcucccgcagcaccugacccagcgcgcccagaacgcccuggacaaccucgugaugcugcacaacagcgagcagggcgggcgggcguaccgccacgccauggaggagcugcccgacacgaucgagacccucaugcugcuggcccucaucgccgugcugaccgggggcgucacccuguucuuccucuccgggcggggccugggcaagaccagcaucgggcugcucugcgugauggccuccagcgugcugcuguggauggcguccgucgagccccacuggaucgccgccagcaucauccucgaguucuuccugauggugcugcucauccccgagccggaccgccagcggacgccccaggacaaccagcuggccuacguggucaucggccuccucuucaucauccugaccguggccgcgaacgagauggggcugcucgagaccaccaagaaggaccugggcaucgggcacguggccgucgagaaccaccaccacgccacgaugcuggacguggaccuccaccccgccuccgccuggacccuguacgcgguggccaccaccaucaucacgccgaugaugcgccacaccaucgagaacaccaccgccaacaucagccugacggccaucgccaaccaggcggccauccucaugggccuggacaagggcuggcccaucuccaagauggacaucggggucccccugcucgcccugggcugcuacagccaggugaacccccugacccucaccgccgcggugcugaugcuggucgcccacuacgccaucaucgggccgggccuccaggccaaggccacccgcgaggcgcagaagcggacggccgccgggaucaugaagaaccccaccguggacggcaucguggccaucgaccuggaccccgucguguacgacgccaaguucgagaagcagcugggccagaucaugcuccugauccugugcaccucccagauccuccugaugcgcaccacgugggcgcugugcgagagcaucacccucgccaccgggccccugaccacgcugugggagggcuccccggggaaguucuggaacaccaccaucgccgugagcauggccaacaucuuccggggcuccuaccucgccggcgcggggcuggccuucagccugaugaagucccucggcgggggccgccgggggaccggcgcccagggcgagacgcugggggagaaguggaagcgccagcugaaccagcucuccaagagcgaguucaacaucuacaagcgguccggcaucauggaggucgaccgcagcgaggccaaggaggggcugaagcggggcgagaccacccgccacgcggugucccgggggaccgccaagcugcgcugguucguggagcggaaccuggucaagcccgagggcaaggugaucgaccucggcugcgggcgcggcggguggagcuacuacugcgccggccugaagaaggugacggaggucaagggguacaccaagggcggccccgggcacgaggagcccaucccgauggccaccuacggcuggaaccuggugaagcuccacuccgggaaggacguguucuucacgccgcccgagaagugcgacacgcugcugugcgacaucggcgagagcucccccaacccgaccaucgaggaggggcggacccuccgcguccugaagaugguggagcccuggcugcggggcaaccaguucugcaucaagauccucaaccccuacaugcccagcguggucgagacccuggagcagaugcagcgcaagcacggcgggaugcuggugcggaacccgcucucccgcaacagcacccacgagauguacuggguguccugcggcacggggaacaucgucagcgccgugaacaugaccucccgcaugcugcugaaccgguucaccauggcgcaccgcaagcccaccuacgagcgggacguggaccucggcgccggcacgcgccacgucgccguggagcccgagguggccaaccuggacaucaucgggcagcggaucgagaacaucaagcacgagcacaagagcaccuggcacuacgacgaggacaaccccuacaagaccugggccuaccacggcuccuacgaggucaagccgagcggguccgcgagcagcauggugaacggcgucgugaagcugcucaccaagcccugggacgugauccccauggucacgcagaucgccaugaccgacaccacccccuucgggcagcagcgcguguucaaggagaagguggacacgcggaccccgaaggccaagcgcggcaccgcccagaucauggaggucaccgcccgguggcuguggggcuuccugucccgcaacaagaagccccggaucugcacgcgcgaggaguucacccggaaggugcgcagcaacgcggccaucggggccguguucgucgacgagaaccaguggaacuccgccaaggaggcgguggaggacgagcgguucugggaccucgugcagaaggagcgcgagcugcacaagcagggcaagugcgcgaccugcgucuacaacaugauggggaagcgggagaagaagcugggcgaguucgggaaggccaagggcagccgcgccaucugguacauguggcucggcgcccgguuccuggaguucgaggcgcugggguucaugaacgaggaccacugguucucccgcgagaacagccucuccggcguggagggggagggccugcacaagcugggguacauccuccgggacaucagcaagauccccggcggcaacauguacgccgacgacaccgccgggugggacacgcgcaucaccgaggacgaccugcagaacgaggccaagaucaccgacaucauggagccggagcacgcccugcucgcgaccuccaucuucaagcugacguaccagaacaaggugguccgcgugcagcggcccgccaagaacggcaccgugauggacgucaucagccgccgggaccagcgcggguccggccaggugggcaccuacgggcugaacaccuucacgaacauggaggcccagcucauccggcagauggagagcgagggcaucuuccugcccuccgagcuggagacccccaaccucgccgagcgcgugcuggacuggcuggagaaguacggggucgagcggcucaagcgcauggccaucagcggcgacgacugcguggugaagccgaucgacgaccgguucgcgaccgcccugaccgcccugaacgacauggggaagguccgcaaggacaucccccagugggagcccuccaagggcuggaacgacuggcagcagguccccuucugcagccaccacuuccaccagcucaucaugaaggacggccgggagaucguggucccgugccgcaaccaggacgagcugguggggcgggcccgcgugucccagggcgccggguggagccugcgggagacggcgugccucggcaagagcuacgcccagauguggcagcugauguacuuccaccgccgggaccugcgccucgccgccaacgcgaucugcuccgccguccccguggacugggugcccaccagccggaccaccugguccauccacgcccaccaccaguggaugacgaccgaggacaugcugagcgucuggaaccgcguguggaucgaggagaaccccuggauggaggacaagacccacguguccagcuggggcgacgucccguaccugggcaagcgcgaggaccaguggugcggcucccucaucgggcugaccgcccgggccaccugggcgagcaacauccagguggccaucaaccaggugcgccggcugaucggcaacgagaacuaccucgacuacaugacguccaugaagcgcuucaagaacgagggggaccccgagggcgcccugugguga

SEQ ID NO: 8583 - RNA, 9879 nt, Artificial Sequence
  derived and/or modified CDS sequence (opt1) from DENV-1__FJ898410__SS-prME
agcgugaccaugcugcugaugcugacccccaccgcccuggccuuccaccucaccacccggggcggggagccccacaugaucguguccaagcaggagcggggcaagagccugcuguucaagaccuccgcgggggugaacaugugcacgcucaucgccauggaccugggcgaguucugcgaggacaccaugaccuacaagugcccccgcaucaccgaggccgagcccgacgacguggacugcuggugcaacgccacggacaccugggucaccuacgggaccugcagccagacgggcgagcaccggcgggacaagcgguccguggcccuggcgccccacgugggccucgggcuggagacccgcaccgagaccuggaugagcuccgagggcgccuggaagcagauccagcgggucgagacgugggcccugcgccaccccggguucaccgugaucgcccucuuccuggcgcacgccaucggcaccagcaucacccagaaggggaucaucuucauccugcucaugcuggugacgcccuccauggccaugcggugcgucggcaucggcagccgcgacuucguggaggggcuguccggcgccaccuggguggacgucgugcucgagcacgggagcugcgugaccaccauggccaaggacaagcccacgcuggacaucgagcugcucaagaccgaggucaccaaccccgcggugcugcggaagcugugcaucgaggccaagaucuccaacaccacgaccgacagccgcugcccgacccagggcgaggccacccucguggaggagcaggacgccaacuucgucugccggcgcacguucguggaccggggcugggggaacggcugcgggcuguucggcaaggggucccugaucacgugcgccaaguucaagugcgugaccaagcucgagggcaagaucguccaguacgagaaccugaaguacagcgugaucgugaccguccacacgggcgaccagcaccagguggggaacgaguccaccgagcacggcaccaccgcgaccaucacgccccaggcccccagcaccgagauccagcugaccgacuacggggcccucacccuggacugcagcccccggacgggccuggacuucaacgagaugguccuccugaccaugaaggagaaguccuggcuggugcacaagcagugguuccucgaccugccccugcccuggaccagcggggccuccaccagccaggagacguggaaccggcaggaccuccuggugaccuucaagaccgcccacgcgaagaagcaggaggucguggugcugggcucccaggagggcgccaugcacaccgcccucacgggggccaccgagauccagaccagcggcaccacgaccaucuucgccgggcaccugaagugccgccugaagauggacaagcucacccugaagggcauguccuacgucaugugcaccgggagcuucaagcuggagaaggagguggcggagacgcagcacggcaccgugcucguccagaucaaguacgagggcaccgacgcccccugcaagauccccuucuccacccaggacgagaagggggugacgcagaacggccggcugaucaccgccaacccgaucgugaccgacaaggagaagcccgucaacaucgaggccgagccgcccuucggggagagcuacaucgugaucggcgcgggcgagaaggcccugaagcuguccugguucaagaaggggagcuccaucggcaagauguucgaggccaccgcccgcggggcccggcgcauggcgauccucggcgacacggccugggacuucgggagcaucggcggcguguucaccuccgucgggaagcuggugcaccagaucuucggcaccgccuacggggugcuguucagcggcgucuccuggaccaugaagaucgggaucggcgugcuccugacguggcugggccucaacagccgcuccaccagccuguccaugaccugcaucgccguggggcuggucacccucuaccugggcgugauggugcaggccgacagcgggugcgucaucaacuggaagggccgggagcugaagugcgggagcggcaucuucgugacgaacgaggugcacaccuggaccgagcaguacaaguuccaggcggacuccccgaagcgccucagcgccgccaucggcaaggccugggaggagggggucugcggcauccgguccgccacccgccuggagaacaucauguggaagcagaucagcaacgagcugaaccacauccuccuggagaacgacaugaagcugaccgugguggucggggacguggcgggcauccucgcccaggggaagaagaugauccggccccagcccauggaguacaaguacuccuggaagaucuggggcaaggccaagaucaucggcgccgacgugcagaacacgaccuucaucaucgacgggcccaacaccccggagugccccgacgaccagcgcgcguggaacaucugggaggucgaggacuacggcuucgggaucuucaccacgaacaucuggcugaagcugcgggacagcuacacccaggugugcgaccaccgccucauguccgccgccaucaaggacagcaaggccgugcacgccgacaugggcuacuggaucgaguccgagaagaacgagaccuggaagcuggcgcgggccagcuucaucgaggucaagaccugcaucuggcccaagucccacacgcuguggagcaacggcgugcucgaguccgagaugaucauccccaagaucuacgggggcccgaucagccagcacaacuaccgccccggguacuucacccagaccgccggccccuggcaccuggggaagcuggagcucgacuucgaccugugcgagggcaccacgguggucguggacgagcacugcggcaaccgggggccgucccugcgcaccaccaccgugacgggcaagaucauccacgaguggugcugccggagcugcacccugccgccccuccgcuucaagggggaggacggcugcugguacgggauggagauccggcccgucaaggagaaggaggagaaccuggugaaguccauggugagcgccggcagcggcgaggucgacuccuucagccucgggcugcugugcaucuccaucaugaucgaggaggugaugcgcagccgguggucccgcaagaugcucaugaccggcacccuggccguguucuuccugcucaucauggggcagcugacguggaacgaccugauccggcucugcaucauggucggcgcgaacgccagcgaccgcauggggaugggcaccaccuaccuggcccugauggccaccuucaagaugcgcccgauguucgccgugggccuccuguuccggcgccugacgucccgggaggugcuccugcugaccaucgggcucagccuggucgcguccguggagcugcccaacagccucgaggagcugggcgacgggcuggccaugggcaucaugauccucaagcugcugaccgacuuccagucccaccagcucugggccacccugcugagccucacguucauccgcaccaccuucucccugcacuacgccuggaagaccauggcgaugguccugagcaucgugucccucuucccccugugccugagcacgaccucccagaagaccaccuggcuccccgugcugcugggcagccucgggugcaagccgcugacgauguuccugaucgccgagaacaagaucuggggccggaaguccuggccccucaacgaggggaucauggccgucggcaucgugagcauccugcugagcucccuccugaagaacgacgugccccuggccgggccccucaucgccggcggcaugcugaucgcgugcuacgucaucagcggguccagcgccgaccugucccucgagaaggccgccgaggugagcugggaggaggaggccgagcacuccggcgcgagccacaacauccugguggagguccaggacgacgggaccaugaagaucaaggacgaggagcgcgacgacacccugaccauccuccugaaggccacccugcucgccguguccggcguguacccgcugagcauccccgccacgcuguucgucugguacuucuggcagaagaagaagcagcgguccggggugcucugggacacccccagcccgcccgagguggagcgcgccguccuggacgacggcaucuaccggaucaugcagcgcggccugcuggggcggucccaggugggcgugggggucuuccaggagaacguguuccacaccauguggcacgugacccgcggcgcgguccucauguaccaggggaagcggcuggagcccagcugggccuccgugaagaaggaccugaucagcuacggcggcggguggcgccuccagggcuccuggaacacgggggaggaggugcaggucaucgccguggagcccggcaagaaccccaagaacgugcagaccgcccccgggaccuucaagaccagcgagggcgaggucggcgccaucgcgcuggacuucaagcccgggacguccggcagccccaucgugaaccgggaggggaagaucgugggccuguacggcaacggggucgugaccaccagcggcaccuacguguccgccaucgcccaggccaaggcgagccaggaggggccccucccggagaucgaggacgaggucuuccgcaagcggaaccugacgaucauggaccugcaccccggcuccgggaagacccgccgguaccuccccgccaucgugcgcgaggccaucaagcggcgccugcgcacccugauccucgccccgacccggguggucgccagcgagauggcggaggcccugaagggcaugcccauccgcuaccagacgaccgccgugaaguccgagcacaccggcaaggagaucguggaccugaugugccacgccaccuucacgaugcggcuccugagccccguccgcgugcccaacuacaacaugaucaucauggacgaggcccacuucaccgacccguccagcaucgcggcccggggguacaucuccacccgcgugggcaugggggaggccgccgccaucuucaugaccgcgacgccgcccggcagcgucgaggccuucccccaguccaacgccgugauccaggacgaggagcgggacaucccggagcgcagcuggaacuccggguacgaguggaucaccgacuuccccggcaagaccgugugguucguccccagcaucaaguccggcaacgacaucgccaacugccugcggaagaacgggaagcgcgugauccagcucagccggaagaccuucgacacggaguaccagaagaccaagaacaacgacugggacuacguggucaccaccgacaucuccgagaugggcgcgaacuuccgcgccgaccgggugaucgacccccgccggugccugaagccggugauccugaaggacgggcccgagcgcgucauccucgccggccccaugcccgugacggucgccagcgccgcgcagcggcgcgggcggaucggccgcaaccacaacaaggagggcgaccaguacaucuacauggggcagccgcugaacaacgacgaggaccacgcccacuggaccgaggccaagaugcugcucgacaacaucaacacccccgagggcaucauccccgcccuguucgagcccgagcgcgagaaguccgccgcgaucgacggggaguaccggcugcgcggcgaggcccggaagaccuucguggagcucaugcgccgcggggaccugccgguguggcugagcuacaaggucgccagcgagggcuuccaguacuccgaccgccgguggugcuucgacggcgagcgcaacaaccaggugcucgaggagaacauggacguggagaucuggacgaaggagggggagcggaagaagcugcgcccccgguggcuggacgcccgcaccuacagcgacccccucgcccugcgggaguucaaggaguucgcggccggccgccgguccgucagcggggaccugauccucgagaucggcaagcugccccagcaccugacccagcgcgcccagaacgcccucgacaaccuggugaugcugcacaacuccgagcagggcgggcgggcguaccgccacgccauggaggagcucccggacaccaucgagacgcugaugcugcucgcccugaucgccgugcugaccggcggggucacccucuucuuccugagcggccgggggcugggcaagaccuccaucggccuccugugcgugauggccagcuccgugcugcucuggauggcgagcgucgagccccacuggaucgccgccuccaucauccuggaguucuuccugauggugcuccugauccccgagcccgaccgccagcggaccccgcaggacaaccagcuggccuacguggucaucgggcuccuguucaugauccugacgguggccgcgaacgagaugggccuccuggagaccaccaagaaggaccuggggaucggccacguggccgucgagaaccaccaccacgccgccaugcucgacguggaccugcaccccgccagcgcguggacccuguacgccguggccacgaccaucaucacccccaugaugcgccacaccaucgagaacacgaccgccaacaucucccucaccgccaucgcgaaccaggccgccauccugauggggcuggacaagggcuggccgaucagcaagauggacaucggcgucccccuccuggcccuggggugcuacucccaggugaacccccucacccugacggcggccgugcugaugcucgucgcccacuacgccaucaucggccccgggcugcaggccaaggcgacccgcgaggcccagaagcggaccgccgccggcaucaugaagaacccgaccguggacgggaucguggccaucgaccuggaccccgucguguacgacgcgaaguucgagaagcagcucggccagaucaugcugcugauccucugcacgagccagauccugcugaugcgcaccaccugggcccucugcgaguccaucacccuggccacgggcccccugaccacccucugggaggggagccccggcaaguucuggaacaccacgaucgccguguccauggccaacaucuuccgggggagcuaccuggcgggcgccggccuggccuucagccucaugaagucccucgggggcgggcgccgggggaccggggcccagggcgagacccugggcgagaaguggaagcgccagcucaaccagcugagcaagccggaguucaacaccuacaagcgguccgggaucauggaggucgaccgcagcgaggcgaaggagggccugaagcgcggggagacgaccaagcacgccgugucccgcggcaccgccaagcuccggugguucguggagcgcaaccuggucaagcccgaggggaaggugaucgaccugggcugcggccgcggcggguggagcuacuacugcgccgggcugaagaaggugaccgaggucaagggguacacgaagggcgggcccggccacgaggagcccaucccgauggccaccuacggguggaaccucgugaagcugcacuccggcaaggacguguucuucaucccgcccgagaagugcgacacccugcucugcgacaucggggagagcucccccaacccgaccaucgaggagggccgcacgcugcggguccugaagaugguggagcccuggcuccgcgggaaccaguucugcaucaagauccugaaccccuacaugcccagcguggucgagacccuggagcagaugcagcggaagcacggcggcaugcucgugcgcaacccgcugucccggaacagcacccacgagauguacuggguguccugcgggaccggcaacaucgucagcgcggugaacaugaccucccgcaugcugcucaaccgcuucacgauggcccaccggaagcccaccuacgagcgcgacguggaccugggggccggcacccggcacgucgccguggagcccgagguggccaaccuggacaucaucggccagcgcaucgagaacaucaagcacgagcacaagagcaccuggcacuacgacgaggacaaccccuacaagacgugggcguaccacggguccuacgaggucaagccgagcggcuccgccagcagcauggugaacggggucgugaagcuccugaccaagcccugggacgugauccccauggucacccagaucgccaugaccgacacgacccccuucggccagcagcggguguucaaggagaagguggacacccgcaccccgaaggccaagcgggggacggcccagaucauggaggucaccgcgaaguggcuguggggcuuccucucccgcaacaagaagccccggaucugcacccgcgaggaguucacccggaaggugcgcagcaacgccgccaucggcgccguguucgucgacgagaaccaguggaacuccgcgaaggaggccguggaggacgagcgguucugggaccuggugcaccgcgagcgggagcugcacaagcaggggaagugcgccacgugcgucuacaacaugaugggcaagcgcgagaagaagcucggggaguucggcaaggccaaggggagccgggccaucugguacauguggcugggcgcgcgcuuccuggaguucgaggcccucggcuucaugaacgaggaccacugguucucccgggagaacagccuguccgggguggagggcgaggggcugcacaagcucggcuacauccugcgcgacaucagcaagauccccgggggcaacauguacgccgacgacaccgccggcugggacacccggaucaccgaggacgaccugcagaacgaggccaagaucacggacaucauggagccggagcacgcgcuccuggccaaguccaucuucaagcugaccuaccagaacaaggugguccgcgugcagcgccccgccaagaacgggaccgugauggacgucaucagccggcgcgaccagcggggcuccggccaggugggcaccuacggccucaacacguucaccaacauggaggcccagcugauccgccagauggagagcgaggggaucuucucccccagcgagcuggagacccccaaccucgccggccgggugcuggacuggcuggagaagcacggggucgagcgccucaagcggauggcgaucuccggcgacgacugcguggugaagccgaucgacgaccgcuucgccaccgcccugacggcccugaacgacauggggaagguccggaaggacaucccccagugggagcccagcaagggcuggaacgacuggcagcagguccccuucugcucccaccacuuccaccagcucaucaugaaggacggccgcgagaucguggucccgugccggaaccaggacgagcugguggggcgcgcccgggugagccagggcgcgggguggagccugcgcgagaccgccugccucggcaaguccuacgcccagauguggcagcugauguacuuccaccggcgcgaccugcggcucgccgcgaacgccaucugcagcgccguccccguggacugggugcccaccucccgcaccacguggagcauccacgcccaccaccaguggaugaccaccgaggacaugcuguccgucuggaaccggguguggaucgaggagaaccccuggauggaggacaagacccacgugagcuccuggggcgacgucccguaccugggcaagcgcgaggaccaguggugcggcagccucaucgggcugacggcccgcgcgaccugggccaccaacauccagguggccaucaaccaggugcggcgccugcucggcaacgagaacuaccuggacuacaugaccuccaugaagcgguucaagaacgagagcgaccccgagggggcccugugguga

SEQ ID NO: 8584 - RNA, 9879 nt, Artificial Sequence
  derived and/or modified CDS sequence (opt1) from DENV-1__FJ898411__SS-prME
agcgugaccaugcugcucaugcugaugcccaccgcccuggccuuccaccucacgacccggggcggggagccccacaugaucgugagcaagcaggagcggggcaagagccugcuguucaagaccuccgccggggugaacaugugcacccucaucgccauggaccugggcgaguucugcgaggacaccaugaccuacaagugcccccgcaucaccgaggccgagcccgacgacguggacugcuggugcaacgccaccgacacgugggugaccuacgggaccugcagccagaccggcgagcaccggcgggacaagcgguccguggcccuggcgccccacgugggccucgggcuggagacgcgcaccgagaccuggaugagcuccgagggcgccuggaagcagauccagcgggucgagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugcccgacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaagaucguccaguacgagaaccugaaguacagcgugaucgugaccguccacaccggcgaccagcaccagguggggaacgaguccacggagcacggcaccaccgcgaccaucacgccccaggcccccagcacggagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccagcggggccuccaccagccaggagaccuggaaccggaaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcauguccuacgucaugugcaccgggagcuucaagcuggagaaggagguggcggagacccagcacggcacggugcucguccagaucaaguacgagggcaccgacgcccccugcaagauccccuucuccacccaggacgagaagggggugacccagaacggccggcugaucacggccaacccgaucgugaccgacaaggagaagcccgucaacaucgaggccgagccgcccuucggggagagcuacaucgugaucggcgcgggcgagaaggcccugaagcuguccugguucaagaaggggagcuccaucggcaagauguucgaggccaccgcccgcggggcccggcgcauggcgauccucggcgacaccgccugggacuucgggagcaucggcggcguguucacguccgucgggaagcuggugcaccagaucuucggcaccgccuacggggugcuguucagcggcgucuccuggaccaugaagaucgggaucggcgugcuccugaccuggcugggccucaacagccgcuccacgagccuguccaugaccugcaucgccguggggcuggucacccucuaccugggcgugauggugcaggccgacagcgggugcgucaucaacuggaagggccgggagcugaagugcgggagcggcaucuucgugaccaacgaggugcacacguggaccgagcaguacaaguuccaggcggacuccccgaagcgccucagcgccgccaucggcaaggccugggaggagggggucugcggcauccgguccgccacccgccuggagaacaucauguggaagcagaucagcaacgagcugaaccacauccuccuggagaacgacaugaaguucaccgugguggucggggacguggcgggcauccuggcccaggggaagaagaugauccggccccagcccauggaguacaaguacuccuggaaguccuggggcaaggccaagaucaucggcgccgacgugcagaacaccacguucaucaucgacgggcccaacaccccggagugccccgacgaccagcgcgcguggaacaucugggaggucgaggacuacggcuucgggaucuucaccaccaacaucuggcucaagcugcgggacuccuacacccaggugugcgaccaccgccugaugagcgccgccaucaaggacuccaaggccgugcacgccgacaugggcuacuggaucgagagcgagaagaacgagaccuggaagcucgcgcgggccuccuucaucgaggucaagaccugcaucuggcccaagagccacacccugugguccaacggcgugcuggagagcgagaugaucauccccaagaucuacgggggcccgaucucccagcacaacuaccgccccggguacuucacgcagaccgccggccccuggcaccucgggaagcuggagcuggacuucgaccucugcgagggcaccaccguggucguggacgagcacugcggcaaccgggggccgagccugcgcacgaccaccgugaccggcaagaucauccacgaguggugcugccgguccugcacgcugccgccccugcgcuucaagggggaggacggcugcugguacgggauggagauccggcccgucaaggagaaggaggagaaccuggucaagagcauggugagcgccggcuccggcgaggucgacagcuucucccuggggcuccugugcaucagcaucaugaucgaggaggugaugcgcucccgguggagccgcaagaugcugaugaccggcacccucgccguguucuuccugcugaucauggggcagcucaccuggaacgaccugauccggcugugcaucauggucggcgcgaacgccuccgaccgcauggggaugggcacgaccuaccucgcccugauggccaccuucaagaugcgcccgauguucgccguggggcuccuguuccggcgccugaccagccgggaggugcugcuccugacgaucgggcugucccucgucgcgagcguggagcugcccaacucccuggaggagcucggcgacgggcuggccaugggcaucaugauccugaagcuccugaccgacuuccagagccaccagcugugggccacccuccugucccugaccuucaucaagacgaccuucagccuccacuacgccuggaagaccauggcgaugguccuguccaucgugagccuguucccccucugccuguccaccacgagccagaagaccaccuggcugcccgugcuccugggcucccuggggugcaagccgcucaccauguuccugaucgccgagaacaagaucuggggccgcaagagcuggccccugaacgaggggaucauggccgucggcaucgugagcauccuccuguccgcccugcucaagaacgacgugccccuggccgggccccugaucgcgggcggcaugcucaucgccugcuacgucaucagcggguccagcgccgaccugucccuggagaaggccgccgaggugagcugggaggaggaggcggagcacuccggcgccagccacaacauccucguggagguccaggacgacgggacgaugaagaucaaggacgaggagcgggacgacacccugaccauccugcucaaggccacccugcuggccguguccggcguguacccgcucagcauccccgccacccuguucgucugguacuucuggcagaagaagaagcagcgcuccggggugcugugggacacgcccagcccgcccgagguggagcgggcgguccucgacgacggcaucuaccgcaucaugcagcggggccugcuggggcgcucccaggugggcgugggggucuuccaggagaacguguuccacaccauguggcacgugacccggggcgccguccugauguaccaggggaagcgccucgagcccagcugggccuccgugaagaaggaccugaucagcuacggcggcggguggcggcugcagggcuccuggaacaccggggaggaggugcaggucaucgccguggagcccggcaagaaccccaagaacgugcagacggcccccgggaccuucaagaccagcgagggcgaggucggcgcgaucgcccucgacuucaagcccgggaccuccggcagccccaucgugaaccgcgaggggaagaucgugggccuguacggcaacggggucgugacgaccagcggcaccuacguguccgccaucgcccaggcgaaggccagccaggaggggccccugccggagaucgaggacgaggucuuccggaagcgcaaccucaccaucauggaccugcaccccggcuccgggaagacgcggcgcuaccugcccgccaucgugcgggaggccaucaagcgcaagcuccggacccugauccuggccccgacccgcguggucgcgagcgagauggccgaggcccucaagggcaugcccauccgcuaccagaccacggccgugaaguccgagcacaccggcaaggagaucguggaccugaugugccacgccaccuucaccaugcggcugcucagccccguccgcgugcccaacuacaacaugaucaucauggacgaggcgcacuucacggacccguccagcaucgccgcccggggguacaucuccacccgcgugggcaugggggaggccgccgcgaucuucaugaccgccacgccgcccggcagcgucgaggccuucccccaguccaacgccgugauccaggacgaggagcgggacaucccggagcgcagcuggaacuccggguacgaguggaucacggacuuccccggcaagaccgugugguucguccccagcaucaaguccggcaacgacaucgcgaacugccugcggaagaacgggaagcgcgugauccagcugagccggaagaccuucgacaccgaguaccagaagacgaagaacaacgacugggacuacguggucaccaccgacaucuccgagaugggcgccaacuuccgcgccgaccgggugaucgacccccgccggugccucaagccggugauccugaaggacgggcccgagcgcgucauccuggccggccccaugcccgugaccgucgccagcgcggcccagcggcgcgggcggaucggccgcaaccacaacaaggagggcgaccaguacaucuacauggggcagccgcucaacaacgacgaggaccacgcccacuggacggaggccaagaugcugcuggacaacaucaacacccccgagggcaucauccccgcccucuucgagcccgagcgggagaaguccgcggccaucgacggggaguaccgccugcgcggcgaggcccggaagaccuucguggagcugaugcgccgcggggaccucccgguguggcugagcuacaaggucgccagcgagggcuuccaguacuccgaccgccgguggugcuucgacggcgagcgcaacaaccaggugcuggaggagaacauggacguggagaucuggaccaaggagggggagcggaagaagcuccgcccccgguggcuggacgcccgcacguacagcgacccccuggcgcuccgggaguucaaggaguucgccgccggccgccgguccgucagcggggaccugauccuggagaucggcaagcucccccagcaccugacccagcgcgcccagaacgcgcuggacaaccucgugaugcugcacaacuccgagcagggcgggcgggccuaccgccacgccauggaggagcugccggacaccaucgagacccucaugcugcuggcccucaucgccgugcugacgggcggggucacccuguucuuccucagcggccgggggcugggcaagaccuccaucggccugcucugcgugauggcgagcuccgugcugcuguggauggccagcgucgagccccacuggaucgccgccuccaucauccucgaguucuuccugauggugcugcucauccccgagcccgaccgccagcggaccccgcaggacaaccagcuggccuacguggucaucgggcuccucuucaugauccugaccguggcggccaacgagaugggccugcucgagacgaccaagaaggaccuggggaucggccacguggccgucgagaaccaccaccacgccgccaugcuggacguggaccuccaccccgcgagcgccuggacccuguacgccguggccaccacgaucaucacccccaugaugcgccacaccaucgagaacaccacggccaacaucucccugaccgcgaucgccaaccaggccgccauccucauggggcuggacaagggcuggccgaucagcaagauggacaucggcgucccccugcucgcgcuggggugcuacucccaggugaacccccugacccucaccgccgccgugcugaugcuggucgcccacuacgccaucaucggccccgggcuccaggcgaaggccacgcgggaggcccagaagcgcaccgccgccggcaucaugaagaacccgaccguggacgggaucguggcgaucgaccuggaccccgucguguacgacgccaaguucgagaagcagcugggccagaucaugcuccugauccugugcaccagccagauccuccugaugcgcacgaccugggcccugugcgaguccaucacccucgccaccggcccccugacgacccugugggaggggagccccggcaaguucuggaacaccaccaucgccguguccauggcgaacaucuuccgggggagcuaccucgccggcgccggccuggccuucagccugaugaagucccucgggggcgggcgccggggcacgggggcgcagggcgagacccugggcgagaaguggaagcgccagcugaaccagcucagcaaguccgaguucaacaccuacaagcggagcgggaucauggaggucgaccgcuccgaggccaaggagggccugaagcgcggggagaccacgaagcacgccgugagccgcggcaccgccaagcugcggugguucguggagcgcaaccucgucaagccggaggggaaggugaucgaccugggcugcggccgcggcgggugguccuacuacugcgccgggcugaagaaggugaccgaggucaagggguacaccaagggcgggcccggccacgaggagcccauccccauggcgacguacggguggaaccuggugaagcuccacagcggcaaggacguguucuucaucccgcccgagaagugcgacacccugcugugcgacaucggggaguccagccccaaccccaccaucgaggagggccgcacccuccggguccugaagaugguggagccguggcugcgcgggaaccaguucugcaucaagauccucaaccccuacaugcccuccguggucgagacgcuggagcagaugcagcggaagcacggcggcaugcuggugcgcaacccccucagccggaacuccacccacgagauguacugggugagcugcgggaccggcaacaucgucuccgccgugaacaugaccagccgcaugcugcugaaccgguucaccauggcccaccgcaagccgacguacgagcgcgacguggaccucggggccggcacccggcacgucgccguggagcccgagguggcgaaccuggacaucaucggccagcgcaucgagaacaucaagcacgagcacaaguccaccuggcacuacgacgaggacaaccccuacaagaccugggccuaccacgggagcuacgaggucaagcccuccggcagcgccagcuccauggugaacggggucgugaagcugcucacgaagccgugggacgugauccccauggucacccagaucgccaugaccgacaccacgcccuucggccagcagcggguguucaaggagaagguggacacccgcacccccaaggccaagcgggggaccgcgcagaucauggaggucacggccaaguggcuguggggcuuccugagccgcaacaagaagccgcggaucugcacccgcgaggaguucacccggaaggugcgcuccaacgccgccaucggcgcgguguucgucgacgagaaccaguggaacagcgccaaggaggccguggaggacgagcgguucugggaccucgugcaccgcgagcgggagcugcacaagcaggggaagugcgcgaccugcgucuacaacaugaugggcaagcgcgagaagaagcugggggaguucggcaaggccaaggggucccgggcgaucugguacauguggcucggcgcccgcuuccuggaguucgaggcccugggcuucaugaacgaggaccacugguucagccgggagaacucccucagcgggguggagggcgaggggcugcacaagcugggcuacauccuccgcgacaucuccaagauccccgggggcaacauguacgccgacgacacggccggcugggacacccggaucaccgaggacgaccugcagaacgaggcgaagaucaccgacaucauggagcccgagcacgcccugcucgccaagagcaucuucaagcugacguaccagaacaaggugguccgcgugcagcggccggccaagaacgggaccgugauggacgucaucucccgccgcgaccagcggggcagcggccaggugggcaccuacggccugaacaccuucacgaacauggaggcccagcucauccgccagauggaguccgaggggaucuucagccccuccgagcuggagacccccaaccuggcgggccgggugcucgacuggcuggagaagcacggggucgagcgccugaagcggauggccaucagcggcgacgacugcguggugaagcccaucgacgaccgcuucgccaccgcccucaccgcccugaacgacauggggaagguccggaaggacaucccgcagugggagcccuccaagggcuggaacgacuggcagcagguccccuucugcagccaccacuuccaccagcugaucaugaaggacggccgcgagaucgugguccccugccggaaccaggacgagcucguggggcgcgcgcgggugagccagggcgccggguggucccugcgcgagacggccugccugggcaagagcuacgcccagauguggcagcucauguacuuccaccggcgcgaccugcggcuggcggccaacgccaucugcuccgccgucccgguggacugggugcccaccagccgcaccaccugguccauccacgcccaccaccaguggaugacgaccgaggacaugcucagcgucuggaaccggguguggaucgaggagaaccccuggauggaggacaagacccacaucuccagcuggggcgacgugcccuaccugggcaagcgcgaggaccaguggugcggcucccugaucgggcucaccgcgcgggccacgugggccaccaacauccaggucgccaucaaccaggugcgccgccugaucggcaacgagaacuaccuggacuacaugaccagcaugaagcgguucaagaacgaguccgacccggagggggcccucugguga

SEQ ID NO: 8585 - RNA, 9879 nt, Artificial Sequence
  derived and/or modified CDS sequence (opt1) from DENV-1__FJ898412__SS-prME
agcgugaccaugcugcucaugcugaugcccaccgcccuggccuuccaccucaccacccggggcggggagccccacaugaucgugaccaagcaggagcggggcaagagccugcuguucaagaccagcgccggggugaacaugugcacccucaucgccauggaccugggcgagcugugcgaggacaccaugaccuacaagugcccccggaucaccgaggccgagcccgacgacguggacugcuggugcaacgccaccgacaccugggugaccuacgggaccugcagccagacgggcgagcaccggcgcgacaagcggagcguggcccucgcgccccacgugggccuggggcuggagacccgcaccgagaccuggauguccagcgagggcgccuggaagcagauccagcgggucgagacgugggcccuccgccaccccggguucaccgugaucgcccuguuccuggcgcacgccaucggcaccuccaucacccagaaggggaucaucuucauccuccugaugcuggugacgcccagcauggccaugcggugcgucggcaucggcucccgcgacuucguggaggggcucagcggcgccaccuggguggacgucgugcuggagcacggguccugcgugaccaccauggccaaggacaagcccacgcuggacaucgagcuccugaagaccgaggucaccaaccccgcggugcugcggaagcucugcaucgaggccaagaucagcaacaccacgaccgacucccgcugccccacccagggcgaggccacccugauggaggagcaggacgccaacuucgugugccggcgcacguucgucgaccggggcugggggaacggcugcgggcuguucggcaaggggagccucaucacgugcgccaaguucaagugcgugaccaagcuggagggcaagaucgugcaguacgagaaccugaaguacuccgucaucgugaccgugcacacgggcgaccagcaccaggucgggaacgagagcaccgagcacggcaccaccgcgaccaucacgccccaggcccccaccuccgagauccagcucaccgacuacggggcccugacccuggacugcagcccccgcacgggccucgacuucaacgagauggugcugcugaccaugaaggagaaguccuggcucguccacaagcagugguuccuggaccugccgcuccccuggaccagcggggccagcaccucccaggagacguggaaccggcaggaccugcuggugaccuucaagaccgcccacgcgaagaagcaggagguggucgugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgugaugugcaccggguccuucaagcucgagaaggaggucgcggagacgcagcacggcaccgugcuggugcagaucaaguacgagggcaccgacgcccccugcaagauccccuucagcacccaggacgagaagggggucacgcagaacggccggcugaucaccgccaacccgaucgugaccgacaaggagaagcccgugaacaucgaggccgagccgcccuucggggaguccuacaucgucaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcguggggaagcugguccaccagaucuucggcaccgccuacgggguccuguucuccggcgugagcuggaccaugaagaucgggaucggcguccugcugacguggcucggccugaacucccgcagcaccucccugagcaugaccugcaucgccguggggcucgugacccuguaccugggcgucauggugcaggccgacuccgggugcgugaucaacuggaagggccgggagcucaagugcgggagcggcaucuucgucacgaacgaggugcacaccuggaccgagcaguacaaguuccaggcggacagcccgaagcgccuguccgccgccaucggcaaggccugggaggagggggugugcggcauccggagcgccacccgccuggagaacaucauguggaagcagaucuccaacgagcucaaccacauccugcuggagaacgacaugaaguucaccgucguggugggggacgucgugggcauccucgcgcaggggaagaagaugauccggccccagcccauggagcacaaguacagcuggaaguccuggggcaaggccaagaucaucggcgccgacgugcagaacacgaccuucaucaucgacgggcccaacaccccggagugccccgacgaccagcgcgccuggaacaucugggaggucgaggacuacggcuucgggaucuucaccacgaacaucuggcugaagcugcgggacagcuacacccaggugugcgaccaccgccucauguccgcggccaucaaggacagcaaggccgugcacgccgacaugggcuacuggaucgaguccgagaagaacgagaccuggaagcuggcccgggcgagcuucaucgaggucaagaccugcaucuggcccaagucccacacgcuguggagcaacggcgugcucgaguccgagaugaucauccccaagaucuacgggggcccgaucagccagcacaacuaccgccccggguacuucacccagaccgccggccccuggcaccuggggaagcuggagcucgacuucgaccugugcgagggcaccacgguggucguggacgagcacugcggcaaccgggggccgucccugcgcaccaccaccgugacgggcaagaucauccacgaguggugcugccggagcugcacccugccgccccuccgcuucaagggggaggacggcugcugguacgggauggagauccggcccgucaaggagaaggaggagaaccuggugaaguccauggugagcgccggcagcggcgaggucgacuccuucagccucgggcugcugugcaucuccaucaugaucgaggaggugaugcgcagccgguggucccgcaagaugcucaugaccggcacccuggccguguuccugcuccugaucauggggcagcugacguggaacgaccucauccggcugugcaucauggucggcgccaacgcgagcgaccgcauggggaugggcaccaccuaccuggcccucauggccaccuucaagaugcgcccgauguucgccguggggcugcuguuccggcgccucacgucccgggaggugcugcugcucaccaucgggcugagccuggucgccuccguggagcuccccaacagccuggaggagcugggcgacgggcucgcgaugggcaucaugauccugaagcugcucaccgacuuccagucccaccagcugugggccacccugcucagccugacguucaucaagaccacccugucccuccacuacgccuggaagaccauggccaugguccugagcaucgugucccuguucccccucugccugagcacgaccucccagaagaccaccuggcugcccgugcuccugggcagccuggggugcaagccgcucacgauguuccugaucgcggagaacaagaucuggggccgcaaguccuggccccugaacgaggggaucauggccgucggcguggugagcauccuccugagcucccugcucaagaacgacgucccccuggccgggccccugaucgccggcggcaugcucaucgccugcuacgugaucagcggguccagcgcggaccugucccuggagaaggccgccgaggugagcugggaggaggaggccgagcacuccggcgccagccacaacauccucgucgaggugcaggacgacgggaccaugaagaucaaggacgaggagcgggacgacacccugaccauccugcucaaggcgacccugcuggccguguccggcgucuacccgcucagcauccccgccacgcuguucgugugguacuucuggcagaagaagaagcagcgcuccggggugcugugggacacccccagcccgcccgaggucgagcgggccgugcuggacgacggcaucuaccgcaucaugcagcggggccuccuggggcgcucccaggugggcgucgggguguuccaggagaacguguuccacaccauguggcacgucacccggggcgccgugcugauguaccaggggaagcgccucgagcccagcugggcguccgugaagaaggaccugaucagcuacggcggcggguggcggcugcagggcuccuggaacacgggggaggagguccaggugaucgccguggagcccggcaagaaccccaagaacguccagaccgcccccgggaccuucaagacccccgagggcgaggugggcgccaucgcccucgacuucaagcccgggacgagcggcucccccaucgugaaccgcgaggggaagaucgucggccuguacggcaacgggguggugaccaccagcggcaccuacgucagcgcgaucgcccaggccaaggccucccaggaggggccgcugcccgagaucgaggacgagguguuccggaagcgcaaccucacgaucauggaccugcaccccggcagcgggaagacccggcgcuaccugccggcgaucgugcgggaggccaucaagcgcaagcuccggacccugauccuggcccccacccgcgucguggccuccgagauggccgaggcgcucaagggcaugcccauccgcuaccagacgaccgccgucaagagcgagcacaccggcaaggagaucgucgaccugaugugccacgccaccuucacgaugcggcugcucucccccgugcgcgugccgaacuacaacaugaucaucauggacgaggcccacuucaccgaccccagcuccaucgccgcgcggggguacaucagcacccgcgucggcaugggggaggccgccgccaucuucaugaccgccacgccgcccggcuccguggaggcguucccgcagagcaacgccgugauccaggacgaggagcgggacauccccgagcgcuccuggaacagcggguacgaguggaucaccgacuuccccggcaagaccgucugguucgugcccuccaucaagagcggcaacgacaucgccaacugccugcggaagaacgggaagcgcgugauccagcugucccggaagaccuucgacacggaguaccagaagaccaagaacaacgacugggacuacgucgugaccaccgacaucagcgagaugggcgccaacuuccgcgcggaccgggugaucgacccgcgccggugccucaagcccgucauccugaaggacgggcccgagcgcgugauccuggccggccccaugccggucacgguggccuccgccgcccagcggcgcgggcggaucggccgcaaccacaacaaggagggcgaccaguacaucuacauggggcagccccucaacaacgacgaggaccacgcgcacuggaccgaggccaagaugcugcuggacaacaucaacacccccgagggcaucauccccgcccucuucgagccggagcgggagaaguccgccgccaucgacggggaguaccgccugcgcggcgaggcgcggaagaccuucguggagcugaugcgccgcggggaccuccccgucuggcuguccuacaagguggccagcgagggcuuccaguacagcgaccgccgguggugcuucgacggcgagcgcaacaaccaggugcuggaggagaacauggacgucgagaucuggacgaaggagggggagcggaagaagcuccgcccccgguggcuggacgcccgcaccuacuccgacccccuggcccuccgggaguucaaggaguucgccgcgggccgccggagcguguccggggaccugauccuggagaucggcaagcucccgcagcaccugacccagcgcgcccagaacgcccuggacaaccucgugaugcugcacaacagcgagcagggcgggcgggccuaccgccacgcgauggaggagcugcccgacaccaucgagacgcucaugcugcuggcccucaucgccguccugaccggcggggugacccuguucuuccucuccggccgggggcugggcaagaccagcaucggccugcucugcgugauggccuccagcguccugcuguggauggccuccguggagccccacuggaucgcggccagcaucauccucgaguucuuccugauggugcugcucauccccgagccggaccgccagcggacgccccaggacaaccagcuggccuacgucgugaucgggcuccucuucaugauccugacgguggccgccaacgagaugggccugcucgagaccaccaagaaggaccuggggaucggccacgucgcgguggagaaccaccaccacgugaccaugcuggacgucgaccuccaccccgccuccgccuggacgcuguacgccguggccaccaccaucaucaccccgaugaugcgccacacgaucgagaacaccaccgcgaacaucagccugaccgccaucgccaaccaggccgccauccucauggggcuggacaagggcuggcccaucuccaagauggacaucggcgugccccugcucgcgcuggggugcuacagccaggucaacccccugacgcucaccgccgccgugcugaugcugguggcccacuacgcgaucaucggcccggggcuccaggccaaggccacccgggaggcccagaagcgcaccgccgcgggcaucaugaagaaccccacggucgacgggaucguggccaucgaccuggaccccguggucuacgacgccaaguucgagaagcagcugggccagaucaugcuccugauccugugcaccucccagauccuccugaugcgcaccaccugggcccugugcgagagcaucacgcucgccaccggcccccugaccacccugugggagggguccccgggcaaguucuggaacacgaccaucgcggugagcauggccaacaucuuccggggguccuaccucgccggcgccggccuggccuucagccugaugaagucccucgggggcgggcgccggggcaccggggcgcagggcgagacccugggcgagaaguggaagcgccagcugaaccagcucuccaagagcgaguucaacaucuacaagcgguccgggaucauggagguggaccgcagcgaggccaaggagggccugaagcgcggggagacgacccgccacgccgucucccggggcaccgccaagcugcgcugguucguggagcggaaccuggugaagcccgaggggaaggucaucgaccucggcugcggccgcgggggcuggagcuacuacugcgcggggcugaagaaggugaccgaggugaagggcuacacgaagggcgggcccggccacgaggagcccaucccgauggccaccuacggguggaaccuggucaagcuccacuccggcaaggacguguucuucacgccgcccgagaagugcgacacccugcugugcgacaucggggagagcucccccaacccgacgaucgaggagggccggacccuccgcgugcugaagauggucgagcccuggcugcgggggaaccaguucugcaucaagauccucaaccccuacaugcccagcgugguggagacccuggagcagaugcagcgcaagcacggcggcaugcugguccggaacccgcucucccgcaacagcacccacgagauguacuggguguccugcgggaccggcaacaucgugagcgccgucaacaugacgucccggaugcugcugaaccgcuucaccauggcccaccgcaagcccaccuacgagcgggacguggaccucggggccggcacccgccacguggcggucgagcccgagguggccaaccuggacaucaucggccagcggaucgagaacaucaagcacgagcacaagagcacguggcacuacgacgaggacaaccccuacaagaccugggccuaccacggguccuacgaggucaagccgagcggcuccgccagcagcauggugaacgggguggucaagcugcucaccaagcccugggacgugauccccauggugacccagaucgccaugacggacaccacccccuucggccagcagcgcgucuucaaggagaagguggacacccggacgccgaaggcgaagcgcgggaccgcccagaucauggaggugaccgcccgguggcuguggggcuuccugucccgcaacaagaagccccggaucugcacccgcgaggaguucacgcggaagguccgcagcaacgccgccaucggcgcgguguucguggacgagaaccaguggaacuccgccaaggaggccgucgaggacgagcgguucugggaccucgugcagaaggagcgcgagcugcacaagcaggggaagugcgcgaccugcguguacaacaugaugggcaagcgggagaagaagcugggggaguucggcaaggcgaaggggagccgcgccaucugguacauguggcucggcgcccgguuccuggaguucgaggcccugggcuucaugaacgaggaccacugguucucccgcgagaacagccucuccggggucgagggcgaggggcugcacaagcugggcuacauccuccgggacaucagcaagauccccgggggcaacauguacgccgacgacaccgcgggcugggacacccgcaucacggaggacgaccugcagaacgaggccaagaucaccgacaucauggagccggagcacgcccugcucgccaccuccaucuucaagcugaccuaccagaacaagguggugcggguccagcgccccgccaagaacgggacggugauggacgugaucagccgccgggaccagcgcggcuccgggcaggucggcaccuacggccugaacaccuucaccaacauggaggcgcagcucauccggcagauggagagcgaggggaucuuccugcccuccgagcuggagacgcccaaccucgccgagcgcgugcuggacuggcuggagaaguacggcguggagcggcucaagcgcauggccaucagcggggacgacugcgucgugaagccgaucgacgaccgguucgccaccgcccugaccgcgcugaacgacaugggcaaggugcgcaaggacaucccccagugggagcccuccaagggguggaacgacuggcagcagguccccuucugcagccaccacuuccaccagcucaucaugaaggacggccgggagaucguggugccgugccgcaaccaggacgagcuggucggccgggcccgcgugucccagggggccggcuggagccugcgggagaccgccugccucggcaagagcuacgcccagauguggcagcugauguacuuccaccgccgggaccugcgccucgcggccaacgccaucugcuccgccgugcccgucgacugggugcccacgagccggaccaccugguccauccacgcgcaccaccaguggaugaccacggaggacaugcugagcguguggaaccgcgucuggaucgaggagaaccccuggauggaggacaagacccacguguccagcuggggcgacgugccguaccuggggaagcgggaggaccaguggugcggcucccucaucggccugaccgcccgcgccaccugggccagcaacauccaggucgccaucaaccaggugcgccggcugaucgggaacgagaacuaccucgacuacaugaccuccaugaagcgcuucaagaacgagggcgaccccgagggggcgcugugguga

SEQ ID NO: 8586 - RNA, 9879 nt, Artificial Sequence
  derived and/or modified CDS sequence (opt1) from DENV-1__GQ199852__SS-prME
agcgugaccaugcugcucaugcugaugcccaccgcccuggccuuccaccucaccacccggggcggggagccccacaugaucgugaccaagcaggagcggggcaagagccugcuguucaagaccagcgcgggggugaacaugugcacccucaucgccauggaccugggcgagcugugcgaggacaccaugaccuacaagugcccccggaucaccgaggccgagcccgacgacguggacugcuggugcaacgccaccgacaccugggugaccuacgggaccugcucccagaccggcgagcaccggcgcgacaagcggagcguggcccucgcgccccacgugggccuggggcuggagacccgcaccgagaccuggauguccagcgagggcgccuggaagcagauccagcgggucgagacgugggcccuccgccacccgggguucaccgugaucgcccuguuccuggcgcacgccaucggcaccuccaucacccagaaggggaucaucuucauccuccugaugcuggugacgcccagcauggccaugcggugcgucggcaucggcucccgcgacuucguggaggggcucagcggcgccaccuggguggacgucgugcuggagcacggguccugcgugaccaccauggccaaggacaagcccacgcuggacaucgagcuccugaagaccgaggucaccaaccccgcggugcugcggaagcucugcaucgaggccaagaucagcaacaccacgaccgacucccgcugcccgacccagggcgaggccacccugauggaggagcaggacgccaacuucgugugccggcgcacguucgucgaccggggcugggggaacggcugcgggcuguucggcaaggggagccucaucacgugcgccaaguucaagugcgugaccaagcuggagggcaagaucgugcaguacgagaaccugaaguacuccgucaucgugaccgugcacacgggcgaccagcaccaggucgggaacgagagcaccgagcacggcaccaccgcgaccaucacgccccaggcccccaccuccgagauccagcucaccgacuacggggcccugacccuggacugcagcccccgcacgggccucgacuucaacgagauggugcugcugaccaugaaggagaaguccuggcucguccacaagcagugguuccuggaccugccgcuccccuggaccagcggggccagcaccucccaggagacguggaaccggcaggaccugcuggugaccuucaagaccgcccacgcgaagaagcaggagguggucgugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgugaugugcaccggguccuucaagcucgagaaggaggucgcggagacgcagcacggcaccgugcuggugcagaucaaguacgagggcaccgacgcccccugcaagauccccuucagcacccaggacgagaagggggucacgcagaacggccggcugaucaccgccaacccgaucgugaccgacaaggagaagcccgugaacaucgaggccgagccgcccuucggggaguccuacaucgucaucggcgcgggcgagaaggcccugaagcucagcugguucaagaagggguccagcaucggcaagauguucgaggccaccgcccgcggggcccggcgcauggcgauccugggcgacacggccugggacuucggguccgugggcggcguguucaccagcgucgggaagcuggugcaccagaucuucggcaccgccuacgggguccuguucuccggcgucagcuggaccaugaagaucgggaucggcgugcugcugacguggcucggccugaacucccgcagcaccucccugagcaugaccugcaucgccguggggcucgucacccuguaccugggcgugauggugcaggccgacuccgggugcgucaucaacuggaagggccgggagcucaagugcgggagcggcaucuucgugacgaacgaggugcacaccuggaccgagcaguacaaguuccaggcggacagcccgaagcgccuguccgccgccaucggcaaggccugggaggagggggucugcggcauccggagcgccacccgccuggagaacaucauguggaagcagaucuccaacgagcucaaccacauccugcuggagaacgacaugaaguucaccgugguggucggggacguggugggcauccucgcgcaggggaagaagaugauccggccccagcccauggagcacaaguacagcuggaaguccuggggcaaggccaagaucaucggcgccgacguccagaacacgaccuucaucaucgacgggcccaacaccccggagugccccgacgaccagcgcgccuggaacaucugggagguggaggacuacggcuucgggaucuucaccacgaacaucuggcugaagcugcgggacagcuacacccaggugugcgaccaccgccucauguccgcggccaucaaggacagcaaggccguccacgccgacaugggcuacuggaucgaguccgagaagaacgagaccuggaagcuggcccgggcgagcuucaucgaggugaagaccugcaucuggcccaagucccacacgcuguggagcaacggcgugcucgaguccgagaugaucauccccaagaucuacgggggcccgaucagccagcacaacuaccgccccggguacuucacccagaccgccggccccuggcaccuggggaagcuggagcucgacuucgaccugugcgagggcaccacggucgugguggacgagcacugcggcaaccgggggccgucccugcgcaccaccaccgucacgggcaagaucauccacgaguggugcugccggagcugcacccugccgccccuccgcuucaagggggaggacggcugcugguacgggauggagauccggcccgugaaggagaaggaggagaaccuggugaaguccauggucagcgccggcagcggcgagguggacuccuucagccucgggcugcugugcaucuccaucaugaucgaggaggugaugcgcagccgguggucccgcaagaugcucaccaccggcacgcuggccgucuuccugcuccugaucauggggcagcugaccuggaacgaccucauccggcugugcaucauggugggcgccaacgcgagcgaccgcauggggaugggcaccaccuaccuggcccucauggccacguucaagaugcgcccgauguucgccgugggccugcuguuccggcgccucaccucccgggagguccugcugcucaccaucgggcugagccugguggccuccgucgagcuccccaacagccuggaggagcugggcgacgggcucgcgaugggcaucaugauccugaagcugcucaccgacuuccagucccaccagcugugggccacgcugcucagccugaccuucaucaagaccacccugccccuccacugcgccuggaagacgauggccauggugcuguccaucgcgagccuguucccccucugccuguccaccaccagccagaagaccacguggcugccggugcuccugggcucccuggggugcaagccccucaccauguuccugaucaccgagaccaagaucuggggccgcaagagcuggccccugaacgaggggaucauggccgucggcgugguguccauccuccugagcagccugcucaagaacgacgucccccuggccgggccgcugaucgccggcggcaugcucaucgccugcuacgugaucuccgggagcuccgcggaccugagccuggagaaggccgccgagguguccugggaggaggaggccgagcacagcggcgccucccacaacauccucgucguggugcaggacgacgggaccaugaagaucaaggacgaggagcgggacgacacgcugaccauccugcucaaggcgacccugcuggccgucagcggcguguacccccucuccauccccgccacccuguucgugugguacuucuggcagaagaagaagcagcgcagcgggguccugugggacacgcccuccccgcccgagguggagcgggccgugcuggacgacggcaucuaccgcaucaugcagcggggccuccuggggcgcagccaggucggcguggggguguuccaggagaacgucuuccacaccauguggcacgugacccggggcgccgugcugauguaccaggggaagcgccucgagcccuccugggcgagcgucaagaaggaccugaucuccuacggcggcggguggcggcugcagggcagcuggaacaccggggaggagguccaggugaucgccgucgagcccggcaagaacccgaagaacgugcagacggcccccgggaccuucaagacccccgagggcgaggugggcgccaucgcccucgacuucaagcccgggaccuccggcagcccgaucgucaaccgcgaggggaagaucgugggccuguacggcaacgggguggucacgaccuccggcaccuacgugagcgcgaucgcccaggccaaggccagccaggaggggccccugcccgagaucgaggacgagguguuccggaagcgcaaccucaccaucauggaccugcacccgggcuccgggaagacgcggcgcuaccugcccgcgaucguccgggaggccaucaagcgcaagcuccggacccugauccuggcccccacccgcgugguggccagcgagauggccgaggcgcucaagggcaugcccauccgcuaccagaccacggccgucaaguccgagcacaccggcaaggagaucguggaccugaugugccacgccaccuucaccaugcggcugcucagcccggugcgcguccccaacuacaacaugaucaucauggacgaggcccacuucacggaccccuccagcaucgccgcgcggggguacaucuccacccgcgugggcaugggggaggccgccgccaucuucaugaccgccacgccgcccggcagcguggaggcguucccccaguccaacgccgucauccaggacgaggagcgggacauccccgagcgcagcuggaacuccggguacgaguggaucacggacuuccccggcaagaccgugugguucgugcccagcaucaaguccggcaacgacaucgccaacugccugcggaagaacgggaagcgcgucauccagcugagccggaagaccuucgacaccgaguaccagaagacgaagaacaacgacugggacuacguggugaccaccgacaucuccgagaugggcgccaacuuccgcgcggaccgggucaucgacccccgccggugccucaagcccgugauccugaaggacgggcccgagcgcgucauccuggccggcccgaugcccgugaccguggccagcgccgcccagcggcgcgggcggaucggccgcaaccacaacaaggagggcgaccaguacaucuacauggggcagccccucaacaacgacgaggaccacgcgcacuggacggaggccaagaugcugcuggacaacaucaacacccccgagggcaucaucccggcccucuucgagcccgagcgggagaaguccgccgccaucgacggggaguaccgccugcgcggcgaggcgcggaagaccuucgucgagcugaugcgccgcggggaccuccccguguggcugagcuacaagguggccuccgagggcuuccaguacagcgaccgccgguggugcuucgacggcgagcgcaacaaccagguccuggaggagaacauggacguggagaucuggaccaaggagggggagcggaagaagcuccgcccccgguggcuggacgcccgcacguacagcgacccgcuggcccuccgggaguucaaggaguucgccgcgggccgccgguccgugagcggggaccugauccuggagaucggcaagcucccccagcaccugacccagcgcgcccagaacgcccuggacaaccucgucaugcugcacaacuccgagcagggcgggcgggccuaccgccacgcgauggaggagcugcccgacaccaucgagacccucaugcugcuggcccucaucgccgugcugaccggcggggugacgcuguucuuccucagcggccgggggcugggcaagaccuccaucggccugcucugcgucauggccagcuccgugcugcuguggauggccagcguggagccccacuggaucgcggccuccaucauccucgaguucuuccugaugguccugcucaucccggagcccgaccgccagcggacgccccaggacaaccagcuggccuacguggugaucgggcuccucuucaugauccugaccgucgccgccaacgagaugggccugcucgagacgaccaagaaggaccuggggaucggccacguggcgguggagaaccaccaccacgccaccaugcuggacgucgaccuccacccggccagcgccuggacccuguacgccguggcgacgaccaucaucacccccaugaugcgccacaccaucgagaacacgaccgccaacaucucccugaccgccaucgccaaccaggccgcgauccucauggggcuggacaagggcuggcccaucagcaagauggacaucggcgugccccugcucgcccuggggugcuacucccaggucaacccgcugacccucacggccgccgugcugaugcugguggcgcacuacgccaucaucggccccgggcuccaggccaaggccacccgggaggcccagaagcgcaccgcggccggcaucaugaagaaccccaccgucgacgggaucguggccaucgaccuggaccccguggucuacgacgccaaguucgagaagcagcugggccagaucaugcuccugauccugugcacgagccagauccuccugaugcgcaccaccugggcccugugcgaguccaucacccucgcgacgggcccgcugaccacccugugggaggggagccccggcaaguucuggaacaccacgaucgccguguccauggccaacaucuuccgggggagcuaccucgccggcgccggccuggcguucucccugaugaagucccucgggggcgggcgccggggcaccggggcccagggcgagacccugggcgagaaguggaagcgccagcugaaccagcucagcaaguccgaguucaacaucuacaagcggagcgggaucauggagguggaccgcuccgaggccaaggagggccugaagcgcggggagaccacgcgccacgccgucagccggggcaccgcgaagcugcgcugguucguggagcggaaccuggugaagcccgaggggaaggucaucgaccucggcugcggccgcgggggcugguccuacuacugcgccgggcugaagaaggugaccgaggugaagggcuacaccaagggcgggcccggccacgaggagccgauccccauggccacguacggguggaaccuggucaagcuccacagcggcaaggacguguucuucacgccgcccgagaagugcgacacccugcugugcgacaucggggaguccagcccgaaccccaccaucgaggagggccggacccuccgcgugcugaagauggucgagcccuggcugcgggggaaccaguucugcaucaagauccucaaccccuacaugccguccgugguggagacgcuggagcagaugcagcgcaagcacggcggcaugcugguccggaacccccucagccgcaacuccacccacgagauguacugggugagcugcgggaccggcaacaucguguccgccgucaacaugaccagccggaugcugcugaaccgcuucacgauggcccaccgcaagcccaccuacgagcgggacguggaccucggggcgggcacccgccacguggccgucgagcccgagguggccaaccuggacaucaucggccagcggaucgagaacaucaagcacgagcacaaguccaccuggcacuacgacgaggacaacccguacaagacgugggccuaccacgggagcuacgaggucaagcccuccggcagcgccuccagcauggugaacgggguggucaagcugcucaccaagcccugggacgugauccccauggugacccagaucgcgaugaccgacacgaccccguucggccagcagcgcgucuucaaggagaagguggacacccggacccccaaggccaagcgcgggacggcccagaucauggaggugaccgcccgguggcuguggggcuuccugagccgcaacaagaagccccggaucugcacccgcgaggaguucacccggaagguccgcuccaacgccgcgaucggcgccguguucguggacgagaaccaguggaacagcgccaaggaggccgucgaggacgagcgguucugggaccucgugcagaaggagcgcgagcugcacaagcaggggaagugcgcgacgugcguguacaacaugaugggcaagcgggagaagaagcugggggaguucggcaaggccaaggggucccgcgccaucugguacauguggcucggcgcccgguuccuggaguucgaggcccugggcuucaugaacgaggaccacugguucagccgcgagaacucccucagcggggucgagggcgaggggcugcacaagcugggcuacauccuccgggacaucuccaagauccccggcgggaacauguacgcggacgacaccgccgggugggacacccgcaucaccgaggacgaccugcagaacgaggccaagaucacggacaucauggagcccgagcacgcccugcucgccaccagcaucuucaagcugaccuaccagaacaagguggugcggguccagcgccccgcgaagaacgggaccgugauggacgugaucucccgccgggaccagcgcggcagcgggcaggucggcacguacggccugaacaccuucaccaacauggaggcccagcucauccggcagauggaguccgaggggaucuuccugcccagcgagcuggagaccccgaaccucgccgagcgcgugcuggacuggcuggagaaguacggcguggagcggcucaagcgcauggccaucuccggggacgacugcgucgugaagcccaucgacgaccgguucgccacggcgcugaccgcccugaacgacaugggcaaggugcgcaaggacaucccccagugggagcccagcaagggguggaacgacuggcagcaggucccguucugcucccaccacuuccaccagcucaucaugaaggacggccgggagaucguggugcccugccgcaaccaggacgagcuggucggccgggcccgcgugagccagggggccggcuggucccugcgggagaccgccugccucggcaagagcuacgcgcagauguggcagcugauguacuuccaccgccgggaccugcgccucgccgccaacgccaucugcagcgcggugcccgucgacugggugcccaccucccggacgaccuggagcauccacgcccaccaccaguggaugaccaccgaggacaugcuguccguguggaaccgcgucuggaucgaggagaacccguggauggaggacaagacccacgugagcuccuggggcgacgugcccuaccuggggaagcgggaggaccaguggugcggcagccucaucggccugacggcccgcgccaccugggccuccaacauccaggucgcgaucaaccaggugcgccggcugaucgggaacgagaacuaccucgacuacaugaccagcaugaagcgcuucaagaacgagggcgaccccgagggggcccugugguga

SEQ ID NO: 8587 - RNA, 9879 nt, Artificial Sequence
  derived and/or modified CDS sequence (opt1) from DENV-1__FJ898415__SS-prME
agcgugaccaugcugcucaugcugaugcccaccgcccuggccuuccaccucaccacccggggcggggagccccacaugaucgugaccaagcaggagcggggcaagagccugcuguucaagaccagcgcgggggugaacaugugcacccucaucgccauggaccugggcgagcugugcgaggacaccaugaccuacaagugcccccggaucaccgaggccgagcccgacgacguggacugcuggugcaacgccaccgacaccugggucaccuacgggaccugcucccagacgggcgagcaccggcgcgacaagcggagcguggcccucgcgccccacgugggccuggggcuggagacccgcaccgagaccuggauguccagcgagggcgccuggaagcagauccagcgggucgagacgugggcccuccgccaccccggguucaccgugaucgcccuguuccuggcgcacgccaucggcaccuccaucacccagaaggggaucaucuucauccuccugaugcuggugacgcccagcauggccaugcggugcgucggcaucggcucccgcgacuucguggaggggcucagcggcgccaccuggguggacgucgugcuggagcacggguccugcgugaccaccauggccaaggacaagcccacgcuggacaucgagcuccugaagaccgaggucaccaaccccgcggugcugcggaagcucugcaucgaggccaagaucagcaacaccacgaccgacucccgcugccccacccagggcgaggccacccugauggaggagcaggacgccaacuucgugugccggcgcacguucgucgaccggggcugggggaacggcugcgggcuguucggcaaggggagccucaucacgugcgccaaguucaagugcgugaccaagcuggagggcaagaucgugcaguacgagaaccugaaguacuccgucaucgugaccgugcacacgggcgaccagcaccaggucgggaacgagagcaccgagcacggcaccaccgcgaccaucacgccccaggcccccaccuccgagauccagcucaccgacuacggggcccugacccuggacugcagcccccgcacgggccucgacuucaacgagauggugcugcugaccaugaaggagaaguccuggcucguccacaagcagugguuccuggaccugccgcuccccuggaccagcggggccagcaccucccaggagacguggaaccggcaggaccugcuggugaccuucaagaccgcccacgcgaagaagcaggagguggucgugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgugaugugcaccggguccuucaagcucgagaaggaggucgcggagacgcagcacggcaccgugcuggugcagaucaaguacgagggcaccgacgcccccugcaagauccccuuccugacccaggacgagaagggggucacgcagaacggccggcugaucaccgccaacccgaucgugaccgacaaggagaagcccgugaacaucgaggccgagccgcccuucggggagagcuacaucgucaucggcgcgggcgagaaggcccucaagcuguccugguucaagaaggggagcaacaucggcaagauguucgaggccaccgcccgcggggcccggcgcauggcgauccugggcgacacggccugggacuucggguccaucggcggcguguucaccagcguggggaagcucguccaccagaucuucggcaccgccuacggggugcuguucuccggcgugagcuggaccaugaagaucgggaucggcguccugcucacguggcugggccugaacucccgcagcaccucccucagcaugaccugcaucgccguggggcuggugacccuguaccucggcgucauggugcaggccgacuccgggugcgugaucaacuggaagggccgggagcugaagugcgggagcggcaucuucgucacgaacgaggugcacaccuggaccgagcaguacaaguuccaggcggacuccccgaagcgccugagcgccgccaucggcaaggccugggaggagggggugugcggcauccggagcgccacccgccucgagaacaucauguggaagcagaucuccaacgagcugaaccacauccugcucgagaacgacaugaaguucaccgucguggugggggacgucgugggcauccuggcgcaggggaagaagaugauccggccccagcccauggagcacaaguacagcuggaaguccuggggcaaggccaagaucaucggcgccgacgugcagaacacgaccuucaucaucgacgggcccaacaccccggagugccccgacgaccagcgcgccuggaacaucugggaggucgaggacuacggcuucgggaucuucaccacgaacaucuggcugaagcuccgggacagcuacacccaggugugcgaccaccgccugauguccgcggccaucaaggacagcaaggccgugcacgccgacaugggcuacuggaucgaguccgagaagaacgagaccuggaagcuggcccgggcgagcuucaucgaggucaagaccugcaucuggcccaagucccacacgcucuggagcaacggcgugcuggaguccgagaugaucauccccaagaucuacgggggcccgaucagccagcacaacuaccgccccggguacuucacccagaccgccggccccuggcaccuggggaagcucgagcuggacuucgaccugugcgagggcaccacgguggucguggacgagcacugcggcaaccgggggccgucccuccgcaccaccaccgugacgggcaagaccauccacgaguggugcugccggagcugcacccugccgccccugcgcuucaagggggaggacggcugcugguacgggauggagauccggcccgucaaggagaaggaggagaaccucgugaaguccauggugagcgccggcuccggcgaggucgacagcuucagccuggggcugcucugcaucuccaucaugaucgaggaggugaugcgcagccgguggucccgcaagaugcugaugaccggcacgcuggccguguuccuccugcugaucauggggcagcucaccuggaacgaccugauccggcugugcaucauggucggcgccaacgcgagcgaccgcauggggaugggcaccaccuaccucgcccugauggccacguucaagaugcgcccgauguucgccguggggcugcuguuccggcgccugaccucccgggaggugcugcuccugaccaucgggcugagccucgucgccuccguggagcugcccaacagccuggaggagcucggcgacgggcuggcgaugggcaucaugauccugaagcuccugaccgacuuccagucccaccagcugugggccacgcuccugagccugaccuucaucaagaccacccucucccugcacuacgccuggaagacgauggccaugguccugagcaucgugucccucuucccccugugccugagcaccaccucccagaagaccacguggcuccccgugcugcugggcagccucgggugcaagccgcugaccauguuccugaucgcggagaacaagaucuggggccgcaaguccuggccccucaacgaggggaucauggccgucggcguggugagcauccugcuguccagccuccugaagaacgacgucccccuggccgggccccucaucgccggcggcaugcugaucgccugcuacgugaucagcggguccagcgcggaccugucccucgagaaggccgccgaggugagcugggaggaggaggccgagcacuccggcgccagccacaacauccuggucgaggugcaggacgacgggaccaugaagaucaaggacgaggagcgggacgacacccugaccauccuccugaaggcgacgcugcucgccguguccggcgucuacccgcugagcauccccgccacccuguucgugugguacuucuggcagaagaagaagcagcgcuccggggugcugugggacacccccagcccgcccgaggucgagcgggccgugcucgacgacggcaucuaccgcaucaugcagcggggccugcuggggcgcucccaggugggcgucgggguguuccaggagaacguguuccacaccauguggcacgucacgcggggcgccgugcucauguaccaggggaagcgccuggagcccagcugggcguccgugaagaaggaccugaucagcuacggcggcggguggcggcuccagggcuccuggaacaccggggaggagguccaggugaucgccguggagcccggcaagaaccccaagaacguccagaccgcccccgggaccuucaagacgcccgagggcgaggugggcgccaucgcccuggacuucaagcccgggaccagcggcucccccaucgugaaccgcgaggggaagaucgucggccuguacggcaacgggguggugaccaccagcggcacguacgucuccgcgaucgcccaggccaaggccagccaggaggggccgcuccccgagaucgaggacgagguguuccggaagcgcaaccugaccaucauggaccugcaccccggcagcgggaagacccggcgcuaccucccggcgaucgugcgggaggccaucaagcgcaagcugcggacccugauccucgcccccacgcgcgucguggccuccgagauggccgaggcgcugaagggcaugcccauccgcuaccagaccaccgccgucaagagcgagcacaccggcaaggagaucgucgaccugaugugccacgccacguucaccaugcggcuccugucccccgugcgcgugccgaacuacaacaugaucaucauggacgaggcccacuucaccgaccccagcuccaucgccgcgcggggguacaucagcacccgcgucggcaugggggaggccgccgccaucuucaugacggccacgccgcccggcuccguggaggcguucccgcagagcaacgccgugauccaggacgaggagcgggacauccccgagcgcuccuggaacagcggguacgaguggaucaccgacuuccccggcaagaccgucugguucgugcccuccaucaagagcggcaacgacaucgccaacugccugcggaagaacgggaagcgcgugauccagcucucccggaagacguucgacaccgaguaccagaagaccaagaacaacgacugggacuacgucgugaccacggacaucagcgagaugggcgccaacuuccgcgcggaccgggugaucgacccgcgccggugccugaagcccgucauccugaaggacgggcccgagcgcgugauccucgccggccccaugccggucaccguggccuccgccgcccagcggcgcgggcggaucggccgcaaccacaacaaggagggcgaccaguacaucuacauggggcagccccugaacaacgacgaggaccacgcgcacuggaccgaggccaagaugcugcucgacaacaucaacacccccgagggcaucauccccgcccuguucgagccggagcgggagaaguccgccgccaucgacggggaguaccgccugcgcggcgaggcgcggaagacguucguggagcucaugcgccgcggggaccugcccgucuggcuguccuacaagguggccagcgagggcuuccaguacuccgaccgccgguggugcuucgacggcgagcgcaacaaccaggugcucgaggagaacauggacgucgagaucuggaccaaggagggggagcggaagaagcugcgcccccgguggcuggacgcccgcaccuacagcgacccccucgcccugcgggaguucaaggaguucgccgcgggccgccggagcguguccggggaccugauccucgagaucggcaagcugccgcagcaccugacccagcgcgcccagaacgcccucgacaaccuggugaugcugcacaacagcgagcagggcgggcgggccuaccgccacgcgauggaggagcuccccgacacgaucgagacccugaugcugcucgcccugaucgccguccugaccggcggggugacccucuucuuccuguccggccgggggcugggcaagaccagcaucggccuccugugcgugauggccuccagcguccugcucuggauggccuccguggagccccacuggaucgcggccagcaucauccuggaguucuuccugauggugcuccugauccccgagccggaccgccagcggacgccccaggacaaccagcuggccuacgucgugaucgggcuccuguucaugauccugaccguggccgccaacgagaugggccuccuggagaccaccaagaaggaccuggggaucggccacgucgcgguggagaaccaccaccacgccacgaugcucgacguggaccugcaccccgccuccgccuggacccuguacgccgucgcgaccaccaucaucacgccgaugaugcgccacaccaucgagaacaccaccgccaacaucagccucacggccaucgccaaccaggccgcgauccugauggggcuggacaagggcuggcccaucuccaagauggacaucggcgugccccuccuggcccuggggugcuacagccaggugaacccccucacccugaccgccgccguccugaugcucguggcgcacuacgccaucaucggcccggggcugcaggccaaggccacccgggaggcccagaagcgcacggcggccggcaucaugaagaaccccaccguggacgggaucgucgccaucgaccuggaccccgugguguacgacgccaaguucgagaagcagcucggccagaucaugcugcugauccucugcaccucccagauccugcugaugcgcaccacgugggcccucugcgagagcaucacccuggcgaccggcccccugaccacgcucugggagggguccccgggcaaguucuggaacaccaccaucgccgucagcauggccaacaucuuccggggguccuaccuggccggcgccggccuggcguucagccucaugaagucccucgggggcgggcgccgggggaccggggcccagggcgagacgcugggcgagaaguggaagcgccagcucaaccagcugagcaagagcgaguucaacaucuacaagcgguccgggaucauggagguggaccgcagcgaggccaaggagggccugaagcgcggggagaccacccgccacgccgugucccggggcaccgcgaagcugcgcugguucgucgagcggaaccucgugaagcccgaggggaaggugaucgaccugggcugcggccgcgggggcuggagcuacuacugcgccgggcugaagaaggucacggaggugaagggcuacaccaagggcgggcccggccacgaggagcccaucccgauggccaccuacggguggaaccucgugaagcugcacuccggcaaggacgucuucuucacgccgcccgagaagugcgacacgcugcucugcgacaucggggagagcucccccaacccgaccaucgaggagggccggacccugcgcgugcugaagaugguggagcccuggcuccgggggaaccaguucugcaucaagauccugaaccccuacaugcccagcgucguggagacccuggagcagaugcagcgcaagcacggcggcaugcucgugcggaacccgcugucccgcaacagcacccacgagauguacugggucuccugcgggacgggcaacaucgugagcgccgugaacaugaccucccggaugcugcucaaccgcuucaccauggcccaccgcaagcccaccuacgagcgggacgucgaccugggggcgggcacgcgccacguggccguggagcccgaggucgccaaccuggacaucaucggccagcggaucgagaacaucaagcacgagcacaagagcaccuggcacuacgacgaggacaaccccuacaagaccugggccuaccacggguccuacgaggugaagccgagcggcuccgccagcuccauggucaacgggguggugaagcuccugaccaagcccugggacgucauccccauggugacgcagaucgcgaugaccgacaccacccccuucggccagcagcgcguguucaaggagaaggucgacacgcggaccccgaaggccaagcgcgggaccgcccagaucauggaggugaccgcccgguggcuguggggcuuccucagccgcaacaagaagccccggaucugcacgcgcgaggaguucacccggaaggugcgcagcaacgccgcgaucggcgccgucuucguggacgagaaccaguggaacuccgccaaggaggccguggaggacgagcgguucugggaccugguccagaaggagcgcgagcugcacaagcaggggaagugcgcgaccugcguguacaacaugaugggcaagcgggagaagaagcucggggaguucggcaaggccaaggggagccgcgccaucugguacauguggcugggcgcccgguuccuggaguucgaggcccucggcuucaugaacgaggaccacugguucucccgcgagaacagccuguccgggguggagggcgaggggcugcacaagcucggcuacauccugcgggacaucagcaagauccccgggggcaacauguacgcggacgacaccgccggcugggacacgcgcaucaccgaggacgaccugcagaacgaggccaagaucaccgacaucauggagccggagcacgcccuccuggccaccuccaucuucaagcugacguaccagaacaaggucgugcgggugcagcgccccgcgaagaacgggaccgucauggacgugaucagccgccgggaccagcgcggcuccggccaggugggcaccuacggccucaacaccuucacgaacauggaggcccagcugauccggcagauggagagcgaggggaucuucucccccagcgagcuggagauccccaaccucgccgagcgcguccuggacuggcuggagaaguacggcguggagcggcucaagcgcauggccaucuccggggacgacugcguggucaagccgaucgacgaccgguucgccaccgcgcugaccgcccugaacgacaugggcaaggugcgcaaggacgugccccagugggagcccagcaagggguggaacgacuggcagcagguccccuucugcucccaccacuuccaccagcucaucaugaaggacggccgggagaucguggugccgugccgcaaccaggacgagcuggucggccgggcccgcgugagccagggggccggcuggucccugcgggagaccgccugccucggcaagagcuacgcgcagauguggcagcugauguacuuccaccgccgggaccugcgccucgccgccaacgccaucugcagcgcggugcccgucgacugggugcccacgucccggaccaccuggagcauccacgcccaccaccaguggaugaccacggaggacaugcuguccguguggaaccgcgucuggaucgaggagaaccccuggauggaggacaagacccacgugagcuccuggggcgacgugccguaccuggggaagcgggaggaccaguggugcggcagccucaucggccugaccgcccgcgccaccugggccuccaacauccaggucgcgaucaaccaggugcgccggcugaucgggaacgagaacuaccucgacuacaugaccagcaugaagcgcuucaagaacgagggcgaccccgagggggcccugugguga
